United States Patent 11,446,398 (REGULATED BIOCIRCUIT SYSTEMS) - sequence listing, part 13

SEQ ID NO: 54918 - protein, 1432 aa, Homo sapiens
  Payload ID: 10847
  Gene Symbol: NWD1
  Gene Name: NACHT and WD repeat domain containing 1
  Uniprot ID: Q149M9
  ENSP ID: ENSP00000369136
MQRGKPCRALPTLKCQTFCQRHGLMFEVVDLRWGIRNIEATDHLTTELCLEEVDRCWKTSIGPAFVALIGDQYGPCLIPSRIDEKEWEVLRDHLTARPSDLELVARYFQRDENAFPPTYVLQAPGTGEACEPEEATLTSVLRSGAQEARRLGLITQEQWQHYHRSVIEWEIERSLLSSEDREQGATVFLREIQDLHKHILEDCALRMVDRLADGCLDADAQNLLSSLKSHITDMHPGVLKTHRLPWSRDLVNPKNKTHACYLKELGEQFVVRANHQVLTRLRELDTAGQELAWLYQEIRHHLWQSSEVIQTFCGRQELLARLGQQLRHDDSKQHTPLVLFGPPGIGKTALMCKLAEQMPRLLGHKTVTVLRLLGTSQMSSDARGLLKSICFQVCLAYGLPLPPAQVLDAHTRVVQFFHTLLHTVSCRNFESLVLLLDAMDDLDSVRHARRVPWLPLNCPPRVHLILSACSGALGVLDTLQRVLLDPEAYWEVKPLSGNQGQQMIQLLLAAARRTLSPVHTDLLWASLPECGNPGRLRLAFEEARKWASFTVPVPLATTAEEATHQLCTRLEQTHGQLLVAHVLGYIVSSRHGLSEAELKDVLSLDDEVLQDVYRDWTPPSKELLRFPPLLWVRLRRDLGYYLARRPVDGFTLLAIAHRQLVEVVRERYLSGSERAKRHGVLADFFSGTWSQGTKKLITLPLVGKPLNLDRKVAPQPLWFSHTVANLRKLKELPYHLLHSGRLEELKQEVLGSMSWISCRGISGGIEDLLDDFDLCAPHLDSPEVGLVREALQLCRPAVELRGMERSLLYTELLARLHFFATSHPALVGQLCQQAQSWFQLCAHPVLVPLGGFLQPPGGPLRATLSGCHKGITAMAWGVEEKLLVIGTQDGIMAVWDMEEQHVIHMLTGHTGEVRCVKIFAKGTLANSASKDYTLHLWNLLSGQEKFTIWDGGSKNPAEPQIWNLHVDEAHKVVYSASGSKINAWNLETAEPVFHILGDASDPWMCMAVLASQATLLTVSRDGVVSLWSSATGKLQGKQHMSSIKEETPTCAVSVQKQGKLVTGFSNGSISLVSSKGDRLLEKLPDAVRFLVVSEDESLLAAGFGRSVRIFLADSRGFRRFMAMDLEHEDMVETAVFGTENNLIITGSLDALIQVWSLSEQGTLLDILEGVGAPVSLLARGGALVASASPQSSSFKVWDLSDAHRSRVPAPFLDRTGLTAVSHNGSYVYFPKIGDKNKVTIWDLAEGEEQDSLDTSSEIRCLEVAEQRKLLFTGLVSGVVLVFPLNSRQDVICIPPPEARKAINCMSLSKCEDRLAIAYDNIVLVLDITSGDPCPVIDGPRYTFYTQLPETLSSVAILTDYRVVYSMTNGDLFLYECATSKAFPLETHRSRVACVEVSHKEQLVVSGSEDALLCLWDLQARKWKFEMSYTAPC

SEQ ID NO: 54919 - protein, 76 aa, Homo sapiens
  Payload ID: 10847
  Gene Symbol: NWD1
  Gene Name: NACHT and WD repeat domain containing 1
  Uniprot ID: Q149M9
  ENSP ID: ENSP00000400248
MQRGKPCRALPTLKCQTFCQRHGLMFEVVDLRWGIRNIEATDHLTTELCLEEVDRCWKTSIGPAFVEKCADPCPGQ

SEQ ID NO: 54920 - protein, 179 aa, Homo sapiens
  Payload ID: 10847
  Gene Symbol: NWD1
  Gene Name: NACHT and WD repeat domain containing 1
  ENSP ID: ENSP00000428224
MQRGKPCRALPTLKCQTFCQRHGLMFEVVDLRWGIRNIEATDHLTTELCLEEVDRCWKTSIGPAFVALIGDQYGPCLIPSRIDEKEWEVLRDHLTARPSDLELVARYFQRDENAFPPTYVLQAPGTGEACEPEEATLTSVLRSGAQEARRLGLITQEQWQHYHRSGEAAGTPLWRPTRN

SEQ ID NO: 54921 - protein, 1432 aa, Homo sapiens; identical to SEQ ID NO: 54918
  Payload ID: 10847
  Gene Symbol: NWD1
  Gene Name: NACHT and WD repeat domain containing 1
  Uniprot ID: Q149M9
  ENSP ID: ENSP00000428579

SEQ ID NO: 54922 - protein, 1564 aa, Homo sapiens
  Payload ID: 10847
  Gene Symbol: NWD1
  Gene Name: NACHT and WD repeat domain containing 1
  Uniprot ID: Q149M9
  ENSP ID: ENSP00000447224
MQRGKPCRALPTLKCQTFCQRHGLMFEVVDLRWGIRNIEATDHLTTELCLEEVDRCWKTSIGPAFVALIGDQYGPCLIPSRIDEKEWEVLRDHLTARPSDLELVARYFQRDENAFPPTYVLQAPGTGEACEPEEATLTSVLRSGAQEARRLGLITQEQWQHYHRSVIEWEIERSLLSSEDREQGATVFLREIQDLHKHILEDCALRMVDRLADGCLDADAQNLLSSLKSHITDMHPGVLKTHRLPWSRDLVNPKNKTHACYLKELGEQFVVRANHQVLTRLRELDTAGQELAWLYQEIRHHLWQSSEVIQTFCGRQELLARLGQQLRHDDSKQHTPLVLFGPPGIGKTALMCKLAEQMPRLLGHKTVTVLRLLGTSQMSSDARGLLKSICFQVCLAYGLPLPPAQVLDAHTRVVQFFHTLLHTVSCRNFESLVLLLDAMDDLDSVRHARRVPWLPLNCPPRVHLILSACSGALGVLDTLQRVLLDPEAYWEVKPLSGNQGQQMIQLLLAAARRTLSPVHTDLLWASLPECGNPGRLRLAFEEARKWASFTVPVPLATTAEEATHQLCTRLEQTHGQLLVAHVLGYIVSSRHGLSEAELKDVLSLDDEVLQDVYRDWTPPSKELLRFPPLLWVRLRRDLGYYLARRPVDGFTLLAIAHRQLVEVVRERYLSGSERAKRHGVLADFFSGTWSQGTKKLITLPLVGKPLNLDRKVAPQPLWFSHTVANLRKLKELPYHLLHSGRLEELKQEVLGSMSWISCRGISGGIEDLLDDFDLCAPHLDSPEVGLVREALQLCRPAVELRGMERSLLYTELLARLHFFATSHPALVGQLCQQAQSWFQLCAHPVLVPLGGFLQPPGGPLRATLSGCHKGITAMAWGVEEKLLVIGTQDGIMAVWDMEEQHVIHMLTGHTGEVRCVKIFAKGTLANSASKDYTLHLWNLLSGQEKFTIWDGGSKNPAEPQIWNLHVDEAHKVVYSASGSKINAWNLETAEPVFHILGDASDPWMCMAVLASQATLLTVSRDGVVSLWSSATGKLQGKQHMSSIKEETPTCAVSVQKQGKLVTGFSNGSISLVSSKGDRLLEKLPDAVRFLVVSEDESLLAAGFGRSVRIFLADSRGFRRFMAMDLEHEDMVETAVFGTENNLIITGSLDALIQVWSLSEQGTLLDILEGVGAPVSLLARGGALVASASPQSSSFKVWDLSDAHRSRVPAPFLDRTGLTAVSHNGSYVYFPKIGDKNKVTIWDLAEGEEQDSLDTSSEIRCLEVAEQRKLLFTGLVSGVVLVFPLNSRQDVICIPPPEARKAINCMSLSKCEDRLAIAYDNIVLVLDITSGDPCPVIDGPRYTFYTQLPETLSSVAILTDYRVVYSMTNGDLFLYECATSKAFPLETHRSRVACVEVSHKEQLVVSGSEDALLCLWDLQARKWKFEMSYTSSYCRGVQCACFSKDDKYVYVGLKDRSILVWSVLDGTLLTVQFVHAVVNRIIPTTSGFIAPTRHGYLIRENFQCLSAKASPQDPLKNFKKAMWMVKSRQREELVAAAGAPQDLESESAQGNETKSNKCSQVCLIV

SEQ ID NO: 54923 - protein, 1522 aa, Homo sapiens
  Payload ID: 10847
  Gene Symbol: NWD1
  Gene Name: NACHT and WD repeat domain containing 1
  ENSP ID: ENSP00000447548
MQRGKPCRALPTLKCQTFCQRHGLMFEVVDLRWGIRNIEATDHLTTELCLEEVDRCWKTSIGPAFVALIGDQYGPCLIPSRIDEKEWEVLRDHLTARPSDLELVARYFQRDENAFPPTYVLQAPGTGEACEPEEATLTSVLRSGAQEARRLGLITQEQWQHYHRSVIEWEIERSLLSSEDREQGATVFLREIQDLHKHILEDCALRMVDRLADGCLDADAQNLLSSLKSHITDMHPGVLKTHRLPWSRDLVNPKNKTHACYLKELGEQFVVRANHQVLTRLRELDTAGQELAWLYQEIRHHLWQSSEVIQTFCGRQELLARLGQQLRHDDSKQHTPLVLFGPPGIGKTALMCKLAEQMPRLLGHKTVTVLRLLGTSQMSSDARGLLKSICFQVCLAYGLPLPPAQVLDAHTRVVQFFHTLLHTVSCRNFESLVLLLDAMDDLDSVRHARRVPWLPLNCPPRVHLILSACSGALGVLDTLQRVLLDPEAYWEVKPLSGNQGQQMIQLLLAAARRTLSPVHTDLLWASLPECGNPGRLRLAFEEARKWASFTVPVPLATTAEEATHQLCTRLEQTHGQLLVAHVLGYIVSSRHGLSEAELKDVLSLDDEVLQDVYRDWTPPSKELLRFPPLLWVRLRRDLGYYLARRPVDGFTLLAIAHRQLVEVVRERYLSGSERAKRHGVLADFFSGTWSQGTKKLITLPLVGKPLNLDRKVAPQPLWFSHTVANLRKLKELPYHLLHSGRLEELKQEVLGSMSWISCRGISGGIEDLLDDFDLCAPHLDSPEVGLVREALQLCRPAVELRGMERSLLYTELLARLHFFATSHPALVGQLCQQAQSWFQLCAHPVLVPLGGFLQPPGGPLRATLSGCHKGITAMAWGVEEKLLVIGTQDGIMAVWDMEEQHVIHMLTGHTGEVRCVKIFAKGTLANSASKDYTLHLWNLLSGQEKFTIWDGGSKNPAEPQIWNLHVDEAHKVVYSASGSKINAWNLETAEPVFHILGDASDPWMCMAVLASQATLLTVSRDGVVSLWSSATGKLQGKQHMSSIKEETPTCAVSVQKQGKLVTGFSNGSISLVSSKGDRLLEKLPDAVRFLVVSEDESLLAAGFGRSVRIFLADSRGFRRFMAMDLEHEDMVETAVFGTENNLIITGSLDALIQVWDLSDAHRSRVPAPFLDRTGLTAVSHNGSYVYFPKIGDKNKVTIWDLAEGEEQDSLDTSSEIRCLEVAEQRKLLFTGLVSGVVLVFPLNSRQDVICIPPPEARKAINCMSLSKCEDRLAIAYDNIVLVLDITSGDPCPVIDGPRYTFYTQLPETLSSVAILTDYRVVYSMTNGDLFLYECATSKAFPLETHRSRVACVEVSHKEQLVVSGSEDALLCLWDLQARKWKFEMSYTSSYCRGVQCACFSKDDKYVYVGLKDRSILVWSVLDGTLLTVQFVHAVVNRIIPTTSGFIAPTRHGYLIRENFQCLSAKASPQDPLKNFKKAMWMVKSRQREELVAAAGAPQDLESESAQGNETKSNKCSQVCLIV

SEQ ID NO: 54924 - protein, 1742 aa, Homo sapiens
  Payload ID: 10848
  Gene Symbol: NWD2
  Gene Name: NACHT and WD repeat domain containing 2
  Uniprot ID: Q9ULI1
  ENSP ID: ENSP00000309501
MWPAGAGTKLPCPRDSALRRAAFSGNLTALPSHLVPAGRSVRVFISANPEDTGAERQALRENVYPKLREFCRENYGLEFQVIDLYWGVEEDEWDSPELQKTRMKLLENCLKTSAGPCFVGLLGEKYGNIRIPGEVEASEFEMILDAAIEAKLETKLLEEWYCRDENSVPAAYYLRPKSEMLRSNRNAMQPSTNAENEKTWQEISDEIKKIFKAAVKLLHEKGKMKHSQAKRYLFSAIEDEFDFALGKQTPAFLKKCVCYIRKIANIERFVKIPEMGKYMDITGTEPRIIRDPEAQEKLIKLRDEFIPTIVASSNLRVYTSVTHCDMKLGYSQEIENHYIEGLGKQFYEDMIDIIQATIQQNFDTETDTLYDEILQHSSLCKTYASFYEYKCESLNIVHNYILPSKAGHINPLIIYGGPCTGKTLLLAEVAKKAYGWLHEDTGPESDPVVIVRFLGTTDMSSDLRTLLLSVCEQLAVNYRCLVQSYPKKIHDLCDLFINLLNESSLQRPLVIIFDALEQLSENDDARKLWWLPAHLPRFVRIVLSTLPNKHGILQKLRCLIHEEDNYIELIPRDRKMCSQVLKHQLLRVKRKVTSGQQIYVNNALSKCTLPMFVNLTFREVRHWRSHKDVDESSLSVTVHESIEQLFWSLEKKCGQKLVSRALGYITMAKMGLSEMELEDVLALDNSVMSELKENTRPSNPLRVPYLYIARLKEGLSGYLIERHVKNVTLLVWANRHLQLIAQKLYLQDDNDLREMHTILADYFLGVWSGGRRKAFCLEDPYLNGCLDLENRSLLEEEKHFMEQASFDRQAPDQPWVFQCNPLEPDIFFVNHRKMSELLYHLTRCGKTDDLLYGIIMNFSWLYTMIKIGQFDKVLSDIELAYNYSQEKELKFLANTLRSIKNKVTAFPGSLSAELQQRLLPVVSSLPKLRHLLLECDKDGPKYCSIVPLHSSMDVTYSPERLPLSSSHLHVTEILPTCNPSTVLTALENGSISTWDVETRQLLRQITTAQSVILGMKLTSDEKYLVVATTNNTLLIYDNVNSCLLSEVEIKGTKHGSSATYINGFTLSANHALAWLEASKDVTVIDLLYGWPLYQFHCWYEVTCVQCSLDGLYAFCGQYLNTTTIFHLGSGEKLCTVTSEFSGGFVKFLLILDTAQEMVMVDSEGSLSVWNTEDISSPQLTDDFDCRREDSEVVSIELSEDQSAVLICKALSIELLDTGLWKVAEKFRAKHNERFISAVLSKNGDCIIATMENTSAVFFWRRDTGQCMASLQEISGSIVKLVKSSHHNMLLSLSTSGVLSIWDIDIITAMSNIDKTGKPIQSLLLPARGEIIYSLDGSDCVHKWNFSSGFIEAVFKHEGIVEHCVLTSTGDIMVTSDDKSSQYVWHTSSGENLFRINGQRISQLLITHNDQFVVSLCEENASRVWRLATGHRVCNILTTLQNAFITSANTFVVGMTKSKVLAVSLWTGSITKKFCCEDGTTIVNFKLIPDCPDIIVFITSAETVNIWSLTDEVICRRVQLPNNFLKNLEDFEISPNGKLGIIARGDENINVLDLYSGKLRVVHASGIIWRQRLSRDGRYLVYICFRNGEEEDENGAIFSLIVMRLADGKNIGACSLYKTPTFLALSQRHLNIIVGFDDGSIGIYTVVDRVDAALKIKIATSNSRQIFNNATHTSRPKCNSYCFKISVDCLWRESTEVFARDSPITVSDSTESNEATPSKKHNSCYERVCSALEARGHSYAPDN

SEQ ID NO: 54925 - protein, 393 aa, Homo sapiens
  Payload ID: 10849
  Gene Symbol: NAPEPLD
  Gene Name: N-acyl phosphatidylethanolamine phospholipase D
  Uniprot ID: Q6IQ20
  ENSP ID: ENSP00000340093
MDENESNQSLMTSSQYPKEAVRKRQNSARNSGASDSSRFSRKSFKLDYRLEEDVTKSKKGKDGRFVNPWPTWKNPSIPNVLRWLIMEKDHSSVPSSKEELDKELPVLKPYFITNPEEAGVREAGLRVTWLGHATVMVEMDELIFLTDPIFSSRASPSQYMGPKRFRRSPCTISELPPIDAVLISHNHYDHLDYNSVIALNERFGNELRWFVPLGLLDWMQKCGCENVIELDWWEENCVPGHDKVTFVFTPSQHWCKRTLMDDNKVLWGSWSVLGPWNRFFFAGDTGYCPAFEEIGKRFGPFDLAAIPIGAYEPRWFMKYQHVDPEEAVRIHTDVQTKKSMAIHWGTFALANEHYLEPPVKLNEALERYGLNAEDFFVLKHGESRYLNNDDENF

SEQ ID NO: 54926 - protein, 393 aa, Homo sapiens; identical to SEQ ID NO: 54925
  Payload ID: 10849
  Gene Symbol: NAPEPLD
  Gene Name: N-acyl phosphatidylethanolamine phospholipase D
  Uniprot ID: Q6IQ20
  ENSP ID: ENSP00000392775

SEQ ID NO: 54927 - protein, 143 aa, Homo sapiens
  Payload ID: 10849
  Gene Symbol: NAPEPLD
  Gene Name: N-acyl phosphatidylethanolamine phospholipase D
  ENSP ID: ENSP00000395138
  MOD_RES (1)..(1): Any amino acid
XQHWCKRTLMDDNKVLWGSWSVLGPWNRFFFAGDTGYCPAFEEIGKRFGPFDLAAIPIGAYEPRWFMKYQHVDPEEAVRIHTDVQTKKSMAIHWGTFALANEHYLEPPVKLNEALERYGLNAEDFFVLKHGESRYLNNDDENF

SEQ ID NO: 54928 - protein, 124 aa, Homo sapiens
  Payload ID: 10849
  Gene Symbol: NAPEPLD
  Gene Name: N-acyl phosphatidylethanolamine phospholipase D
  ENSP ID: ENSP00000404391
MDENESNQSLMTSSQYPKEAVRKRQNSARNSGASDSSRFSRKSFKLDYRLEEDVTKSKKGKDGRFVNPWPTWKNPSIPNVLRWLIMEKDHSSVPSSKEELDKELPVLKPYFITNPEEAGVREAG

SEQ ID NO: 54929 - protein, 393 aa, Homo sapiens; identical to SEQ ID NO: 54925
  Payload ID: 10849
  Gene Symbol: NAPEPLD
  Gene Name: N-acyl phosphatidylethanolamine phospholipase D
  Uniprot ID: Q6IQ20
  ENSP ID: ENSP00000407112

SEQ ID NO: 54930 - protein, 393 aa, Homo sapiens; identical to SEQ ID NO: 54925
  Payload ID: 10849
  Gene Symbol: NAPEPLD
  Gene Name: N-acyl phosphatidylethanolamine phospholipase D
  Uniprot ID: Q6IQ20
  ENSP ID: ENSP00000412376

SEQ ID NO: 54931 - protein, 5 aa, Homo sapiens
  Payload ID: 10849
  Gene Symbol: NAPEPLD
  Gene Name: N-acyl phosphatidylethanolamine phospholipase D
  ENSP ID: ENSP00000414778
MDENE

SEQ ID NO: 54932 - protein, 393 aa, Homo sapiens; identical to SEQ ID NO: 54925
  Payload ID: 10849
  Gene Symbol: NAPEPLD
  Gene Name: N-acyl phosphatidylethanolamine phospholipase D
  Uniprot ID: Q6IQ20
  ENSP ID: ENSP00000419188

SEQ ID NO: 54933 - protein, 393 aa, Homo sapiens; identical to SEQ ID NO: 54925
  Payload ID: 10849
  Gene Symbol: NAPEPLD
  Gene Name: N-acyl phosphatidylethanolamine phospholipase D
  Uniprot ID: Q6IQ20
  ENSP ID: ENSP00000481285

SEQ ID NO: 54934 - protein, 393 aa, Homo sapiens; identical to SEQ ID NO: 54925
  Payload ID: 10849
  Gene Symbol: NAPEPLD
  Gene Name: N-acyl phosphatidylethanolamine phospholipase D
  Uniprot ID: Q6IQ20
  ENSP ID: ENSP00000482162

SEQ ID NO: 54935 - protein, 393 aa, Homo sapiens; identical to SEQ ID NO: 54925
  Payload ID: 10849
  Gene Symbol: NAPEPLD
  Gene Name: N-acyl phosphatidylethanolamine phospholipase D
  Uniprot ID: Q6IQ20
  ENSP ID: ENSP00000487770

SEQ ID NO: 54936 - protein, 143 aa, Homo sapiens; identical to SEQ ID NO: 54927
  Payload ID: 10849
  Gene Symbol: NAPEPLD
  Gene Name: N-acyl phosphatidylethanolamine phospholipase D
  ENSP ID: ENSP00000488070
  MOD_RES (1)..(1): Any amino acid

SEQ ID NO: 54937 - protein, 124 aa, Homo sapiens; identical to SEQ ID NO: 54928
  Payload ID: 10849
  Gene Symbol: NAPEPLD
  Gene Name: N-acyl phosphatidylethanolamine phospholipase D
  ENSP ID: ENSP00000488410

SEQ ID NO: 54938 - protein, 393 aa, Homo sapiens; identical to SEQ ID NO: 54925
  Payload ID: 10849
  Gene Symbol: NAPEPLD
  Gene Name: N-acyl phosphatidylethanolamine phospholipase D
  Uniprot ID: Q6IQ20
  ENSP ID: ENSP00000488504

SEQ ID NO: 54939 - protein, 393 aa, Homo sapiens; identical to SEQ ID NO: 54925
  Payload ID: 10849
  Gene Symbol: NAPEPLD
  Gene Name: N-acyl phosphatidylethanolamine phospholipase D
  Uniprot ID: Q6IQ20
  ENSP ID: ENSP00000488648

SEQ ID NO: 54940 - protein, 5 aa, Homo sapiens
  Payload ID: 10849
  Gene Symbol: NAPEPLD
  Gene Name: N-acyl phosphatidylethanolamine phospholipase D
  ENSP ID: ENSP00000488856
MDENE

SEQ ID NO: 54941 - protein, 359 aa, Homo sapiens
  Payload ID: 10850
  Gene Symbol: NAAA
  Gene Name: N-acylethanolamine acid amidase
  Uniprot ID: Q02083
  ENSP ID: ENSP00000286733
MRTADREARPGLPSLLLLLLAGAGLSAASPPAAPRFNVSLDSVPELRWLPVLRHYDLDLVRAAMAQVIGDRVPKWVHVLIGKVVLELERFLPQPFTGEIRGMCDFMNLSLADCLLVNLAYESSVFCTSIVAQDSRGHIYHGRNLDYPFGNVLRKLTVDVQFLKNGQIAFTGTTFIGYVGLWTGQSPHKFTVSGDERDKGWWWENAIAALFRRHIPVSWLIRATLSESENFEAAVGKLAKTPLIADVYYIVGGTSPREGVVITRNRDGPADIWPLDPLNGAWFRVETNYDHWKPAPKEDDRRTSAIKALNATGQANLSLEALFQILSVVPVYNNFTIYTTVMSAGSPDKYMTRIRNPSRK

SEQ ID NO: 54942 - protein, 167 aa, Homo sapiens
  Payload ID: 10850
  Gene Symbol: NAAA
  Gene Name: N-acylethanolamine acid amidase
  ENSP ID: ENSP00000423142
MRTADREARPGLPSLLLLLLAGAGLSAASPPAAPRFNVSLDSVPELRWLPVLRHYDLDLVRAAMAQVIGDRVPKWVHVLIGKVVLELERFLPQPFTGEIRGMCDFMNLSLADCLLVNLAYESSVFCTSIVAQDSRGHIYHGRNLDYPFGNVLRKLTVDVQFLKNGQV

SEQ ID NO: 54943 - protein, 139 aa, Homo sapiens
  Payload ID: 10850
  Gene Symbol: NAAA
  Gene Name: N-acylethanolamine acid amidase
  ENSP ID: ENSP00000423397
  MOD_RES (1)..(1): Any amino acid
XDKGWWWENAIAALFRRHIPVSWLIRATLSESENFEAAVGKLAKTPLIADVYYIVGGTSPREGVVITRNRDGPADIWPLDPLNGAWFRVETNYDHWKPAPKEDDRRTSAIKALNATGQANLSLEALFQLHNLYYGNERR

SEQ ID NO: 54944 - protein, 252 aa, Homo sapiens
  Payload ID: 10850
  Gene Symbol: NAAA
  Gene Name: N-acylethanolamine acid amidase
  ENSP ID: ENSP00000426977
MCDFMNLSLADCLLVNLAYESSVFCTSIVAQDSRGHIYHGRNLDYPFGNVLRKLTVDVQFLKNGQIAFTGTTFIGYVGLWTGQSPHKFTVSGDERDKGWWWENAIAALFRRHIPVSWLIRATLSESENFEAAVGKLAKTPLIADVYYIVGGTSPREGVVITRNRDGPADIWPLDPLNGAWFRVETNYDHWKPAPKEDDRRTSAIKALNATGQANLSLEALFQVTCVTVSCIPRMFGVLLIVNMKNSVKSSGR

SEQ ID NO: 54945 - protein, 323 aa, Homo sapiens
  Payload ID: 10850
  Gene Symbol: NAAA
  Gene Name: N-acylethanolamine acid amidase
  Uniprot ID: Q02083
  ENSP ID: ENSP00000427641
MRTADREARPGLPSLLLLLLAGAGLSAASPPAAPRFNVSLDSVPELRWLPVLRHYDLDLVRAAMAQVIGDRVPKWVHVLIGKVVLELERFLPQPFTGEIRGMCDFMNLSLADCLLVNLAYESSVFCTSIVAQDSRGHIYHGRNLDYPFGNVLRKLTVDVQFLKNGQIAFTGTTFIGYVGLWTGQSPHKFTVSGDERDKGWWWENAIAALFRRHIPVSWLIRATLSESENFEAAVGKLAKTPLIADVYYIVGGTSPREGVVITRNRDGPADIWPLDPLNGAWFRVETNYDHWKPAPKEDDRRTSAIKALNATGQANLSLEALFQ

SEQ ID NO: 54946 - protein, 222 aa, Homo sapiens
  Payload ID: 10850
  Gene Symbol: NAAA
  Gene Name: N-acylethanolamine acid amidase
  ENSP ID: ENSP00000473575
  MOD_RES (1)..(1): Any amino acid
XTSIVAQDSRGHIYHGRNLDYPFGNVLRKLTVDVQFLKNGQIAFTGTTFIGYVGLWTGQSPHKFTVSGDERDKGWWWENAIAALFRRHIPVSWLIRATLSESENFEAAVGKLAKTPLIADVYYIVGGTSPREGVVITRNRDGPADIWPLDPLNGAWFRVETNYDHWKPAPKEDDRRTSAIKALNATGQANLSLEALFQILSVVPVYNKLFPLAEFPEVGLLS

SEQ ID NO: 54947 - protein, 395 aa, Homo sapiens
  Payload ID: 10851
  Gene Symbol: ASAH1
  Gene Name: N-acylsphingosine amidohydrolase (acid ceramidase) 1
  Uniprot ID: Q13510
  ENSP ID: ENSP00000262097
MPGRSCVALVLLAAAVSCAVAQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 54948 - protein, 389 aa, Homo sapiens
  Payload ID: 10851
  Gene Symbol: ASAH1
  Gene Name: N-acylsphingosine amidohydrolase (acid ceramidase) 1
  Uniprot ID: Q13510
  ENSP ID: ENSP00000326970
MNCCIGLGEKARGSHRASYPSLSALFTEASILGFGSFAVKAQWTEDCRKSTYPPSGPTVFPAVIRYRGAVPWYTINLDLPPYKRWHELMLDKAPVPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 54949 - protein, 411 aa, Homo sapiens
  Payload ID: 10851
  Gene Symbol: ASAH1
  Gene Name: N-acylsphingosine amidohydrolase (acid ceramidase) 1
  Uniprot ID: Q13510
  ENSP ID: ENSP00000371152
MNCCIGLGEKARGSHRASYPSLSALFTEASILGFGSFAVKAQWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 54950 - protein, 370 aa, Homo sapiens
  Payload ID: 10851
  Gene Symbol: ASAH1
  Gene Name: N-acylsphingosine amidohydrolase (acid ceramidase) 1
  ENSP ID: ENSP00000427751
MPGRSCVALVLLAAAVSCAVAQHAPPWTEDCRKSTYPPSGPTYRGAVPWYTINLDLPPYKRWHELMLDKAPVLKVIVNSLKNMINTFVPSGKIMQVVDEKLPGLLGNFPGPFEEEMKGIAAVTDIPLGHLIHGRNMDFGVFLGWNINNDTWVITEQLKPLTVNLDFQRNNKTVFKASSFAGYVGMLTGFKPGLFSLTLNERFSINGGYLGILEWILGKKDVMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 54951 - protein, 726 aa, Homo sapiens
  Payload ID: 10852
  Gene Symbol: ASAH2
  Gene Name: N-acylsphingosine amidohydrolase (non-lysosomal ceramidase) 2
  ENSP ID: ENSP00000329886
MSAITVALLSLLFITSGTIENHKDLGGHFFSTTQSPPATQGSTAAQRSTATQHSTATQSSTATQTSPVPLTPESPLFQNFSGYHIGVGRADCTGQVADINLMGYGKSGQNAQGILTRLYSRAFIMAEPDGSNRTVFVSIDIGMVSQRLRLEVLNRLQSKYGSLYRRDNVILSGTHTHSGPAGYFQYTVFVIASEGFSNQTFQHMVTGILKSIDIAHTNMKPGKIFINKGNVDGVQINRSPYSYLQNPQSERARYSSNTDKEMIVLKMVDLNGDDLGLISWFAIHPVSMNNSNHLVNSDNVGYASYLLEQEKNKGYLPGQGPFVAAFASSNLGDVSPNILGPRCINTGESCDNANSTCPIGGPSMCIAKGPGQDMFDSTQIIGRAMYQRAKSKTCKPALGYSFAAGTIDGVGGLNFTQGKTEGDPFWDTIRDQILGKPSEEIKECHKPKPILLHTGELSKPHPWHPDIVDVQIITLGSLAITAIPGEFTTMSGRRLREAVQAEFASHGMQNMTVVISGLCNVYTHYITTYEEYQAQRYEAASTIYGPHTLSAYIQLFRNLAKAIATDTVANLSRGPEPPFFKQLIVPLIPSIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 54952 - protein, 780 aa, Homo sapiens
  Payload ID: 10852
  Gene Symbol: ASAH2
  Gene Name: N-acylsphingosine amidohydrolase (non-lysosomal ceramidase) 2
  Uniprot ID: Q9NR71
  ENSP ID: ENSP00000378897
MAKRTFSNLETFLIFLLVMMSAITVALLSLLFITSGTIENHKDLGGHFFSTTQSPPATQGSTAAQRSTATQHSTATQSSTATQTSPVPLTPESPLFQNFSGYHIGVGRADCTGQVADINLMGYGKSGQNAQGILTRLYSRAFIMAEPDGSNRTVFVSIDIGMVSQRLRLEVLNRLQSKYGSLYRRDNVILSGTHTHSGPAGYFQYTVFVIASEGFSNQTFQHMVTGILKSIDIAHTNMKPGKIFINKGNVDGVQINRSPYSYLQNPQSERARYSSNTDKEMIVLKMVDLNGDDLGLISWFAIHPVSMNNSNHLVNSDNVGYASYLLEQEKNKGYLPGQGPFVAAFASSNLGDVSPNILGPRCINTGESCDNANSTCPIGGPSMCIAKGPGQDMFDSTQIIGRAMYQRAKELYASASQEVTGPLASAHQWVDMTDVTVWLNSTHASKTCKPALGYSFAAGTIDGVGGLNFTQGKTEGDPFWDTIRDQILGKPSEEIKECHKPKPILLHTGELSKPHPWHPDIVDVQIITLGSLAITAIPGEFTTMSGRRLREAVQAEFASHGMQNMTVVISGLCNVYTHYITTYEEYQAQRYEAASTIYGPHTLSAYIQLFRNLAKAIATDTVANLSRGPEPPFFKQLIVPLIPSIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 54953 - protein, 745 aa, Homo sapiens
  Payload ID: 10852
  Gene Symbol: ASAH2
  Gene Name: N-acylsphingosine amidohydrolase (non-lysosomal ceramidase) 2
  Uniprot ID: Q9NR71
  ENSP ID: ENSP00000388206
MAKRTFSNLETFLIFLLVMMSAITVALLSLLFITSGTIENHKDLGGHFFSTTQSPPATQGSTAAQRSTATQHSTATQSSTATQTSPVPLTPESPLFQNFSGYHIGVGRADCTGQVADINLMGYGKSGQNAQGILTRLYSRAFIMAEPDGSNRTVFVSIDIGMVSQRLRLEVLNRLQSKYGSLYRRDNVILSGTHTHSGPAGYFQYTVFVIASEGFSNQTFQHMVTGILKSIDIAHTNMKPGKIFINKGNVDGVQINRSPYSYLQNPQSERARYSSNTDKEMIVLKMVDLNGDDLGLISWFAIHPVSMNNSNHLVNSDNVGYASYLLEQEKNKGYLPGQGPFVAAFASSNLGDVSPNILGPRCINTGESCDNANSTCPIGGPSMCIAKGPGQDMFDSTQIIGRAMYQRAKSKTCKPALGYSFAAGTIDGVGGLNFTQGKTEGDPFWDTIRDQILGKPSEEIKECHKPKPILLHTGELSKPHPWHPDIVDVQIITLGSLAITAIPGEFTTMSGRRLREAVQAEFASHGMQNMTVVISGLCNVYTHYITTYEEYQAQRYEAASTIYGPHTLSAYIQLFRNLAKAIATDTVANLSRGPEPPFFKQLIVPLIPSIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 54954 - protein, 622 aa, Homo sapiens
  Payload ID: 10852
  Gene Symbol: ASAH2
  Gene Name: N-acylsphingosine amidohydrolase (non-lysosomal ceramidase) 2
  ENSP ID: ENSP00000392766
MDSEKSSEWRSDVLNRLQSKYGSLYRRDNVILSGTHTHSGPAGYFQYTVFVIASEGFSNQTFQHMVTGILKSIDIAHTNMKPGKIFINKGNVDGVQINRSPYSYLQNPQSERARYSSNTDKEMIVLKMVDLNGDDLGLISWFAIHPVSMNNSNHLVNSDNVGYASYLLEQEKNKGYLPGQGPFVAAFASSNLGDVSPNILGPRCINTGESCDNANSTCPIGGPSMCIAKGPGQDMFDSTQIIGRAMYQRAKELYASASQEVTGPLASAHQWVDMTDVTVWLNSTHASKTCKPALGYSFAAGTIDGVGGLNFTQGKTEGDPFWDTIRDQILGKPSEEIKECHKPKPILLHTGELSKPHPWHPDIVDVQIITLGSLAITAIPGEFTTMSGRRLREAVQAEFASHGMQNMTVVISGLCNVYTHYITTYEEYQAQRYEAASTIYGPHTLSAYIQLFRNLAKAIATDTVANLSRGPEPPFFKQLIVPLIPSIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 54955 - protein, 51 aa, Homo sapiens
  Payload ID: 10852
  Gene Symbol: ASAH2
  Gene Name: N-acylsphingosine amidohydrolase (non-lysosomal ceramidase) 2
  ENSP ID: ENSP00000476403
AQRYEAASTIYGPHTLSAYIQLFRNLAKAIATELHLWKSSLWMQLFMKLQL

SEQ ID NO: 54956 - protein, 144 aa, Homo sapiens
  Payload ID: 10852
  Gene Symbol: ASAH2
  Gene Name: N-acylsphingosine amidohydrolase (non-lysosomal ceramidase) 2
  ENSP ID: ENSP00000476827
AQRYEAASTIYGPHTLSAYIQLFRNLAKAIATGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 54957 - protein, 165 aa, Homo sapiens
  Payload ID: 10853
  Gene Symbol: ASAH2B
  Gene Name: N-acylsphingosine amidohydrolase (non-lysosomal ceramidase) 2B
  Uniprot ID: P0C7U1
  ENSP ID: ENSP00000363118
MRQHRQFMDRTHYLLTFSSSETLLRLLLRIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 54958 - protein, 160 aa, Homo sapiens
  Payload ID: 10853
  Gene Symbol: ASAH2B
  Gene Name: N-acylsphingosine amidohydrolase (non-lysosomal ceramidase) 2B
  Uniprot ID: P0C7U1
  ENSP ID: ENSP00000363119
MVANLSRGPEPPFFKQLIVPLIPSIVDRAPKGRTFGDVLQPAKPEYRVGEVAEVIFVGANPKNSVQNQTHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 54959 - protein, 414 aa, Homo sapiens
  Payload ID: 10854
  Gene Symbol: NADK
  Gene Name: NAD kinase
  ENSP ID: ENSP00000339727
MGRPRVRQAWPGCCGHTGRLPAGRGYLASHMCDPAGAELIGDGMSDPTPPSNACTGHIQDPASQRLTWNKSPKSVLVIKKMRDASLLQPFKELCTHLMEENMIVYVEKKVLEDPAIASDESFGAVKKKFCTFREDYDDISNQIDFIICLGGDGTLLYASSLFQGSVPPVMAFHLGSLGFLTPFSFENFQSQVTQVIEGNAAVVLRSRLKVRVVKELRGKKTAVHNGLGENGSQAAGLDMDVGKQAMQYQVLNEVVIDRGPSSYLSNVDVYLDGHLITTVQGDGVIVSTPTGSTAYAAAAGASMIHPNVPAIMITPICPHSLSFRPIVVPAGVELKIMLSPEARNTAWVSFDGRKRQEIRHGDSISITTSCYPLPSICVRDPVSDWFESLAQCLHWNVRKKQAHFEEEEEEEEEG

SEQ ID NO: 54960 - protein, 446 aa, Homo sapiens
  Payload ID: 10854
  Gene Symbol: NADK
  Gene Name: NAD kinase
  Uniprot ID: O95544
  ENSP ID: ENSP00000341679
MEMEQEKMTMNKELSPDAAAYCCSACHGDETWSYNHPIRGRAKSRSLSASPALGSTKEFRRTRSLHGPCPVTTFGPKACVLQNPQTIMHIQDPASQRLTWNKSPKSVLVIKKMRDASLLQPFKELCTHLMEENMIVYVEKKVLEDPAIASDESFGAVKKKFCTFREDYDDISNQIDFIICLGGDGTLLYASSLFQGSVPPVMAFHLGSLGFLTPFSFENFQSQVTQVIEGNAAVVLRSRLKVRVVKELRGKKTAVHNGLGENGSQAAGLDMDVGKQAMQYQVLNEVVIDRGPSSYLSNVDVYLDGHLITTVQGDGVIVSTPTGSTAYAAAAGASMIHPNVPAIMITPICPHSLSFRPIVVPAGVELKIMLSPEARNTAWVSFDGRKRQEIRHGDSISITTSCYPLPSICVRDPVSDWFESLAQCLHWNVRKKQAHFEEEEEEEEEG

SEQ ID NO: 54961 - protein, 446 aa, Homo sapiens; identical to SEQ ID NO: 54960
  Payload ID: 10854
  Gene Symbol: NADK
  Gene Name: NAD kinase
  Uniprot ID: O95544
  ENSP ID: ENSP00000344340

SEQ ID NO: 54962 - protein, 591 aa, Homo sapiens
  Payload ID: 10854
  Gene Symbol: NADK
  Gene Name: NAD kinase
  Uniprot ID: O95544
  ENSP ID: ENSP00000367890
MEMEQEKMTMNKELSPDAAAYCCSACHGDETWSYNHPIRGRAKSRSLSASPALGSTKEFRRTRSLHGPCPVTTFGPKACVLQNPQTIIATPLSLASQLLPSPAVSHSGQGGVTGQVHVLPQPSDQGVLSGPRAARGQTAPQEEAVTQEEVEALVCGHTQRWVPGPVYDAAAGGSGWAQLSLRAGMGVGQATGHIQDPASQRLTWNKSPKSVLVIKKMRDASLLQPFKELCTHLMEARGAGGKGAWGAHGVGGASIHITAPRVGSAGGMSRLALCFQENMIVYVEKKVLEDPAIASDESFGAVKKKFCTFREDYDDISNQIDFIICLGGDGTLLYASSLFQGSVPPVMAFHLGSLGFLTPFSFENFQSQVTQVIEGNAAVVLRSRLKVRVVKELRGKKTAVHNGLGENGSQAAGLDMDVGKQAMQYQVLNEVVIDRGPSSYLSNVDVYLDGHLITTVQGDGVIVSTPTGSTAYAAAAGASMIHPNVPAIMITPICPHSLSFRPIVVPAGVELKIMLSPEARNTAWVSFDGRKRQEIRHGDSISITTSCYPLPSICVRDPVSDWFESLAQCLHWNVRKKQAHFEEEEEEEEEG

SEQ ID NO: 54963 - protein, 44 aa, Homo sapiens
  Payload ID: 10854
  Gene Symbol: NADK
  Gene Name: NAD kinase
  ENSP ID: ENSP00000462589
  MOD_RES (1)..(1): Any amino acid
XSPKSVLVIKKMRDASLLQPFKELCTHLMEKSRRGGCGAQESHS

SEQ ID NO: 54964 - protein, 74 aa, Homo sapiens
  Payload ID: 10854
  Gene Symbol: NADK
  Gene Name: NAD kinase
  ENSP ID: ENSP00000462999
ENMIVYVEKKVLEDPAIASDESFGAVKKKFCTFREDYDDISNQIDFIICLGGDGTLLYASSLFQGTQLLFSGVG

SEQ ID NO: 54965 - protein, 30 aa, Homo sapiens
  Payload ID: 10854
  Gene Symbol: NADK
  Gene Name: NAD kinase
  ENSP ID: ENSP00000464096
ASLLQPFKELCTHLMEKSRRGGCGAQESHS

SEQ ID NO: 54966 - protein, 38 aa, Homo sapiens
  Payload ID: 10854
  Gene Symbol: NADK
  Gene Name: NAD kinase
  ENSP ID: ENSP00000464137
VLNEVVIDRGPSSYLSNVDVYLDGHLITTVQGDDHAVT

SEQ ID NO: 54967 - protein, 279 aa, Homo sapiens
  Payload ID: 10855
  Gene Symbol: NADK2
  Gene Name: NAD kinase 2, mitochondrial
  Uniprot ID: Q4G0N4
  ENSP ID: ENSP00000282512
MLLAASKVLDRLKPVIGVNTDPERSEGHLCLPVRYTHSFPEALQKFYRGEFRWLWRQRIRLYLEGTGINPVPVDLHEQQLSLNQHNRALNIERAHDERSEASGPQLLPVRALNEVFIGESLSSRASYYEISVDDGPWEKQKSSGLNLCTGTGSKAWSFNINRVATQAVEDVLNIAKRQGNLSLPLNRELVEKVTNEYNESLLYSPEEPKILFSIREPIANRVFSSSRQRCFSSKVCVRSRCWDACMVVDGGTSFEFNDGAIASMMINKEDELRTVLLEQ

SEQ ID NO: 54968 - protein, 442 aa, Homo sapiens
  Payload ID: 10855
  Gene Symbol: NADK2
  Gene Name: NAD kinase 2, mitochondrial
  Uniprot ID: Q4G0N4
  ENSP ID: ENSP00000371362
MTCYRGFLLGSCCRVAGGRAAALRGPGAGGPAARPRLGGDGGGRRHLGQGQPRELAGCGSRADGGFRPSRVVVVAKTTRYEFEQQRYRYAELSEEDLKQLLALKGSSYSGLLERHHIHTKNVEHIIDSLRNEGIEVRLVKRREYDEETVRWADAVIAAGGDGTMLLAASKVLDRLKPVIGVNTDPERSEGHLCLPVRYTHSFPEALQKFYRGEFRWLWRQRIRLYLEGTGINPVPVDLHEQQLSLNQHNRALNIERAHDERSEASGPQLLPVRALNEVFIGESLSSRASYYEISVDDGPWEKQKSSGLNLCTGTGSKAWSFNINRVATQAVEDVLNIAKRQGNLSLPLNRELVEKVTNEYNESLLYSPEEPKILFSIREPIANRVFSSSRQRCFSSKVCVRSRCWDACMVVDGGTSFEFNDGAIASMMINKEDELRTVLLEQ

SEQ ID NO: 54969 - protein, 279 aa, Homo sapiens; identical to SEQ ID NO: 54967
  Payload ID: 10855
  Gene Symbol: NADK2
  Gene Name: NAD kinase 2, mitochondrial
  Uniprot ID: Q4G0N4
  ENSP ID: ENSP00000380499

SEQ ID NO: 54970 - protein, 410 aa, Homo sapiens
  Payload ID: 10855
  Gene Symbol: NADK2
  Gene Name: NAD kinase 2, mitochondrial
  Uniprot ID: Q4G0N4
  ENSP ID: ENSP00000421029
MTCYRGFLLGSCCRVAGGRAAALRGPGAGGPAARPRLGGDGGGRRHLGQGQPRELAGCGSRADGGFRPSRVVVVAKTTRYEFEQQRYRYAELSEEDLKQLLALKGSSYSGLLERHHIHTKNVEHIIDSLRNEGIEVRLVKRREYDEETVRWADAVIAAGGDGTMLLAASKVLDRLKPVIGVNTDPERSEGHLCLPVRYTHSFPEALQKFYRGEFRWLWRQRIRLYLEGTGINPVPVDLHEQQLSLNQHNRALNIERAHDERSEASGPQLLPVRALNEVFIGESLSSRSFNINRVATQAVEDVLNIAKRQGNLSLPLNRELVEKVTNEYNESLLYSPEEPKILFSIREPIANRVFSSSRQRCFSSKVCVRSRCWDACMVVDGGTSFEFNDGAIASMMINKEDELRTVLLEQ

SEQ ID NO: 54971 - protein, 301 aa, Homo sapiens
  Payload ID: 10855
  Gene Symbol: NADK2
  Gene Name: NAD kinase 2, mitochondrial
  ENSP ID: ENSP00000422250
MLLAASKVLDRLKPVIGVNTDPERSEGHLCLPVRYTHSFPEALQKFYRGEFRWLWRQRIRLYLEGTGINPVPVDLHEQQLSLNQHNRALNIERAHDERSEASGPQLLPVRALNEVFIGESLSSRMSYSWAVAVDNLRRSIPTLKGLASYYEISVDDGPWEKQKSSGLNLCTGTGSKAWSFNINRVATQAVEDVLNIAKRQGNLSLPLNRELVEKVTNEYNESLLYSPEEPKILFSIREPIANRVFSSSRQRCFSSKVCVRSRCWDACMVVDGGTSFEFNDGAIASMMINKEDELRTVLLEQ

SEQ ID NO: 54972 - protein, 137 aa, Homo sapiens
  Payload ID: 10855
  Gene Symbol: NADK2
  Gene Name: NAD kinase 2, mitochondrial
  ENSP ID: ENSP00000424166
  MOD_RES (1)..(1): Any amino acid
XSYYEISVDDGPWEKQKSSGLNLCTGTGSKAWSFNINRVATQAVEDVLNIVTNEYNESLLYSPEEPKILFSIREPIANRVFSSSRQRCFSSKVCVRSRCWDACMVVDGGTSFEFNDGAIASMMINKEDELRTVLLEQ

SEQ ID NO: 54973 - protein, 82 aa, Homo sapiens
  Payload ID: 10855
  Gene Symbol: NADK2
  Gene Name: NAD kinase 2, mitochondrial
  ENSP ID: ENSP00000426084
MLLAASKVLDRLKPVIGVNTDPERSEGHLCLPVRYTHSFPEALQKFYRGEFRWLWRQRIRLYLEGTGINPVPVDLHEQQLSL

SEQ ID NO: 54974 - protein, 247 aa, Homo sapiens
  Payload ID: 10855
  Gene Symbol: NADK2
  Gene Name: NAD kinase 2, mitochondrial
  ENSP ID: ENSP00000480506
MLLAASKVLDRLKPVIGVNTDPERSEGHLCLPVRYTHSFPEALQKFYRGEFRWLWRQRIRLYLEGTGINPVPVDLHEQQLSLNQHNRALNIERAHDERSEASGPQLLPVRALNEVFIGESLSSRSFNINRVATQAVEDVLNIAKRQGNLSLPLNRELVEKVTNEYNESLLYSPEEPKILFSIREPIANRVFSSSRQRCFSSKVCVRSRCWDACMVVDGGTSFEFNDGAIASMMINKEDELRTVLLEQ

SEQ ID NO: 54975 - protein, 706 aa, Homo sapiens
  Payload ID: 10856
  Gene Symbol: NADSYN1
  Gene Name: NAD synthetase 1
  Uniprot ID: Q6IA69
  ENSP ID: ENSP00000326424
MGRKVTVATCALNQWALDFEGNLQRILKSIEIAKNRGARYRLGPELEICGYGCWDHYYESDTLLHSFQVLAALVESPVTQDIICDVGMPVMHRNVRYNCRVIFLNRKILLIRPKMALANEGNYRELRWFTPWSRSRHTEEYFLPRMIQDLTKQETVPFGDAVLVTWDTCIGSEICEELWTPHSPHIDMGLDGVEIITNASGSHQVLRKANTRVDLVTMVTSKNGGIYLLANQKGCDGDRLYYDGCAMIAMNGSVFAQGSQFSLDDVEVLTATLDLEDVRSYRAEISSRNLAASRASPYPRVKVDFALSCHEDLLAPISEPIEWKYHSPEEEISLGPACWLWDFLRRSQQAGFLLPLSGGVDSAATACLIYSMCCQVCEAVRSGNEEVLADVRTIVNQISYTPQDPRDLCGRILTTCYMASKNSSQETCTRARELAQQIGSHHISLNIDPAVKAVMGIFSLVTGKSPLFAAHGGSSRENLALQNVQARIRMVLAYLFAQLSLWSRGVHGGLLVLGSANVDESLLGYLTKYDCSSADINPIGGISKTDLRAFVQFCIQRFQLPALQSILLAPATAELEPLADGQVSQTDEEDMGMTYAELSVYGKLRKVAKMGPYSMFCKLLGMWRHICTPRQVADKVKRFFSKYSMNRHKMTTLTPAYHAENYSPEDNRFDLRPFLYNTSWPWQFRCIENQVLQLERAEPQSLDGVD

SEQ ID NO: 54976 - protein, 83 aa, Homo sapiens
  Payload ID: 10856
  Gene Symbol: NADSYN1
  Gene Name: NAD synthetase 1
  ENSP ID: ENSP00000431515
  MOD_RES (1)..(1): Any amino acid
XGGQGAVTLGSSQRTTGCVNRSPCLHGHLRPGSPDGHAGSGGRPELQGGDFISKPGGQQGEPLPQSEGGLCPLVPRGLAGTHL

SEQ ID NO: 54977 - protein, 335 aa, Homo sapiens
  Payload ID: 10856
  Gene Symbol: NADSYN1
  Gene Name: NAD synthetase 1
  ENSP ID: ENSP00000431820
MCCQVCEAVRSGNEEVLADVRTIVNQISYTPQDPRDLCGRILTTCYMASKNSSQETCTRARELAQQIGSHHISLNIDPAVKAVMGIFSLVTGKSPLFAAHGGSSRENLALQNVQARIRMVLAYLFAQLSLWSRGVHGGLLVLGSANVDESLLGYLTKYDCSSADINPIGGISKTDLRAFVQFCIQRFQLPALQSILLAPATAELEPLADGQVSQTDEEDMGMTYAELSVYGKLRKVAKMGPYSMFCKLLGMWRHICTPRQVADKVKRFFSKYSMNRHKMTTLTPAYHAENYSPEDNRFDLRPFLYNTSWPWQFRCIENQVLQLERAEPQSLDGVD

SEQ ID NO: 54978 - protein, 259 aa, Homo sapiens
  Payload ID: 10856
  Gene Symbol: NADSYN1
  Gene Name: NAD synthetase 1
  ENSP ID: ENSP00000432129
  MOD_RES (1)..(1): Any amino acid
XNRGARYRLGPELEICGYGCWDHYYESDTLLHSFQVLAALVESPVTQDIICDVGMPVMHRNVRYNCRVIFLNRKILLIRPKMALANEGNYRELRWFTPWSRSRHTEEYFLPRMIQDLTKQETVPFGDAVLVTWDTCIGSEICEELWTPHSPHIDMGLDGVEIITNASGSHQVLRKANTRVDLVTMVTSKNGGIYLLANQKGCDGDRLYYDGCAMIAMNGSVFAQGSQFSLDDVQTRKNGLLLPQMETNPKCTNTTKSNF

SEQ ID NO: 54979 - protein, 294 aa, Homo sapiens
  Payload ID: 10856
  Gene Symbol: NADSYN1
  Gene Name: NAD synthetase 1
  ENSP ID: ENSP00000433472
MGRKVTVATCALNQWALDFEGNLQRILKSIEIAKNRGARYRLGPELEICGYGCWDHYYESDTLLHSFQVLAALVESPVTQDIICDVGMPVMHRNVRYNCRVIFLNRKILLIRPKMALANEGNYRELRWFTPWSRSRHTEEYFLPRMIQDLTKQETVPFGDAVLVTWDTCIGSEICEELWTPHSPHIDMGLDGVEIITNASGSHQVLRKANTRVDLVTMVTSKNGGIYLLANQKGCDGDRLYYDGCAMIAMNGSVFAQGSQFSLDDVVMSGPGHAWGRVLCAETELLALPCKPGA

SEQ ID NO: 54980 - protein, 111 aa, Homo sapiens
  Payload ID: 10856
  Gene Symbol: NADSYN1
  Gene Name: NAD synthetase 1
  ENSP ID: ENSP00000433612
  MOD_RES (1)..(1): Any amino acid
XELSVYGKLRKVAKMGPYSMFCKLLGMWRHICTPRQVADKVKRFFSKYSMNRHKMTTLTPAYHAENYSPEDNRFDLRPFLYNTSWPWQFRCIENQVLQLERAEPQSLDGVD

SEQ ID NO: 54981 - protein, 59 aa, Homo sapiens
  Payload ID: 10856
  Gene Symbol: NADSYN1
  Gene Name: NAD synthetase 1
  ENSP ID: ENSP00000435570
  MOD_RES (1)..(1): Any amino acid
XKMTTLTPAYHAENYSPEDNRFDLRPFLYNTSWPWQFRCIENQVLQLERAEPQSLDGVD

SEQ ID NO: 54982 - protein, 149 aa, Homo sapiens
  Payload ID: 10856
  Gene Symbol: NADSYN1
  Gene Name: NAD synthetase 1
  ENSP ID: ENSP00000437172
MCCQVCEAVRSGNEEVLADVRTIVNQISYTPQDPRDLCGRILTTCYMASKNSSQETCTRARELAQQIGSHHISLNIDPAVKAVMGIFSLVTGKSPLFAAHGGSSRENLALQNVQARIRMVLAYLFAQLSLWSRGVHGGLLVLGSANVDE

SEQ ID NO: 54983 - protein, 88 aa, Homo sapiens
  Payload ID: 10856
  Gene Symbol: NADSYN1
  Gene Name: NAD synthetase 1
  ENSP ID: ENSP00000437220
MGRKVTVATCALNQWALDFEGNLQRILKSIEIAKNRGARYRLGPELEICGYGCWDHYYESDTLLHSFQVLAALVESPVTQDIICDVGM

SEQ ID NO: 54984 - protein, 373 aa, Homo sapiens
  Payload ID: 10857
  Gene Symbol: NSDHL
  Gene Name: NAD(P) dependent steroid dehydrogenase-like
  Uniprot ID: Q15738
  ENSP ID: ENSP00000359297
MEPAVSEPMRDQVARTHLTEDTPKVNADIEKVNQNQAKRCTVIGGSGFLGQHMVEQLLARGYAVNVFDIQQGFDNPQVRFFLGDLCSRQDLYPALKGVNTVFHCASPPPSSNNKELFYRVNYIGTKNVIETCKEAGVQKLILTSSASVIFEGVDIKNGTEDLPYAMKPIDYYTETKILQERAVLGANDPEKNFLTTAIRPHGIFGPRDPQLVPILIEAARNGKMKFVIGNGKNLVDFTFVENVVHGHILAAEQLSRDSTLGGKAFHITNDEPIPFWTFLSRILTGLNYEAPKYHIPYWVAYYLALLLSLLVMVISPVIQLQPTFTPMRVALAGTFHYYSCERAKKAMGYQPLVTMDDAMERTVQSFRHLRRVK

SEQ ID NO: 54985 - protein, 373 aa, Homo sapiens; identical to SEQ ID NO: 54984
  Payload ID: 10857
  Gene Symbol: NSDHL
  Gene Name: NAD(P) dependent steroid dehydrogenase-like
  Uniprot ID: Q15738
  ENSP ID: ENSP00000391854

SEQ ID NO: 54986 - protein, 254 aa, Homo sapiens
  Payload ID: 10857
  Gene Symbol: NSDHL
  Gene Name: NAD(P) dependent steroid dehydrogenase-like
  ENSP ID: ENSP00000396266
MEPAVSEPMRDQVARTHLTEDTPKVNADIEKVNQNQAKRCTVIGGSGFLGQHMVEQLLARGYAVNVFDIQQGFDNPQVRFFLGDLCSRQDLYPALKGVNTVFHCASPPPSSNNKELFYRVNYIGTKNVIETCKEAGVQKLILTSSASVIFEGVDIKNGTEDLPYAMKPIDYYTETKILQERAVLGANDPEKNFLTTAIRPHGIFGPRDPQLVPILIEAARNGKMKFVIGNGKNLVDFTFVENVVHGHILAAEQL

SEQ ID NO: 54987 - protein, 274 aa, Homo sapiens
  Payload ID: 10858
  Gene Symbol: NQO1
  Gene Name: NAD(P)H dehydrogenase, quinone 1
  Uniprot ID: P15559
  ENSP ID: ENSP00000319788
MVGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQFPLQWFGVPAILKGWFERVFIGEFAYTYAAMYDKGPFRSKKAVLSITTGGSGSMYSLQGIHGDMNVILWPIQSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 54988 - protein, 236 aa, Homo sapiens
  Payload ID: 10858
  Gene Symbol: NQO1
  Gene Name: NAD(P)H dehydrogenase, quinone 1
  Uniprot ID: P15559
  ENSP ID: ENSP00000368334
MVGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQSKKAVLSITTGGSGSMYSLQGIHGDMNVILWPIQSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 54989 - protein, 240 aa, Homo sapiens
  Payload ID: 10858
  Gene Symbol: NQO1
  Gene Name: NAD(P)H dehydrogenase, quinone 1
  Uniprot ID: P15559
  ENSP ID: ENSP00000368335
MVGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQFPLQWFGVPAILKGWFERVFIGEFAYTYAAMYDKGPFRSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 54990 - protein, 202 aa, Homo sapiens
  Payload ID: 10858
  Gene Symbol: NQO1
  Gene Name: NAD(P)H dehydrogenase, quinone 1
  ENSP ID: ENSP00000398330
MVGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 54991 - protein, 253 aa, Homo sapiens
  Payload ID: 10858
  Gene Symbol: NQO1
  Gene Name: NAD(P)H dehydrogenase, quinone 1
  ENSP ID: ENSP00000455020
MKEAAAAALKKKGWEVVESDLYAMNFNPIISRKDITGKLKDPANFQYPAESVLAYKEGHLSPDIVAEQKKLEAADLVIFQFPLQWFGVPAILKGWFERVFIGEFAYTYAAMYDKGPFRSKKAVLSITTGGSGSMYSLQGIHGDMNVILWPIQSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 54992 - protein, 269 aa, Homo sapiens
  Payload ID: 10858
  Gene Symbol: NQO1
  Gene Name: NAD(P)H dehydrogenase, quinone 1
  ENSP ID: ENSP00000456282
MVGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQSKKAVLSITTGGSGSMYSLQGIHGDMNVILWPIQSGILHFCGFQVLEPQLTYSIGHTPADARIQILEGWKKRLENIWDETPLYFAPSSLFDLNFQAGFLMKKEFHSVTQVGVHAQPPCRDSLQHLGILGSPHQQEGSHQTQPLHLDFSASMAVRNSFSLYIAQLQVFC

SEQ ID NO: 54993 - protein, 231 aa, Homo sapiens
  Payload ID: 10859
  Gene Symbol: NQO2
  Gene Name: NAD(P)H dehydrogenase, quinone 2
  Uniprot ID: P16083
  ENSP ID: ENSP00000337773
MAGKKVLIVYAHQEPKSFNGSLKNVAVDELSRQGCTVTVSDLYAMNLEPRATDKDITGTLSNPEVFNYGVETHEAYKQRSLASDITDEQKKVREADLVIFQFPLYWFSVPAILKGWMDRVLCQGFAFDIPGFYDSGLLQGKLALLSVTTGGTAEMYTKTGVNGDSRYFLWPLQHGTLHFCGFKVLAPQISFAPEIASEEERKGMVAAWSQRLQTIWKEEPIPCTAHWHFGQ

SEQ ID NO: 54994 - protein, 231 aa, Homo sapiens; identical to SEQ ID NO: 54993
  Payload ID: 10859
  Gene Symbol: NQO2
  Gene Name: NAD(P)H dehydrogenase, quinone 2
  Uniprot ID: P16083
  ENSP ID: ENSP00000369795

SEQ ID NO: 54995 - protein, 193 aa, Homo sapiens
  Payload ID: 10859
  Gene Symbol: NQO2
  Gene Name: NAD(P)H dehydrogenase, quinone 2
  ENSP ID: ENSP00000369806
MAGKKVLIVYAHQEPKSFNGSLKNVAVDELSRQGCTVTVSDLYAMNLEPRATDKDITGTLSNPEVFNYGVETHEAYKQRSLASDITDEQKKVREADLVIFQGKLALLSVTTGGTAEMYTKTGVNGDSRYFLWPLQHGTLHFCGFKVLAPQISFAPEIASEEERKGMVAAWSQRLQTIWKEEPIPCTAHWHFGQ

SEQ ID NO: 54996 - protein, 193 aa, Homo sapiens; identical to SEQ ID NO: 54995
  Payload ID: 10859
  Gene Symbol: NQO2
  Gene Name: NAD(P)H dehydrogenase, quinone 2
  ENSP ID: ENSP00000369821

SEQ ID NO: 54997 - protein, 231 aa, Homo sapiens; identical to SEQ ID NO: 54993
  Payload ID: 10859
  Gene Symbol: NQO2
  Gene Name: NAD(P)H dehydrogenase, quinone 2
  Uniprot ID: P16083
  ENSP ID: ENSP00000369822

SEQ ID NO: 54998 - protein, 139 aa, Homo sapiens
  Payload ID: 10859
  Gene Symbol: NQO2
  Gene Name: NAD(P)H dehydrogenase, quinone 2
  ENSP ID: ENSP00000369839
MAGKKVLIVYAHQEPKSFNGSLKNVAVDELSRQGCTVTVSDLYAMNLEPRATDKDITGTLSNPEVFNYGVETHEAYKQRSLASDITDEQKKVREADLVIFQFPLYWFSVPAILKGWMDRVLCQGFAFDIPGFYDSGLLQ

SEQ ID NO: 54999 - protein, 139 aa, Homo sapiens; identical to SEQ ID NO: 54998
  Payload ID: 10859
  Gene Symbol: NQO2
  Gene Name: NAD(P)H dehydrogenase, quinone 2
  ENSP ID: ENSP00000380829

SEQ ID NO: 55000 - protein, 63 aa, Homo sapiens
  Payload ID: 10859
  Gene Symbol: NQO2
  Gene Name: NAD(P)H dehydrogenase, quinone 2
  ENSP ID: ENSP00000406951
MAGKKVLIVYAHQEPKSFNGSLKNVAVDELSRQGCTVTVSDLYAMNLEPRATDKDITGTLSNP

SEQ ID NO: 55001 - protein, 35 aa, Homo sapiens
  Payload ID: 10859
  Gene Symbol: NQO2
  Gene Name: NAD(P)H dehydrogenase, quinone 2
  ENSP ID: ENSP00000475864
MAEFRFLKSGALPILSLLCLQALKFSLGCSRGSSE

SEQ ID NO: 55002 - protein, 70 aa, Homo sapiens
  Payload ID: 10860
  Gene Symbol: NDUFA1
  Gene Name: NADH dehydrogenase (ubiquinone) 1 alpha subcomplex, 1, 7.5kDa
  Uniprot ID: O15239
  ENSP ID: ENSP00000360492
MWFEILPGLSVMGVCLLIPGLATAYIHRFTNGGKEKRVAHFGYHWSLMERDRRISGVDRYYVSKGLENID

SEQ ID NO: 55003 - protein, 355 aa, Homo sapiens
  Payload ID: 10861
  Gene Symbol: NDUFA10
  Gene Name: NADH dehydrogenase (ubiquinone) 1 alpha subcomplex, 10, 42kDa
  Uniprot ID: O95299
  ENSP ID: ENSP00000252711
MALRLLKLAATSASARVVAAGAQRVRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQCVDHYNEVKSVTICDYLPPHLVIYIDVPVPEVQRRIQKKGDPHEMKITSAYLQDIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFRELPGRKYSPGYNTEVGDKWIWLK

SEQ ID NO: 55004 - protein, 429 aa, Homo sapiens
  Payload ID: 10861
  Gene Symbol: NDUFA10
  Gene Name: NADH dehydrogenase (ubiquinone) 1 alpha subcomplex, 10, 42kDa
  Uniprot ID: O95299
  ENSP ID: ENSP00000302321
MALRLLKLAATSASARVVAAGAQRVRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQCESALQTHFWTGVAGASGKLESGSSEEVLLINERGGRSKPGVDHYNEVKSVTICDYLPPHLVIYIDVPVPEPHEMKITSAYLQDIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFRERLDWTVCFGEESTEVKHQGHLLSVQPGTVALTVGSWLRSCLLGLHWKLLFLFPESPMHTTAFMFLC

SEQ ID NO: 55005 - protein, 201 aa, Homo sapiens
  Payload ID: 10861
  Gene Symbol: NDUFA10
  Gene Name: NADH dehydrogenase (ubiquinone) 1 alpha subcomplex, 10, 42kDa
  ENSP ID: ENSP00000383975
MALRLLKLAATSASARVVAAGAQRVRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQCESALQTHFWVCGATLQGL

SEQ ID NO: 55006 - protein, 390 aa, Homo sapiens
  Payload ID: 10861
  Gene Symbol: NDUFA10
  Gene Name: NADH dehydrogenase (ubiquinone) 1 alpha subcomplex, 10, 42kDa
  ENSP ID: ENSP00000385697
MALRLLKLAATSASARVVAAGAQRVRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQCVDHYNEVKSVTICDYLPPHLVIYIDVPVPEVQRRIQKKGDPHEMKITSAYLQDIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFRELGIPYPQRAVQSTREGPEVLLTGLWRWEDLLIGLQLPGRKYSPGYNTEVGDKWIWLK

SEQ ID NO: 55007 - protein, 94 aa, Homo sapiens
  Payload ID: 10861
  Gene Symbol: NDUFA10
  Gene Name: NADH dehydrogenase (ubiquinone) 1 alpha subcomplex, 10, 42kDa
  ENSP ID: ENSP00000388413
MALRLLKLAATSASARVVAAGAQRVASSTFLKRGFIIQTVPQEMGSPSPPTIMATVVWRNFTMIREAMMATVTACSPGCTAVACCSTQMPWSTC

SEQ ID NO: 55008 - protein, 133 aa, Homo sapiens
  Payload ID: 10861
  Gene Symbol: NDUFA10
  Gene Name: NADH dehydrogenase (ubiquinone) 1 alpha subcomplex, 10, 42kDa
  ENSP ID: ENSP00000403080
  MOD_RES (1)..(1): Any amino acid
XSAYLQDIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFREVFQESEAKRLDVEEVCWKKTPLKDRGEEV

SEQ ID NO: 55009 - protein, 129 aa, Homo sapiens
  Payload ID: 10861
  Gene Symbol: NDUFA10
  Gene Name: NADH dehydrogenase (ubiquinone) 1 alpha subcomplex, 10, 42kDa
  ENSP ID: ENSP00000408055
DIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFREVPADQEHRWVSLLSSPLGSLFSEWSVCGEDS

SEQ ID NO: 55010 - protein, 138 aa, Homo sapiens
  Payload ID: 10861
  Gene Symbol: NDUFA10
  Gene Name: NADH dehydrogenase (ubiquinone) 1 alpha subcomplex, 10, 42kDa
  ENSP ID: ENSP00000408224
ENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFREFSLFNGRKPDAVKILCSLLEADRSLLEADRSLLEADRVQDSC

SEQ ID NO: 55011 - protein, 244 aa, Homo sapiens
  Payload ID: 10861
  Gene Symbol: NDUFA10
  Gene Name: NADH dehydrogenase (ubiquinone) 1 alpha subcomplex, 10, 42kDa
  ENSP ID: ENSP00000411527
MALRLLKLAATSASARVVAAGAQRVRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQLKNVRFYNILQGKLKIQKRVQDKFEVLNYTSIPIFLPEVTIGAHQTDRVLHQFRELPGRKYS

SEQ ID NO: 55012 - protein, 355 aa, Homo sapiens
  Payload ID: 10861
  Gene Symbol: NDUFA10
  Gene Name: NADH dehydrogenase (ubiquinone) 1 alpha subcomplex, 10, 42kDa
  ENSP ID: ENSP00000480897
MALRLLKLAATSASARVVARAPSAWRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQCVDHYNEVKSVTICDYLPPHLVIYIDVPVPEVQRRIQKKGDPHEMKITSAYLQDIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFRELPGRKYSPGYNTEVGDKWIWLK

SEQ ID NO: 55013 - protein, 141 aa, Homo sapiens
  Payload ID: 10862
  Gene Symbol: NDUFA11
  Gene Name: NADH dehydrogenase (ubiquinone) 1 alpha subcomplex, 11, 14.7kDa
  Uniprot ID: Q86Y39
  ENSP ID: ENSP00000311740
MAPKVFRQYWDIPDGTDCHRKAYSTTSIASVAGLTAAAYRVTLNPPGTFLEGVAKVGQYTFTAAAVGAVFGLTTCISAHVREKPDDPLNYFLGGCAGGLTLGARTHNYGIGAAACVYFGIAASLVKMGRLEGWEVFAKPKV

SEQ ID NO: 55014 - protein, 228 aa, Homo sapiens
  Payload ID: 10862
  Gene Symbol: NDUFA11
  Gene Name: NADH dehydrogenase (ubiquinone) 1 alpha subcomplex, 11, 14.7kDa
  Uniprot ID: Q86Y39
  ENSP ID: ENSP00000389160
MAPKVFRQYWDIPDGTDCHRKAYSTTSIASVAGLTAAAYRVTLNPPGTFLEGVAKVGQYTFTAAAVGAVFGLTTCISAHVREKPDDPLNYFLGGCAGGLTLGARKTGSHCVVQAGLKLLASSSPHTSASQSAGIIGMSHCVQRFWVPSSSACLEVLSGESTDVHACSSTRGACNSSGSRPLPELGARASGSLRKGGHTHPAPRGAGALTPVQALIESLLNTLGSNPRT

SEQ ID NO: 55015 - protein, 35 aa, Homo sapiens
  Payload ID: 10862
  Gene Symbol: NDUFA11
  Gene Name: NADH dehydrogenase (ubiquinone) 1 alpha subcomplex, 11, 14.7kDa
  ENSP ID: ENSP00000466103
MAPKVFRQYWDIPDGTDCHRKAYSTTSIASVAGRD

SEQ ID NO: 55016 - protein, 120 aa, Homo sapiens
  Payload ID: 10862
  Gene Symbol: NDUFA11
  Gene Name: NADH dehydrogenase (ubiquinone) 1 alpha subcomplex, 11, 14.7kDa
  ENSP ID: ENSP00000467706
MAPKVFRQYWDIPDGTDCHRKAYSTTSIASVAGLTAAAYRVTLNPPGTFLEGVAKVGQYTFTAAAVGAVFGLTTCISAHVREKPDDPLNYFLGGCAGGLTLGARSEWPPPHPHPPPSLAE

SEQ ID NO: 55017 - protein, 145 aa, Homo sapiens
  Payload ID: 10863
  Gene Symbol: NDUFA12
  Gene Name: NADH dehydrogenase (ubiquinone) 1 alpha subcomplex, 12
  Uniprot ID: Q9UI09
  ENSP ID: ENSP00000330737
MELVQVLKRGLQQITGHGGLRGYLRVFFRTNDAKVGTLVGEDKYGNKYYEDNKQFFGRHRWVVYTTEMNGKNTFWDVDGSMVPPEWHRWLHSMTDDPPTTKPLTARKFIWTNHKFNVTGTPEQYVPYSTTRKKIQEWIPPSTPYK

SEQ ID NO: 55018 - protein, 99 aa, Homo sapiens
  Payload ID: 10863
  Gene Symbol: NDUFA12
  Gene Name: NADH dehydrogenase (ubiquinone) 1 alpha subcomplex, 12
  ENSP ID: ENSP00000448545
MELVQVLKRGLQQITGHGGLRGYLRVFFRTNDAKVGTLVGEDKYGNKYYEDNKQFFGRHRWVVYTTEMNGKNTFWDVDGSMVPPEWSLMGFKLNLHEPE

SEQ ID NO: 55019 - protein, 55 aa, Homo sapiens
  Payload ID: 10863
  Gene Symbol: NDUFA12
  Gene Name: NADH dehydrogenase (ubiquinone) 1 alpha subcomplex, 12
  ENSP ID: ENSP00000448846
MELVQVLKRGLQQITGHGGLRGYLRVFFRTNDAKKEDSGVDPTFNTLQVKTMKNS

SEQ ID NO: 55020 - protein, 54 aa, Homo sapiens
  Payload ID: 10863
  Gene Symbol: NDUFA12
  Gene Name: NADH dehydrogenase (ubiquinone) 1 alpha subcomplex, 12
  ENSP ID: ENSP00000449144
  MOD_RES (1)..(1): Any amino acid
XKRGLQQITGHGGLRGYLRVFFRTNDAKVGTLVGEDKYGNKYYEDNKQFFGALL

SEQ ID NO: 55021 - protein, 47 aa, Homo sapiens
  Payload ID: 10863
  Gene Symbol: NDUFA12
  Gene Name: NADH dehydrogenase (ubiquinone) 1 alpha subcomplex, 12
  ENSP ID: ENSP00000450096
RVFFRTNDAKVGTLVGEDKYGNKYYEDNKQFFDEETEAQGSIFTKET

SEQ ID NO: 55022 - protein, 63 aa, Homo sapiens
  Payload ID: 10863
  Gene Symbol: NDUFA12
  Gene Name: NADH dehydrogenase (ubiquinone) 1 alpha subcomplex, 12
  Uniprot ID: Q9UI09
  ENSP ID: ENSP00000450130
MELVQVLKRGLQQITGHGGLRGYLRVFFRTNDAKVGTLVGEDKYGNKYYEDNKQFFGIVGFTV

SEQ ID NO: 55023 - protein, 144 aa, Homo sapiens
  Payload ID: 10864
  Gene Symbol: NDUFA13
  Gene Name: NADH dehydrogenase (ubiquinone) 1 alpha subcomplex, 13
  Uniprot ID: Q9P0J0
  ENSP ID: ENSP00000423673
MAASKVKQDMPPPGGYGPIDYKRNLPRRGLSGYSMLAIGIGTLIYGHWSIMKWNRERRRLQIEDFEARIALLPLLQAETDRRTLQMLRENLEEEAIIMKDVPDWKVGESVFHTTRWVPPLIGELYGLRTTEEALHASHGFMWYT

SEQ ID NO: 55024 - protein, 150 aa, Homo sapiens
  Payload ID: 10864
  Gene Symbol: NDUFA13
  Gene Name: NADH dehydrogenase (ubiquinone) 1 alpha subcomplex, 13
  ENSP ID: ENSP00000465129
MAASKVKQDMPPPGGYGPIDYKRNLPRRGLSGYSMLAIGIGTLIYGHWSIMKWNRERRRLQIEDFEARIALLPLLQAETDRRTLQMLRENLEEEAIIMKDVPDWKVGPGWEGRGASHGRDRAWGWGAPTAFYRNPRTKGVVGARSHKGRL

SEQ ID NO: 55025 - protein, 107 aa, Homo sapiens
  Payload ID: 10864
  Gene Symbol: NDUFA13
  Gene Name: NADH dehydrogenase (ubiquinone) 1 alpha subcomplex, 13
  ENSP ID: ENSP00000467274
MAASKVKQDMPPPGGYGPIDYKRNLPRRGLSENPWHGGRGVTVQAASLLRSRQCPLIAEWAAPGAVEEGVWGRAGPLSSASLHRLQHAGHRDWNPDLRALEHNEVEP

SEQ ID NO: 55026 - protein, 120 aa, Homo sapiens
  Payload ID: 10864
  Gene Symbol: NDUFA13
  Gene Name: NADH dehydrogenase (ubiquinone) 1 alpha subcomplex, 13
  ENSP ID: ENSP00000468317
MAASKVKQDMPPPGGYGPIDYKRNLPRRGLSGYSMLAIGIGTLIYGHWSIMKWNRERRRLQIEDFEARIALLPLLQAETDRRTLQMLRENLEEEAIIMKDVPDWKDYRREPPYLVQPCQL

SEQ ID NO: 55027 - protein, 75 aa, Homo sapiens
  Payload ID: 10864
  Gene Symbol: NDUFA13
  Gene Name: NADH dehydrogenase (ubiquinone) 1 alpha subcomplex, 13
  ENSP ID: ENSP00000476093
  MOD_RES (1)..(1): Any amino acid
XDMPPPGGYGPIDYKRNLPRRGLSGYSMLAIGIGTLIYGHWSIMKWNRERRRLQIEDFEARIALLPLLQAETDRR

SEQ ID NO: 55028 - protein, 99 aa, Homo sapiens
  Payload ID: 10865
  Gene Symbol: NDUFA2
  Gene Name: NADH dehydrogenase (ubiquinone) 1 alpha subcomplex, 2, 8kDa
  Uniprot ID: O43678
  ENSP ID: ENSP00000252102
MAAAAASRGVGAKLGLREIRIHLCQRSPGSQGVRDFIEKRYVELKKANPDLPILIRECSDVQPKLWARYAFGQETNVPLNNFSADQVTRALENVLSGKA

SEQ ID NO: 55029 - protein, 76 aa, Homo sapiens
  Payload ID: 10865
  Gene Symbol: NDUFA2
  Gene Name: NADH dehydrogenase (ubiquinone) 1 alpha subcomplex, 2, 8kDa
  Uniprot ID: O43678
  ENSP ID: ENSP00000427220
MAAAAASRGVGAKLGLREIRIHLCQRSPGSQGVRDFIEKRYVELKKANPDLPILIRECSDVQPKLWARYASRVQNS

SEQ ID NO: 55030 - protein, 72 aa, Homo sapiens
  Payload ID: 10866
  Gene Symbol: NDUFA3
  Gene Name: NADH dehydrogenase (ubiquinone) 1 alpha subcomplex, 3, 9kDa
  ENSP ID: ENSP00000375642
MAARVGAFLKNAWDKEPVLVVSFVVGGLAVILPPLSPYFKYSVMINKATPYNYPVEAGFHRVSQDCLDLLTL

SEQ ID NO: 55031 - protein, 61 aa, Homo sapiens
  Payload ID: 10866
  Gene Symbol: NDUFA3
  Gene Name: NADH dehydrogenase (ubiquinone) 1 alpha subcomplex, 3, 9kDa
  ENSP ID: ENSP00000375643
MAASKCRSRRLPQECLGQGASAGRVLRRRGPRCNSAPIEPLLQVLRHDQQGHALQLPSARP

SEQ ID NO: 55032 - protein, 81 aa, Homo sapiens
  Payload ID: 10866
  Gene Symbol: NDUFA3
  Gene Name: NADH dehydrogenase (ubiquinone) 1 alpha subcomplex, 3, 9kDa
  ENSP ID: ENSP00000375644
MAARVGAFLKNAWDKEPVLVVSFVVGGLAVILPPLSPYFKYSVMINKATPYNYPAAGEKGHRIELSSHSTQRQSCPGARRS

SEQ ID NO: 55033 - protein, 34 aa, Homo sapiens
  Payload ID: 10866
  Gene Symbol: NDUFA3
  Gene Name: NADH dehydrogenase (ubiquinone) 1 alpha subcomplex, 3, 9kDa
  ENSP ID: ENSP00000394383
  MOD_RES (1)..(1): Any amino acid
XKYSVMINKATPYNYPVEAGFHRVSQDCLDLLTL

SEQ ID NO: 55034 - protein, 84 aa, Homo sapiens
  Payload ID: 10866
  Gene Symbol: NDUFA3
  Gene Name: NADH dehydrogenase (ubiquinone) 1 alpha subcomplex, 3, 9kDa
  Uniprot ID: O95167
  ENSP ID: ENSP00000398290
MAARVGAFLKNAWDKEPVLVVSFVVGGLAVILPPLSPYFKYSVMINKATPYNYPVPVRDDGNMPDVPSHPQDPQGPSLEWLKKL

SEQ ID NO: 55035 - protein, 69 aa, Homo sapiens
  Payload ID: 10866
  Gene Symbol: NDUFA3
  Gene Name: NADH dehydrogenase (ubiquinone) 1 alpha subcomplex, 3, 9kDa
  ENSP ID: ENSP00000407335
  MOD_RES (1)..(1): Any amino acid
XVGAFLKNAWDKEPVLVVSFVVGGLAVILPPLSPYFKYSVMINKATPYNYPVEAGFHRVSQDCLDLLTL

SEQ ID NO: 55036 - protein, 65 aa, Homo sapiens
  Payload ID: 10866
  Gene Symbol: NDUFA3
  Gene Name: NADH dehydrogenase (ubiquinone) 1 alpha subcomplex, 3, 9kDa
  ENSP ID: ENSP00000410453
MAARVGAFLKNAWDKEPVLVVSFVVGGLEQSHDTTPRMLHDDPTLKRAHSMTNPTAASSRPHVSL

SEQ ID NO: 55037 - protein, 65 aa, Homo sapiens; identical to SEQ ID NO: 55036
  Payload ID: 10866
  Gene Symbol: NDUFA3
  Gene Name: NADH dehydrogenase (ubiquinone) 1 alpha subcomplex, 3, 9kDa
  ENSP ID: ENSP00000412325

SEQ ID NO: 55038 - protein, 84 aa, Homo sapiens; identical to SEQ ID NO: 55034
  Payload ID: 10866
  Gene Symbol: NDUFA3
  Gene Name: NADH dehydrogenase (ubiquinone) 1 alpha subcomplex, 3, 9kDa
  Uniprot ID: O95167
  ENSP ID: ENSP00000418438

SEQ ID NO: 55039 - protein, 41 aa, Homo sapiens
  Payload ID: 10866
  Gene Symbol: NDUFA3
  Gene Name: NADH dehydrogenase (ubiquinone) 1 alpha subcomplex, 3, 9kDa
  ENSP ID: ENSP00000474408
MINKATPYNYPVPVRDDGNMPDVPSHPQDPQGPSLEWLKKL

SEQ ID NO: 55040 - protein, 73 aa, Homo sapiens
  Payload ID: 10866
  Gene Symbol: NDUFA3
  Gene Name: NADH dehydrogenase (ubiquinone) 1 alpha subcomplex, 3, 9kDa
  ENSP ID: ENSP00000474705
MAARVGAFLKNAWDKEPVLVVSFVVGGLAVILPPLSPYFKYSVMINKATPYNYPGEWGPGRDPRNRPSLPVLA

SEQ ID NO: 55041 - protein, 72 aa, Homo sapiens; identical to SEQ ID NO: 55030
  Payload ID: 10866
  Gene Symbol: NDUFA3
  Gene Name: NADH dehydrogenase (ubiquinone) 1 alpha subcomplex, 3, 9kDa
  ENSP ID: ENSP00000477571

SEQ ID NO: 55042 - protein, 84 aa, Homo sapiens; identical to SEQ ID NO: 55034
  Payload ID: 10866
  Gene Symbol: NDUFA3
  Gene Name: NADH dehydrogenase (ubiquinone) 1 alpha subcomplex, 3, 9kDa
  Uniprot ID: O95167
  ENSP ID: ENSP00000477783

SEQ ID NO: 55043 - protein, 34 aa, Homo sapiens; identical to SEQ ID NO: 55033
  Payload ID: 10866
  Gene Symbol: NDUFA3
  Gene Name: NADH dehydrogenase (ubiquinone) 1 alpha subcomplex, 3, 9kDa
  ENSP ID: ENSP00000479136
  MOD_RES (1)..(1): Any amino acid

SEQ ID NO: 55044 - protein, 73 aa, Homo sapiens; identical to SEQ ID NO: 55040
  Payload ID: 10866
  Gene Symbol: NDUFA3
  Gene Name: NADH dehydrogenase (ubiquinone) 1 alpha subcomplex, 3, 9kDa
  ENSP ID: ENSP00000480972

SEQ ID NO: 55045 - protein, 81 aa, Homo sapiens; identical to SEQ ID NO: 55032
  Payload ID: 10866
  Gene Symbol: NDUFA3
  Gene Name: NADH dehydrogenase (ubiquinone) 1 alpha subcomplex, 3, 9kDa
  ENSP ID: ENSP00000481312

SEQ ID NO: 55046 - protein, 69 aa, Homo sapiens; identical to SEQ ID NO: 55035
  Payload ID: 10866
  Gene Symbol: NDUFA3
  Gene Name: NADH dehydrogenase (ubiquinone) 1 alpha subcomplex, 3, 9kDa
  ENSP ID: ENSP00000481667
  MOD_RES (1)..(1): Any amino acid

SEQ ID NO: 55047 - protein, 65 aa, Homo sapiens; identical to SEQ ID NO: 55036
  Payload ID: 10866
  Gene Symbol: NDUFA3
  Gene Name: NADH dehydrogenase (ubiquinone) 1 alpha subcomplex, 3, 9kDa
  ENSP ID: ENSP00000481990

SEQ ID NO: 55048 - protein, 65 aa, Homo sapiens; identical to SEQ ID NO: 55036
  Payload ID: 10866
  Gene Symbol: NDUFA3
  Gene Name: NADH dehydrogenase (ubiquinone) 1 alpha subcomplex, 3, 9kDa
  ENSP ID: ENSP00000482592

SEQ ID NO: 55049 - protein, 41 aa, Homo sapiens; identical to SEQ ID NO: 55039
  Payload ID: 10866
  Gene Symbol: NDUFA3
  Gene Name: NADH dehydrogenase (ubiquinone) 1 alpha subcomplex, 3, 9kDa
  ENSP ID: ENSP00000483123

SEQ ID NO: 55050 - protein, 84 aa, Homo sapiens; identical to SEQ ID NO: 55034
  Payload ID: 10866
  Gene Symbol: NDUFA3
  Gene Name: NADH dehydrogenase (ubiquinone) 1 alpha subcomplex, 3, 9kDa
  Uniprot ID: O95167
  ENSP ID: ENSP00000483683

SEQ ID NO: 55051 - protein, 61 aa, Homo sapiens; identical to SEQ ID NO: 55031
  Payload ID: 10866
  Gene Symbol: NDUFA3
  Gene Name: NADH dehydrogenase (ubiquinone) 1 alpha subcomplex, 3, 9kDa
  ENSP ID: ENSP00000484034

SEQ ID NO: 55052 - protein, 84 aa, Homo sapiens; identical to SEQ ID NO: 55034
  Payload ID: 10867
  Gene Symbol:
  Gene Name: NADH dehydrogenase (ubiquinone) 1 alpha subcomplex, 3, 9kDa [Source:EntrezGene
  Acc:4696]
  ENSP ID: ENSP00000477919

SEQ ID NO: 55053 - protein, 84 aa, Homo sapiens; identical to SEQ ID NO: 55034
  Payload ID: 10867
  Gene Symbol:
  Gene Name: NADH dehydrogenase (ubiquinone) 1 alpha subcomplex, 3, 9kDa [Source:EntrezGene
  Acc:4696]
  ENSP ID: ENSP00000478119

SEQ ID NO: 55054 - protein, 84 aa, Homo sapiens; identical to SEQ ID NO: 55034
  Payload ID: 10867
  Gene Symbol:
  Gene Name: NADH dehydrogenase (ubiquinone) 1 alpha subcomplex, 3, 9kDa [Source:EntrezGene
  Acc:4696]
  ENSP ID: ENSP00000480437

SEQ ID NO: 55055 - protein, 84 aa, Homo sapiens; identical to SEQ ID NO: 55034
  Payload ID: 10867
  Gene Symbol:
  Gene Name: NADH dehydrogenase (ubiquinone) 1 alpha subcomplex, 3, 9kDa [Source:EntrezGene
  Acc:4696]
  Uniprot ID: O95167
  ENSP ID: ENSP00000481545

SEQ ID NO: 55056 - protein, 84 aa, Homo sapiens; identical to SEQ ID NO: 55034
  Payload ID: 10867
  Gene Symbol:
  Gene Name: NADH dehydrogenase (ubiquinone) 1 alpha subcomplex, 3, 9kDa [Source:EntrezGene
  Acc:4696]
  ENSP ID: ENSP00000482015

SEQ ID NO: 55057 - protein, 84 aa, Homo sapiens; identical to SEQ ID NO: 55034
  Payload ID: 10867
  Gene Symbol:
  Gene Name: NADH dehydrogenase (ubiquinone) 1 alpha subcomplex, 3, 9kDa [Source:EntrezGene
  Acc:4696]
  ENSP ID: ENSP00000483002

SEQ ID NO: 55058 - protein, 84 aa, Homo sapiens; identical to SEQ ID NO: 55034
  Payload ID: 10867
  Gene Symbol:
  Gene Name: NADH dehydrogenase (ubiquinone) 1 alpha subcomplex, 3, 9kDa [Source:EntrezGene
  Acc:4696]
  ENSP ID: ENSP00000483934

SEQ ID NO: 55059 - protein, 84 aa, Homo sapiens; identical to SEQ ID NO: 55034
  Payload ID: 10867
  Gene Symbol:
  Gene Name: NADH dehydrogenase (ubiquinone) 1 alpha subcomplex, 3, 9kDa [Source:EntrezGene
  Acc:4696]
  ENSP ID: ENSP00000484436

SEQ ID NO: 55060 - protein, 87 aa, Homo sapiens
  Payload ID: 10868
  Gene Symbol: NDUFA4L2
  Gene Name: NADH dehydrogenase (ubiquinone) 1 alpha subcomplex, 4-like 2
  Uniprot ID: Q9NRX3
  ENSP ID: ENSP00000377411
MAGASLGARFYRQIKRHPGIIPMIGLICLGMGSAALYLLRLALRSPDVCWDRKNNPEPWNRLSPNDQYKFLAVSTDYKKLKKDRPDF

SEQ ID NO: 55061 - protein, 87 aa, Homo sapiens; identical to SEQ ID NO: 55060
  Payload ID: 10868
  Gene Symbol: NDUFA4L2
  Gene Name: NADH dehydrogenase (ubiquinone) 1 alpha subcomplex, 4-like 2
  Uniprot ID: Q9NRX3
  ENSP ID: ENSP00000450664

SEQ ID NO: 55062 - protein, 93 aa, Homo sapiens
  Payload ID: 10868
  Gene Symbol: NDUFA4L2
  Gene Name: NADH dehydrogenase (ubiquinone) 1 alpha subcomplex, 4-like 2
  ENSP ID: ENSP00000452193
MAGASLGARFYRQIKRHPGIIPMIGLICLGMGSAALYLLRLALRSPDVCWDRKNNPEPWNRLSPNDQYKVPLDGSRVAPHPLISWSWHPQLPY

SEQ ID NO: 55063 - protein, 116 aa, Homo sapiens
  Payload ID: 10869
  Gene Symbol: NDUFA5
  Gene Name: NADH dehydrogenase (ubiquinone) 1 alpha subcomplex, 5
  Uniprot ID: Q16718
  ENSP ID: ENSP00000347988
MAGVLKKTTGLVGLAVCNTPHERLRILYTKILDVLEEIPKNAAYRKYTEQITNEKLAMVKAEPDVKKLEDQLQGGQLEEVILQAEHELNLARKMREWKLWEPLVEEPPADQWKWPI

SEQ ID NO: 55064 - protein, 112 aa, Homo sapiens
  Payload ID: 10869
  Gene Symbol: NDUFA5
  Gene Name: NADH dehydrogenase (ubiquinone) 1 alpha subcomplex, 5
  ENSP ID: ENSP00000368072
  MOD_RES (1)..(1): Any amino acid
XEQTTGLVGLAVCNTPHERLRILYTKILDVLEEIPKNAAYRKYTEQITNEKLAMVKAEPDVKKLEDQLQGGQLEEVILQAEHELNLARKMREWKLWEPLVEEPPADQWKWPI

SEQ ID NO: 55065 - protein, 116 aa, Homo sapiens
  Payload ID: 10869
  Gene Symbol: NDUFA5
  Gene Name: NADH dehydrogenase (ubiquinone) 1 alpha subcomplex, 5
  Uniprot ID: Q16718
  ENSP ID: ENSP00000417142
MPYRVGQTTGLVGLAVCNTPHERLRILYTKILDVLEEIPKNAAYRKYTEQITNEKLAMVKAEPDVKKLEDQLQGGQLEEVILQAEHELNLARKMREWKLWEPLVEEPPADQWKWPI

SEQ ID NO: 55066 - protein, 70 aa, Homo sapiens
  Payload ID: 10869
  Gene Symbol: NDUFA5
  Gene Name: NADH dehydrogenase (ubiquinone) 1 alpha subcomplex, 5
  ENSP ID: ENSP00000417331
MAGVLKKTTGLVGLAVCNTPHERLRILYTKILDVLEEIPKNAAYRKYTEQITNEKLAMVKAPIIMQIISS

SEQ ID NO: 55067 - protein, 93 aa, Homo sapiens
  Payload ID: 10869
  Gene Symbol: NDUFA5
  Gene Name: NADH dehydrogenase (ubiquinone) 1 alpha subcomplex, 5
  ENSP ID: ENSP00000418633
MYGNRSKQHESCFVFEQTTGLVGLAVCNTPHERLRILYTKILDVLEEIPKNAAYRKYTEQITNEKLAMVKAEPDVKKLEDQLQGGQLEEVILQ

SEQ ID NO: 55068 - protein, 77 aa, Homo sapiens
  Payload ID: 10869
  Gene Symbol: NDUFA5
  Gene Name: NADH dehydrogenase (ubiquinone) 1 alpha subcomplex, 5
  ENSP ID: ENSP00000481232
MAGVLKKTTGLVGLAVCNTPHEEPDVKKLEDQLQGGQLEEVILQAEHELNLARKMREWKLWEPLVEEPPADQWKWPI

SEQ ID NO: 55069 - protein, 101 aa, Homo sapiens
  Payload ID: 10869
  Gene Symbol: NDUFA5
  Gene Name: NADH dehydrogenase (ubiquinone) 1 alpha subcomplex, 5
  ENSP ID: ENSP00000484180
MAGVLKKRLRILYTKILDVLEEIPKNAAYRKYTEQITNEKLAMVKAEPDVKKLEDQLQGGQLEEVILQAEHELNLARKMREWKLWEPLVEEPPADQWKWPI

SEQ ID NO: 55070 - protein, 154 aa, Homo sapiens
  Payload ID: 10870
  Gene Symbol: NDUFA6
  Gene Name: NADH dehydrogenase (ubiquinone) 1 alpha subcomplex, 6, 14kDa
  Uniprot ID: P56556
  ENSP ID: ENSP00000418842
MGKDIRPRSARAACKGVGLWSGCFGKMAGSGVRQATSTASTFVKPIFSRDMNEAKRRVRELYRAWYREVPNTVHQFQLDITVKMGRDKVREMFMKNAHVTDPRVVDLLVIKGKIELEETIKVWKQRTHVMRFFHETEAPRPKDFLSKFYVGHDP

SEQ ID NO: 55071 - protein, 128 aa, Homo sapiens
  Payload ID: 10870
  Gene Symbol: NDUFA6
  Gene Name: NADH dehydrogenase (ubiquinone) 1 alpha subcomplex, 6, 14kDa
  ENSP ID: ENSP00000473461
MAGSGVRQATSTASTFVKPIFSRDMNEAKRRVRELYRAWYREVPNTVHQFQLDITVKMGRDKVREMFMKNAHVTDPRVVDLLVIKGKIELEETIKVWKQRTHVMRFFHETEAPRPKDFLSKFYVGHDP

SEQ ID NO: 55072 - protein, 71 aa, Homo sapiens
  Payload ID: 10870
  Gene Symbol: NDUFA6
  Gene Name: NADH dehydrogenase (ubiquinone) 1 alpha subcomplex, 6, 14kDa
  ENSP ID: ENSP00000473478
MGRDKVREMFMKNAHVTDPRVVDLLVIKGKIELEETIKVWKQRTHVMRFFHETEAPRPKDFLSKFYVGHDP

SEQ ID NO: 55073 - protein, 154 aa, Homo sapiens; identical to SEQ ID NO: 55070
  Payload ID: 10870
  Gene Symbol: NDUFA6
  Gene Name: NADH dehydrogenase (ubiquinone) 1 alpha subcomplex, 6, 14kDa
  Uniprot ID: P56556
  ENSP ID: ENSP00000475402

SEQ ID NO: 55074 - protein, 154 aa, Homo sapiens; identical to SEQ ID NO: 55070
  Payload ID: 10870
  Gene Symbol: NDUFA6
  Gene Name: NADH dehydrogenase (ubiquinone) 1 alpha subcomplex, 6, 14kDa
  Uniprot ID: P56556
  ENSP ID: ENSP00000475816

SEQ ID NO: 55075 - protein, 154 aa, Homo sapiens; identical to SEQ ID NO: 55070
  Payload ID: 10870
  Gene Symbol: NDUFA6
  Gene Name: NADH dehydrogenase (ubiquinone) 1 alpha subcomplex, 6, 14kDa
  Uniprot ID: P56556
  ENSP ID: ENSP00000482543

SEQ ID NO: 55076 - protein, 154 aa, Homo sapiens; identical to SEQ ID NO: 55070
  Payload ID: 10870
  Gene Symbol: NDUFA6
  Gene Name: NADH dehydrogenase (ubiquinone) 1 alpha subcomplex, 6, 14kDa
  Uniprot ID: P56556
  ENSP ID: ENSP00000484723

SEQ ID NO: 55077 - protein, 71 aa, Homo sapiens; identical to SEQ ID NO: 55072
  Payload ID: 10870
  Gene Symbol: NDUFA6
  Gene Name: NADH dehydrogenase (ubiquinone) 1 alpha subcomplex, 6, 14kDa
  ENSP ID: ENSP00000485080

SEQ ID NO: 55078 - protein, 154 aa, Homo sapiens; identical to SEQ ID NO: 55070
  Payload ID: 10870
  Gene Symbol: NDUFA6
  Gene Name: NADH dehydrogenase (ubiquinone) 1 alpha subcomplex, 6, 14kDa
  Uniprot ID: P56556
  ENSP ID: ENSP00000485713

SEQ ID NO: 55079 - protein, 71 aa, Homo sapiens; identical to SEQ ID NO: 55072
  Payload ID: 10870
  Gene Symbol: NDUFA6
  Gene Name: NADH dehydrogenase (ubiquinone) 1 alpha subcomplex, 6, 14kDa
  ENSP ID: ENSP00000485795

SEQ ID NO: 55080 - protein, 71 aa, Homo sapiens; identical to SEQ ID NO: 55072
  Payload ID: 10870
  Gene Symbol: NDUFA6
  Gene Name: NADH dehydrogenase (ubiquinone) 1 alpha subcomplex, 6, 14kDa
  ENSP ID: ENSP00000485886

SEQ ID NO: 55081 - protein, 71 aa, Homo sapiens; identical to SEQ ID NO: 55072
  Payload ID: 10870
  Gene Symbol: NDUFA6
  Gene Name: NADH dehydrogenase (ubiquinone) 1 alpha subcomplex, 6, 14kDa
  ENSP ID: ENSP00000486423

SEQ ID NO: 55082 - protein, 128 aa, Homo sapiens; identical to SEQ ID NO: 55071
  Payload ID: 10870
  Gene Symbol: NDUFA6
  Gene Name: NADH dehydrogenase (ubiquinone) 1 alpha subcomplex, 6, 14kDa
  ENSP ID: ENSP00000486643

SEQ ID NO: 55083 - protein, 128 aa, Homo sapiens; identical to SEQ ID NO: 55071
  Payload ID: 10870
  Gene Symbol: NDUFA6
  Gene Name: NADH dehydrogenase (ubiquinone) 1 alpha subcomplex, 6, 14kDa
  ENSP ID: ENSP00000486781

SEQ ID NO: 55084 - protein, 154 aa, Homo sapiens; identical to SEQ ID NO: 55070
  Payload ID: 10870
  Gene Symbol: NDUFA6
  Gene Name: NADH dehydrogenase (ubiquinone) 1 alpha subcomplex, 6, 14kDa
  Uniprot ID: P56556
  ENSP ID: ENSP00000487431

SEQ ID NO: 55085 - protein, 128 aa, Homo sapiens; identical to SEQ ID NO: 55071
  Payload ID: 10870
  Gene Symbol: NDUFA6
  Gene Name: NADH dehydrogenase (ubiquinone) 1 alpha subcomplex, 6, 14kDa
  ENSP ID: ENSP00000487462

SEQ ID NO: 55086 - protein, 113 aa, Homo sapiens
  Payload ID: 10871
  Gene Symbol: NDUFA7
  Gene Name: NADH dehydrogenase (ubiquinone) 1 alpha subcomplex, 7, 14.5kDa
  Uniprot ID: O95182
  ENSP ID: ENSP00000301457
MASATRLIQRLRNWASGHDLQGKLQLRYQEISKRTQPPPKLPVGPSHKLSNNYYCTRDGRRESVPPSIIMSSQKALVSGKPAESSAVAATEKKAVTPAPPIKRWELSSDQPYL

SEQ ID NO: 55087 - protein, 113 aa, Homo sapiens; identical to SEQ ID NO: 55086
  Payload ID: 10871
  Gene Symbol: NDUFA7
  Gene Name: NADH dehydrogenase (ubiquinone) 1 alpha subcomplex, 7, 14.5kDa
  Uniprot ID: O95182
  ENSP ID: ENSP00000470962

SEQ ID NO: 55088 - protein, 63 aa, Homo sapiens
  Payload ID: 10871
  Gene Symbol: NDUFA7
  Gene Name: NADH dehydrogenase (ubiquinone) 1 alpha subcomplex, 7, 14.5kDa
  ENSP ID: ENSP00000471333
MASATRLIQRLRNWASGHDLQGKLQLRYQEISKRSAVAATEKKAVTPAPPIKRWELSSDQPYL

SEQ ID NO: 55089 - protein, 76 aa, Homo sapiens
  Payload ID: 10871
  Gene Symbol: NDUFA7
  Gene Name: NADH dehydrogenase (ubiquinone) 1 alpha subcomplex, 7, 14.5kDa
  ENSP ID: ENSP00000471943
MASATRLIQRLRNWASGHDLQGKLQLRYQEISKRRNGVSPCWPVWSRTPDFIIRLPRPPKVLGLQNSASSQAPCGS

SEQ ID NO: 55090 - protein, 172 aa, Homo sapiens
  Payload ID: 10872
  Gene Symbol: NDUFA8
  Gene Name: NADH dehydrogenase (ubiquinone) 1 alpha subcomplex, 8, 19kDa
  Uniprot ID: P51970
  ENSP ID: ENSP00000362873
MPGIVELPTLEELKVDEVKISSAVLKAAAHHYGAQCDKPNKEFMLCRWEEKDPRRCLEEGKLVNKCALDFFRQIKRHCAEPFTEYWTCIDYTGQQLFRHCRKQQAKFDECVLDKLGWVRPDLGELSKVTKVKTDRPLPENPYHSRPRPDPSPEIEGDLQPATHGSRFYFWTK

SEQ ID NO: 55091 - protein, 377 aa, Homo sapiens
  Payload ID: 10873
  Gene Symbol: NDUFA9
  Gene Name: NADH dehydrogenase (ubiquinone) 1 alpha subcomplex, 9, 39kDa
  Uniprot ID: Q16795
  ENSP ID: ENSP00000266544
MAAAAQSRVVRVLSMSRSAITAIATSVCHGPPCRQLHHALMPHGKGGRSSVSGIVATVFGATGFLGRYVVNHLGRMGSQVIIPYRCDKYDIMHLRPMGDLGQLLFLEWDARDKDSIRRVVQHSNVVINLIGRDWETKNFDFEDVFVKIPQAIAQLSKEAGVEKFIHVSHLNANIKSSSRYLRNKAVGEKVVRDAFPEAIIVKPSDIFGREDRFLNSFASMHRFGPIPLGSLGWKTVKQPVYVVDVSKGIVNAVKDPDANGKSFAFVGPSRYLLFHLVKYIFAVAHRLFLPFPLPLFAYRWVARVFEISPFEPWITRDKVERMHITDMKLPHLPGLEDLGIQATPLELKAIEVLRRHRTYRWLSAEIEDVKPAKTVNI

SEQ ID NO: 55092 - protein, 136 aa, Homo sapiens
  Payload ID: 10873
  Gene Symbol: NDUFA9
  Gene Name: NADH dehydrogenase (ubiquinone) 1 alpha subcomplex, 9, 39kDa
  ENSP ID: ENSP00000439818
MDQKAEVASQVEVVIFLKKKNQFRLLYSGLSSCSSHRLAYILGREMLITCAICISLSRWVARVFEISPFEPWITRDKVERMHITDMKLPHLPGLEDLGIQATPLELKAIEVLRRHRTYRWLSAEIEDVKPAKTVNI

SEQ ID NO: 55093 - protein, 149 aa, Homo sapiens
  Payload ID: 10873
  Gene Symbol: NDUFA9
  Gene Name: NADH dehydrogenase (ubiquinone) 1 alpha subcomplex, 9, 39kDa
  ENSP ID: ENSP00000440305
MVECLTSLLLLNFLKVRISFLKHFTPFIIICDVLQWFYSSAITAIATSVCHGPPCRQLHHALMPHGKGGRSSVSGIVATVFGATGFLGRYVVNHLGRMGSQVIIPYRCDKYDIMHLRPMGDLGQLLFLEWDARDKDSIRRVVQHSNVVI

SEQ ID NO: 55094 - protein, 105 aa, Homo sapiens
  Payload ID: 10874
  Gene Symbol: NDUFB1
  Gene Name: NADH dehydrogenase (ubiquinone) 1 beta subcomplex, 1, 7kDa
  Uniprot ID: O75438
  ENSP ID: ENSP00000330787
MICWRHPSAPCGRGEWQVPRSQLPLARVEFPVALGLGVAVGAEAAAIMVNLLQIVRDHWVHVLVPMGFVIGCYLDRKSDERLTAFRNKSMLFKRELQPSEEVTWK

SEQ ID NO: 55095 - protein, 58 aa, Homo sapiens
  Payload ID: 10874
  Gene Symbol: NDUFB1
  Gene Name: NADH dehydrogenase (ubiquinone) 1 beta subcomplex, 1, 7kDa
  Uniprot ID: O75438
  ENSP ID: ENSP00000450776
MVNLLQIVRDHWVHVLVPMGFVIGCYLDRKSDERLTAFRNKSMLFKRELQPSEEVTWK

SEQ ID NO: 55096 - protein, 58 aa, Homo sapiens; identical to SEQ ID NO: 55095
  Payload ID: 10874
  Gene Symbol: NDUFB1
  Gene Name: NADH dehydrogenase (ubiquinone) 1 beta subcomplex, 1, 7kDa
  Uniprot ID: O75438
  ENSP ID: ENSP00000451090

SEQ ID NO: 55097 - protein, 58 aa, Homo sapiens; identical to SEQ ID NO: 55095
  Payload ID: 10874
  Gene Symbol: NDUFB1
  Gene Name: NADH dehydrogenase (ubiquinone) 1 beta subcomplex, 1, 7kDa
  Uniprot ID: O75438
  ENSP ID: ENSP00000475170

SEQ ID NO: 55098 - protein, 105 aa, Homo sapiens; identical to SEQ ID NO: 55094
  Payload ID: 10874
  Gene Symbol: NDUFB1
  Gene Name: NADH dehydrogenase (ubiquinone) 1 beta subcomplex, 1, 7kDa
  Uniprot ID: O75438
  ENSP ID: ENSP00000483888

SEQ ID NO: 55099 - protein, 172 aa, Homo sapiens
  Payload ID: 10875
  Gene Symbol: NDUFB10
  Gene Name: NADH dehydrogenase (ubiquinone) 1 beta subcomplex, 10, 22kDa
  Uniprot ID: O96000
  ENSP ID: ENSP00000268668
MPDSWDKDVYPEPPRRTPVQPNPIVYMMKAFDLIVDRPVTLVREFIERQHAKNRYYYYHRQYRRVPDITECKEEDIMCMYEAEMQWKRDYKVDQEIINIMQDRLKACQQREGQNYQQNCIKEVEQFTQVAKAYQDRYQDLGAYSSARKCLAKQRQRMLQERKAAKEAAAATS

SEQ ID NO: 55100 - protein, 168 aa, Homo sapiens
  Payload ID: 10875
  Gene Symbol: NDUFB10
  Gene Name: NADH dehydrogenase (ubiquinone) 1 beta subcomplex, 10, 22kDa
  Uniprot ID: O96000
  ENSP ID: ENSP00000445086
MPDSWDKDVYPEPPRRTPVQPNPIVYMMKAFDLIVDRPVTLVREFIERQHAKNRYYYYHRQYRRVPDITECKEEDIMCMYEAEMQWKRDYKVDQEIINIMQDRLKACQQREGQNYQQNCIKEVEQFTQVAKAYQDRCACPTHPQPPTILLRPGGQNHCKSSLPSLVLT

SEQ ID NO: 55101 - protein, 161 aa, Homo sapiens
  Payload ID: 10875
  Gene Symbol: NDUFB10
  Gene Name: NADH dehydrogenase (ubiquinone) 1 beta subcomplex, 10, 22kDa
  ENSP ID: ENSP00000455348
MPDSWDKDVYPEPPRRTPVQPNPIVYMMKAFDLIVDRPVTLVREFIERQHAKNRYYYYHRQYRRVPDITECKEEDIMCIKVDQEIINIMQDRLKACQQREGQNYQQNCIKEVEQFTQVAKAYQDRYQDLGAYSSARKCLAKQRQRMLQERKAAKEAAAATS

SEQ ID NO: 55102 - protein, 142 aa, Homo sapiens
  Payload ID: 10875
  Gene Symbol: NDUFB10
  Gene Name: NADH dehydrogenase (ubiquinone) 1 beta subcomplex, 10, 22kDa
  ENSP ID: ENSP00000457908
MPDSWDKDVYPEPPRRTPVQPNPIVYMMKAFDLIVDRPVTLVREFIERQHAKNRYYYYHRQYRRVPDITECKEEDIMCMYEAEMQWKRDYKVDQEIINIMQDRLKACQQREGQNYQQNCIKEVEQFTQIRTWGPTVLPGSAW

SEQ ID NO: 55103 - protein, 163 aa, Homo sapiens
  Payload ID: 10876
  Gene Symbol: NDUFB11
  Gene Name: NADH dehydrogenase (ubiquinone) 1 beta subcomplex, 11, 17.3kDa
  Uniprot ID: Q9NX14
  ENSP ID: ENSP00000276062
MAAGLFGLSARRLLAAAATRGLPAARVRWESSFSRTVVAPSAVAGKRPPEPTTPWQEDPEPEDENLYEKNPDSHGYDKDPVLDVWNMRLVFFFGVSIILVLGSTFVAYLPDYRCTGCPRAWDGMKEWSRREAERLVKYREANGLPIMESNCFDPSKIQLPEDE

SEQ ID NO: 55104 - protein, 153 aa, Homo sapiens
  Payload ID: 10876
  Gene Symbol: NDUFB11
  Gene Name: NADH dehydrogenase (ubiquinone) 1 beta subcomplex, 11, 17.3kDa
  Uniprot ID: Q9NX14
  ENSP ID: ENSP00000367042
MAAGLFGLSARRLLAAAATRGLPAARVRWESSFSRTVVAPSAVAGKRPPEPTTPWQEDPEPEDENLYEKNPDSHGYDKDPVLDVWNMRLVFFFGVSIILVLGSTFVAYLPDYRMKEWSRREAERLVKYREANGLPIMESNCFDPSKIQLPEDE

SEQ ID NO: 55105 - protein, 105 aa, Homo sapiens
  Payload ID: 10877
  Gene Symbol: NDUFB2
  Gene Name: NADH dehydrogenase (ubiquinone) 1 beta subcomplex, 2, 8kDa
  Uniprot ID: O95178
  ENSP ID: ENSP00000247866
MSALTRLASFARVGGRLFRSGCARTAGDGGVRHAGGGVHIEPRYRQFPQLTRSQVFQSEFFSGLMWFWILWRFWHDSEEVLGHFPYPDPSQWTDEELGIPPDDED

SEQ ID NO: 55106 - protein, 34 aa, Homo sapiens
  Payload ID: 10877
  Gene Symbol: NDUFB2
  Gene Name: NADH dehydrogenase (ubiquinone) 1 beta subcomplex, 2, 8kDa
  ENSP ID: ENSP00000418347
MSALTRLASFARVGGRLFRSGCARTAGDGGVRQN

SEQ ID NO: 55107 - protein, 41 aa, Homo sapiens
  Payload ID: 10877
  Gene Symbol: NDUFB2
  Gene Name: NADH dehydrogenase (ubiquinone) 1 beta subcomplex, 2, 8kDa
  ENSP ID: ENSP00000418573
MWFWILWRFWHDSEEVLGHFPYPDPSQWTDEELGIPPDDED

SEQ ID NO: 55108 - protein, 41 aa, Homo sapiens; identical to SEQ ID NO: 55107
  Payload ID: 10877
  Gene Symbol: NDUFB2
  Gene Name: NADH dehydrogenase (ubiquinone) 1 beta subcomplex, 2, 8kDa
  ENSP ID: ENSP00000418953

SEQ ID NO: 55109 - protein, 78 aa, Homo sapiens
  Payload ID: 10877
  Gene Symbol: NDUFB2
  Gene Name: NADH dehydrogenase (ubiquinone) 1 beta subcomplex, 2, 8kDa
  ENSP ID: ENSP00000418981
MHFSYSAGGGVHIEPRYRQFPQLTRSQVFQSEFFSGLMWFWILWRFWHDSEEVLGHFPYPDPSQWTDEELGIPPDDED

SEQ ID NO: 55110 - protein, 105 aa, Homo sapiens; identical to SEQ ID NO: 55105
  Payload ID: 10877
  Gene Symbol: NDUFB2
  Gene Name: NADH dehydrogenase (ubiquinone) 1 beta subcomplex, 2, 8kDa
  Uniprot ID: O95178
  ENSP ID: ENSP00000419087

SEQ ID NO: 55111 - protein, 105 aa, Homo sapiens; identical to SEQ ID NO: 55105
  Payload ID: 10877
  Gene Symbol: NDUFB2
  Gene Name: NADH dehydrogenase (ubiquinone) 1 beta subcomplex, 2, 8kDa
  Uniprot ID: O95178
  ENSP ID: ENSP00000419357

SEQ ID NO: 55112 - protein, 41 aa, Homo sapiens; identical to SEQ ID NO: 55107
  Payload ID: 10877
  Gene Symbol: NDUFB2
  Gene Name: NADH dehydrogenase (ubiquinone) 1 beta subcomplex, 2, 8kDa
  ENSP ID: ENSP00000419392

SEQ ID NO: 55113 - protein, 104 aa, Homo sapiens
  Payload ID: 10877
  Gene Symbol: NDUFB2
  Gene Name: NADH dehydrogenase (ubiquinone) 1 beta subcomplex, 2, 8kDa
  ENSP ID: ENSP00000419479
SALTRLASFARVGGRLFRSGCARTAGDGGVRHAGGGVHIEPRYRQFPQLTRSQVFQSEFFSGLMWFWILWRFWHDSEEVLGHFPYPDPSQWTDEELGIPPDDED

SEQ ID NO: 55114 - protein, 93 aa, Homo sapiens
  Payload ID: 10877
  Gene Symbol: NDUFB2
  Gene Name: NADH dehydrogenase (ubiquinone) 1 beta subcomplex, 2, 8kDa
  ENSP ID: ENSP00000419983
MLKNHSGCREWRLSPRESAVGAGGGVHIEPRYRQFPQLTRSQVFQSEFFSGLMWFWILWRFWHDSEEVLGHFPYPDPSQWTDEELGIPPDDED

SEQ ID NO: 55115 - protein, 96 aa, Homo sapiens
  Payload ID: 10877
  Gene Symbol: NDUFB2
  Gene Name: NADH dehydrogenase (ubiquinone) 1 beta subcomplex, 2, 8kDa
  ENSP ID: ENSP00000420062
MSALTRLASFARVGGRLFRSGCARTAGDGGVRQASNMDHRYTGDSALLWPSYKSSPEAEMLLPSSGAQLPMGISNPSQYNISRMCWRQYMDFLFQW

SEQ ID NO: 55116 - protein, 41 aa, Homo sapiens; identical to SEQ ID NO: 55107
  Payload ID: 10877
  Gene Symbol: NDUFB2
  Gene Name: NADH dehydrogenase (ubiquinone) 1 beta subcomplex, 2, 8kDa
  ENSP ID: ENSP00000420377

SEQ ID NO: 55117 - protein, 98 aa, Homo sapiens
  Payload ID: 10878
  Gene Symbol: NDUFB3
  Gene Name: NADH dehydrogenase (ubiquinone) 1 beta subcomplex, 3, 12kDa
  Uniprot ID: O43676
  ENSP ID: ENSP00000237889
MAHEHGHEHGHHKMELPDYRQWKIEGTPLETIQKKLAAKGLRDPWGRNEAWRYMGGFAKSVSFSDVFFKGFKWGFAAFVVAVGAEYYLESLNKDKKHH

SEQ ID NO: 55118 - protein, 65 aa, Homo sapiens
  Payload ID: 10878
  Gene Symbol: NDUFB3
  Gene Name: NADH dehydrogenase (ubiquinone) 1 beta subcomplex, 3, 12kDa
  ENSP ID: ENSP00000401834
MAHEHGHEHGHHKMELPDYRQWKIEGTPLETIQKKLAAKGLRDPWGRNEAWRYMGGFAKSVSFSD

SEQ ID NO: 55119 - protein, 98 aa, Homo sapiens; identical to SEQ ID NO: 55117
  Payload ID: 10878
  Gene Symbol: NDUFB3
  Gene Name: NADH dehydrogenase (ubiquinone) 1 beta subcomplex, 3, 12kDa
  Uniprot ID: O43676
  ENSP ID: ENSP00000407336

SEQ ID NO: 55120 - protein, 98 aa, Homo sapiens; identical to SEQ ID NO: 55117
  Payload ID: 10878
  Gene Symbol: NDUFB3
  Gene Name: NADH dehydrogenase (ubiquinone) 1 beta subcomplex, 3, 12kDa
  Uniprot ID: O43676
  ENSP ID: ENSP00000410600

SEQ ID NO: 55121 - protein, 129 aa, Homo sapiens
  Payload ID: 10879
  Gene Symbol: NDUFB4
  Gene Name: NADH dehydrogenase (ubiquinone) 1 beta subcomplex, 4, 15kDa
  Uniprot ID: O95168
  ENSP ID: ENSP00000184266
MSFPKYKPSSLRTLPETLDPAEYNISPETRRAQAERLAIRAQLKREYLLQYNDPNRRGLIENPALLRWAYARTINVYPNFRPTPKNSLMGALCGFGPLIFIYYIIKTERDRKEKLIQEGKLDRTFHLSY

SEQ ID NO: 55122 - protein, 69 aa, Homo sapiens
  Payload ID: 10879
  Gene Symbol: NDUFB4
  Gene Name: NADH dehydrogenase (ubiquinone) 1 beta subcomplex, 4, 15kDa
  ENSP ID: ENSP00000417714
MSFPKYKPSSLRTLPETLDPAEYNISPETRRAQAERLAIRAQLKREYLLQYNDPNRRGLIVSVGPPRRE

SEQ ID NO: 55123 - protein, 69 aa, Homo sapiens; identical to SEQ ID NO: 55122
  Payload ID: 10879
  Gene Symbol: NDUFB4
  Gene Name: NADH dehydrogenase (ubiquinone) 1 beta subcomplex, 4, 15kDa
  ENSP ID: ENSP00000417755

SEQ ID NO: 55124 - protein, 80 aa, Homo sapiens
  Payload ID: 10879
  Gene Symbol: NDUFB4
  Gene Name: NADH dehydrogenase (ubiquinone) 1 beta subcomplex, 4, 15kDa
  ENSP ID: ENSP00000419128
MSFPKYKPSSLRTLPETLDPAEYNISPETRRAQAERLAIRAQLKREYLLQYNDPNRRGLIDRKEKLIQEGKLDRTFHLSY

SEQ ID NO: 55125 - protein, 120 aa, Homo sapiens
  Payload ID: 10879
  Gene Symbol: NDUFB4
  Gene Name: NADH dehydrogenase (ubiquinone) 1 beta subcomplex, 4, 15kDa
  Uniprot ID: O95168
  ENSP ID: ENSP00000419578
MSFPKYKPSSLRTLPETLDPAEYNISPETRRAQAERLAIRAQLKREYLLQYNDPNRRGLIENPALLRWAYARTINVYPNFRPTPKNSLMGALCGFGPLIFIYYIIKTERVSIQTRCLVFE

SEQ ID NO: 55126 - protein, 189 aa, Homo sapiens
  Payload ID: 10880
  Gene Symbol: NDUFB5
  Gene Name: NADH dehydrogenase (ubiquinone) 1 beta subcomplex, 5, 16kDa
  Uniprot ID: O43674
  ENSP ID: ENSP00000259037
MAAMSLLRRVSVTAVAALSGRPLGTRLGFGGFLTRGFPKAAAPVRHSGDHGKRLFVIRPSRFYDRRFLKLLRFYIALTGIPVAIFITLVNVFIGQAELAEIPEGYVPEHWEYYKHPISRWIARNFYDSPEKIYERTMAVLQIEAEKAELRVKELEVRKLMHVRGDGPWYYYETIDKELIDHSPKATPDN

SEQ ID NO: 55127 - protein, 42 aa, Homo sapiens
  Payload ID: 10880
  Gene Symbol: NDUFB5
  Gene Name: NADH dehydrogenase (ubiquinone) 1 beta subcomplex, 5, 16kDa
  ENSP ID: ENSP00000353026
MAAMSLLRRVSVTAVAALSGRPLGTRLGFGGFLTRGFPKAAG

SEQ ID NO: 55128 - protein, 206 aa, Homo sapiens
  Payload ID: 10880
  Gene Symbol: NDUFB5
  Gene Name: NADH dehydrogenase (ubiquinone) 1 beta subcomplex, 5, 16kDa
  ENSP ID: ENSP00000418354
  MOD_RES (1)..(1): Any amino acid
XSLLRRVSVTAVAALSGRPLGTRLGFGGFLTRGFPKAAAPVRHSGDHGKRLFVIRPSRFYDRRFLKLLALYEQSRGLENGRLSGPSATRFYIALTGIPVAIFITLVNVFIGQAELAEIPEGYVPEHWEYYKHPISRWIARNFYDSPEKIYERTMAVLQIEAEKAELRVKELEVRKLMHVRGDGPWYYYETIDKELIDHSPKATPDN

SEQ ID NO: 55129 - protein, 100 aa, Homo sapiens
  Payload ID: 10880
  Gene Symbol: NDUFB5
  Gene Name: NADH dehydrogenase (ubiquinone) 1 beta subcomplex, 5, 16kDa
  ENSP ID: ENSP00000419099
GFRLLRWQLCLAGPLALASDLGASSLVAFRRLLGNSIFPAPVRHSGDHGKRLFVIRPSRFYDRRFLKLLRFYIALTGIPVAIFITLVNVFIASHIKMDCP

SEQ ID NO: 55130 - protein, 177 aa, Homo sapiens
  Payload ID: 10880
  Gene Symbol: NDUFB5
  Gene Name: NADH dehydrogenase (ubiquinone) 1 beta subcomplex, 5, 16kDa
  ENSP ID: ENSP00000419248
MAAMSLLRRVSVTAVAALSGRPLGTRLGFGGFLTRGFPKAAAPGNHHSAVFMILTTLFLIFYIALTGIPVAIFITLVNVFIGQAELAEIPEGYVPEHWEYYKHPISRWIARNFYDSPEKIYERTMAVLQIEAEKAELRVKELEVRKLMHVRGDGPWYYYETIDKELIDHSPKATPDN

SEQ ID NO: 55131 - protein, 56 aa, Homo sapiens
  Payload ID: 10880
  Gene Symbol: NDUFB5
  Gene Name: NADH dehydrogenase (ubiquinone) 1 beta subcomplex, 5, 16kDa
  ENSP ID: ENSP00000419501
IPVAIFITLVNVFIGQAELAEIPEGYVPEHWEYYKGKGAGSAKIDACERRWTLVLL

SEQ ID NO: 55132 - protein, 137 aa, Homo sapiens
  Payload ID: 10880
  Gene Symbol: NDUFB5
  Gene Name: NADH dehydrogenase (ubiquinone) 1 beta subcomplex, 5, 16kDa
  Uniprot ID: O43674
  ENSP ID: ENSP00000419656
MAAMSLLRRVSVTAVAALSGRPLGTRLGFGGFLTRGFPKAAGQAELAEIPEGYVPEHWEYYKHPISRWIARNFYDSPEKIYERTMAVLQIEAEKAELRVKELEVRKLMHVRGDGPWYYYETIDKELIDHSPKATPDN

SEQ ID NO: 55133 - protein, 66 aa, Homo sapiens
  Payload ID: 10880
  Gene Symbol: NDUFB5
  Gene Name: NADH dehydrogenase (ubiquinone) 1 beta subcomplex, 5, 16kDa
  ENSP ID: ENSP00000420538
MAAMSLLRRVSVTAVAALSGRPLGTRLGFGGFLTRGFPKAAEILHCIDWDSSSNFHNSGECIHWSS

SEQ ID NO: 55134 - protein, 135 aa, Homo sapiens
  Payload ID: 10880
  Gene Symbol: NDUFB5
  Gene Name: NADH dehydrogenase (ubiquinone) 1 beta subcomplex, 5, 16kDa
  ENSP ID: ENSP00000481703
MAAMSLLRRVSVTAVAALSGRPLGTRLGFGGFLTRGFPKAAAPVRHSGDHGKRLFVIRPSRFYDRRFLKLLRFYIALTGIPVAIFITLVNVFIGQAELAEIPEGYVPEHWEYYKGKGAGSAKIDACERRWTLVLL

SEQ ID NO: 55135 - protein, 113 aa, Homo sapiens
  Payload ID: 10881
  Gene Symbol: NDUFB6
  Gene Name: NADH dehydrogenase (ubiquinone) 1 beta subcomplex, 6, 17kDa
  Uniprot ID: O95139
  ENSP ID: ENSP00000297983
MTGYTPDEKLRLQQLRELRRRWLKDQELSPREPVLPPQKMGPMEKFWNKFLENKSPWRKMVHGVYKKSIFVFTHVLVPVWIIHYYMKYHVSGDTILETGEVIPPMKEFPDQHH

SEQ ID NO: 55136 - protein, 128 aa, Homo sapiens
  Payload ID: 10881
  Gene Symbol: NDUFB6
  Gene Name: NADH dehydrogenase (ubiquinone) 1 beta subcomplex, 6, 17kDa
  Uniprot ID: O95139
  ENSP ID: ENSP00000369176
MTGYTPDEKLRLQQLRELRRRWLKDQELSPREPVLPPQKMGPMEKFWNKFLENKSPWRKMVHGVYKKSIFVFTHVLVPVWIIHYYMKYHVSEKPYGIVEKKSRIFPGDTILETGEVIPPMKEFPDQHH

SEQ ID NO: 55137 - protein, 97 aa, Homo sapiens
  Payload ID: 10881
  Gene Symbol: NDUFB6
  Gene Name: NADH dehydrogenase (ubiquinone) 1 beta subcomplex, 6, 17kDa
  ENSP ID: ENSP00000482941
MTGYTPDEKLRLQQLRELRRRWLKDQELSPREPVLPPQKMGPMEKFWNKFLENKSPWRKMEKPYGIVEKKSRIFPGDTILETGEVIPPMKEFPDQHH

SEQ ID NO: 55138 - protein, 137 aa, Homo sapiens
  Payload ID: 10882
  Gene Symbol: NDUFB7
  Gene Name: NADH dehydrogenase (ubiquinone) 1 beta subcomplex, 7, 18kDa
  Uniprot ID: P17568
  ENSP ID: ENSP00000215565
MGAHLVRRYLGDASVEPDPLQMPTFPPDYGFPERKEREMVATQQEMMDAQLRLQLRDYCAHHLIRLLKCKRDSFPNFLACKQERHDWDYCEHRDYVMRMKEFERERRLLQRKKRREKKAAELAKGQGPGEVDPKVAL

SEQ ID NO: 55139 - protein, 70 aa, Homo sapiens
  Payload ID: 10882
  Gene Symbol: NDUFB7
  Gene Name: NADH dehydrogenase (ubiquinone) 1 beta subcomplex, 7, 18kDa
  ENSP ID: ENSP00000473120
MGAHLVRRYLGDASVEPDPLQMPTFPPDYGFPERKERDGGHTAGDDGRAAEAPAAGLLRPPPHPAAQVQA

SEQ ID NO: 55140 - protein, 186 aa, Homo sapiens
  Payload ID: 10883
  Gene Symbol: NDUFB8
  Gene Name: NADH dehydrogenase (ubiquinone) 1 beta subcomplex, 8, 19kDa
  Uniprot ID: O95169
  ENSP ID: ENSP00000299166
MAVARAGVLGVQWLQRASRNVMPLGARTASHMTKDMFPGPYPRTPEERAAAAKKYNMRVEDYEPYPDDGMGYGDYPKLPDRSQHERDPWYSWDQPGLRLNWGEPMHWHLDMYNRNRVDTSPTPVSWHVMCMQLFGFLAFMIFMCWVGDVYPVYQPVGPKQYPYNNLYLERGGDPSKEPERVVHYEI

SEQ ID NO: 55141 - protein, 172 aa, Homo sapiens
  Payload ID: 10883
  Gene Symbol: NDUFB8
  Gene Name: NADH dehydrogenase (ubiquinone) 1 beta subcomplex, 8, 19kDa
  Uniprot ID: O95169
  ENSP ID: ENSP00000359344
MAVARAGVLGVQWLQRASRNVMPLGARTASHMTKDMFPGPYPRTPEERAAAAKKYNMRVEDYEPYPDDGMGYGDYPKLPDRSQHERDPWYSWDQPGLRLNWGEPMHWHLDMYNRNRVDTSPTPVSWHVMCMQLFGFLAFMIFMCWVGDVYPVYQPVCRHHFSYNLGFLSALG

SEQ ID NO: 55142 - protein, 155 aa, Homo sapiens
  Payload ID: 10883
  Gene Symbol: NDUFB8
  Gene Name: NADH dehydrogenase (ubiquinone) 1 beta subcomplex, 8, 19kDa
  Uniprot ID: O95169
  ENSP ID: ENSP00000359346
MTKDMFPGPYPRTPEERAAAAKKYNMRVEDYEPYPDDGMGYGDYPKLPDRSQHERDPWYSWDQPGLRLNWGEPMHWHLDMYNRNRVDTSPTPVSWHVMCMQLFGFLAFMIFMCWVGDVYPVYQPVGPKQYPYNNLYLERGGDPSKEPERVVHYEI

SEQ ID NO: 55143 - protein, 71 aa, Homo sapiens
  Payload ID: 10883
  Gene Symbol: NDUFB8
  Gene Name: NADH dehydrogenase (ubiquinone) 1 beta subcomplex, 8, 19kDa
  ENSP ID: ENSP00000434072
MAVARAGVLGVQWLQRASRNVMPLGARTASHMTKDMFPGPYPRTPEERAAAAKKYNMRVEDYEPYPDDGMG

SEQ ID NO: 55144 - protein, 179 aa, Homo sapiens
  Payload ID: 10884
  Gene Symbol: NDUFB9
  Gene Name: NADH dehydrogenase (ubiquinone) 1 beta subcomplex, 9, 22kDa
  Uniprot ID: Q9Y6M9
  ENSP ID: ENSP00000276689
MAFLASGPYLTHQQKVLRLYKRALRHLESWCVQRDKYRYFACLMRARFEEHKNEKDMAKATQLLKEAEEEFWYRQHPQPYIFPDSPGGTSYERYDCYKVPEWCLDDWHPSEKAMYPDYFAKREQWKKLRRESWEREVKQLQEETPPGGPLTEALPPARKEGDLPPLWWYIVTRPRERPM

SEQ ID NO: 55145 - protein, 178 aa, Homo sapiens
  Payload ID: 10884
  Gene Symbol: NDUFB9
  Gene Name: NADH dehydrogenase (ubiquinone) 1 beta subcomplex, 9, 22kDa
  ENSP ID: ENSP00000428282
MAFLASGPYLTHQQKVLRLYKRALRHLESWCVQRDKYRYFACLMRARFEEHKNEKDMAKATQLLKEAEEEFWYRQHPQPYIFPDSPGGTSYERYDCYKVPEWCLDDWHPSEKAMYPDYFAKREQWKKLRRESWEREVRSTCTSLFLSYVDGVKFCSPQAEVQIPAMTVTLGPCFSDIL

SEQ ID NO: 55146 - protein, 168 aa, Homo sapiens
  Payload ID: 10884
  Gene Symbol: NDUFB9
  Gene Name: NADH dehydrogenase (ubiquinone) 1 beta subcomplex, 9, 22kDa
  ENSP ID: ENSP00000430322
MAFLASGPYLTHQQKVLRLYKRALRHLESWCVQRARFEEHKNEKDMAKATQLLKEAEEEFWYRQHPQPYIFPDSPGGTSYERYDCYKVPEWCLDDWHPSEKAMYPDYFAKREQWKKLRRESWEREVKQLQEETPPGGPLTEALPPARKEGDLPPLWWYIVTRPRERPM

SEQ ID NO: 55147 - protein, 221 aa, Homo sapiens
  Payload ID: 10884
  Gene Symbol: NDUFB9
  Gene Name: NADH dehydrogenase (ubiquinone) 1 beta subcomplex, 9, 22kDa
  ENSP ID: ENSP00000431115
MAFLASGPYLTHQQKVLRLYKRALRHLESWCVQRDKYRYFACLMRARFEEHKNEKDMAKATQLLKEAEEEFWYRQHPQPYIFPDSPGGTSYERYDCYKVPEWCLDDWHPSEKAMYPDYFAKREQWKKLRRESWEREQLSKRQVRQELGTMEETSHVLYRSAKLGPRAGLERSMEKFCAQGNNSNSDILLGLREMSWYLRISFQNACSASSQLRHANDFLKN

SEQ ID NO: 55148 - protein, 156 aa, Homo sapiens
  Payload ID: 10885
  Gene Symbol: NDUFAB1
  Gene Name: NADH dehydrogenase (ubiquinone) 1, alpha/beta subcomplex, 1, 8kDa
  Uniprot ID: O14561
  ENSP ID: ENSP00000007516
MASRVLSAYVSRLPAAFAPLPRVRMLAVARPLSTALCSAGTQTRLGTLQPALVLAQVPGRVTQLCRQYSDMPPLTLEGIQDRVLYVLKLYDKIDPEKLSVNSHFMKDLGLDSLDQVEIIMAMEDEFGFEIPDIDAEKLMCPQEIVDYIADKKDVYE

SEQ ID NO: 55149 - protein, 74 aa, Homo sapiens
  Payload ID: 10885
  Gene Symbol: NDUFAB1
  Gene Name: NADH dehydrogenase (ubiquinone) 1, alpha/beta subcomplex, 1, 8kDa
  ENSP ID: ENSP00000454812
MASRVLSAYVSRLPAAFAPLPRVRMLAVARPLSTALCSAGTQTRLGTLQPALVLAQHLLPVSRTPGSNSRKQAK

SEQ ID NO: 55150 - protein, 111 aa, Homo sapiens
  Payload ID: 10885
  Gene Symbol: NDUFAB1
  Gene Name: NADH dehydrogenase (ubiquinone) 1, alpha/beta subcomplex, 1, 8kDa
  ENSP ID: ENSP00000454891
  MOD_RES (1)..(1): Any amino acid
XLSAYVSRLPAAFAPLPRVRMLAVARPLSTALCSAGTQTRLGTLQPALVLAQLSVNSHFMKDLGLDSLDQVEIIMAMEDEFGFEIPDIDAEKLMCPQEIVDYIADKKDVYE

SEQ ID NO: 55151 - protein, 156 aa, Homo sapiens; identical to SEQ ID NO: 55148
  Payload ID: 10885
  Gene Symbol: NDUFAB1
  Gene Name: NADH dehydrogenase (ubiquinone) 1, alpha/beta subcomplex, 1, 8kDa
  Uniprot ID: O14561
  ENSP ID: ENSP00000458770

SEQ ID NO: 55152 - protein, 70 aa, Homo sapiens
  Payload ID: 10885
  Gene Symbol: NDUFAB1
  Gene Name: NADH dehydrogenase (ubiquinone) 1, alpha/beta subcomplex, 1, 8kDa
  ENSP ID: ENSP00000461693
MPPLTLEGIQDRVLYVLKLYDKIDPEKLSVNSHFMKDLGLDSLDQVEIIMAMEDEFGFEIPDIDAEKLMC

SEQ ID NO: 55153 - protein, 76 aa, Homo sapiens
  Payload ID: 10886
  Gene Symbol: NDUFC1
  Gene Name: NADH dehydrogenase (ubiquinone) 1, subcomplex unknown, 1, 6kDa
  Uniprot ID: O43677
  ENSP ID: ENSP00000377770
MAPSALLRPLSRLLAPARLPSGPSVRSKFYVREPPNAKPDWLKVGFTLGTTVFLWIYLIKQHNEDILEYKRRNGLE

SEQ ID NO: 55154 - protein, 76 aa, Homo sapiens; identical to SEQ ID NO: 55153
  Payload ID: 10886
  Gene Symbol: NDUFC1
  Gene Name: NADH dehydrogenase (ubiquinone) 1, subcomplex unknown, 1, 6kDa
  Uniprot ID: O43677
  ENSP ID: ENSP00000377775

SEQ ID NO: 55155 - protein, 76 aa, Homo sapiens; identical to SEQ ID NO: 55153
  Payload ID: 10886
  Gene Symbol: NDUFC1
  Gene Name: NADH dehydrogenase (ubiquinone) 1, subcomplex unknown, 1, 6kDa
  Uniprot ID: O43677
  ENSP ID: ENSP00000421195

SEQ ID NO: 55156 - protein, 76 aa, Homo sapiens; identical to SEQ ID NO: 55153
  Payload ID: 10886
  Gene Symbol: NDUFC1
  Gene Name: NADH dehydrogenase (ubiquinone) 1, subcomplex unknown, 1, 6kDa
  Uniprot ID: O43677
  ENSP ID: ENSP00000425882

SEQ ID NO: 55157 - protein, 76 aa, Homo sapiens; identical to SEQ ID NO: 55153
  Payload ID: 10886
  Gene Symbol: NDUFC1
  Gene Name: NADH dehydrogenase (ubiquinone) 1, subcomplex unknown, 1, 6kDa
  Uniprot ID: O43677
  ENSP ID: ENSP00000439882

SEQ ID NO: 55158 - protein, 76 aa, Homo sapiens; identical to SEQ ID NO: 55153
  Payload ID: 10886
  Gene Symbol: NDUFC1
  Gene Name: NADH dehydrogenase (ubiquinone) 1, subcomplex unknown, 1, 6kDa
  Uniprot ID: O43677
  ENSP ID: ENSP00000440133

SEQ ID NO: 55159 - protein, 76 aa, Homo sapiens; identical to SEQ ID NO: 55153
  Payload ID: 10886
  Gene Symbol: NDUFC1
  Gene Name: NADH dehydrogenase (ubiquinone) 1, subcomplex unknown, 1, 6kDa
  Uniprot ID: O43677
  ENSP ID: ENSP00000441126

SEQ ID NO: 55160 - protein, 119 aa, Homo sapiens
  Payload ID: 10887
  Gene Symbol: NDUFC2
  Gene Name: NADH dehydrogenase (ubiquinone) 1, subcomplex unknown, 2, 14.5kDa
  Uniprot ID: O95298
  ENSP ID: ENSP00000281031
MIARRNPEPLRFLPDEARSLPPPKLTDPRLLYIGFLGYCSGLIDNLIRRRPIATAGLHRQLLYITAFFFAGYYLVKREDYLYAVRDREMFGYMKLHPEDFPEEDKKTYGEIFEKFHPIR

SEQ ID NO: 55161 - protein, 71 aa, Homo sapiens
  Payload ID: 10887
  Gene Symbol: NDUFC2
  Gene Name: NADH dehydrogenase (ubiquinone) 1, subcomplex unknown, 2, 14.5kDa
  ENSP ID: ENSP00000432253
MIARRNPEPLRFLPDEARSLPPPKLTDPRLLYIGFLGYCSGLIDNLIRRRPIATADKKTYGEIFEKFHPIR

SEQ ID NO: 55162 - protein, 88 aa, Homo sapiens
  Payload ID: 10887
  Gene Symbol: NDUFC2
  Gene Name: NADH dehydrogenase (ubiquinone) 1, subcomplex unknown, 2, 14.5kDa
  Uniprot ID: O95298
  ENSP ID: ENSP00000432739
MIARRNPEPLRFLPDEARSLPPPKLTDPRLLYIGFLGYCSGLIDNLIRRRPIATAGLHRQLLYITAFFFAGYYLVKLEAYANLYVDTL

SEQ ID NO: 55163 - protein, 96 aa, Homo sapiens
  Payload ID: 10887
  Gene Symbol: NDUFC2
  Gene Name: NADH dehydrogenase (ubiquinone) 1, subcomplex unknown, 2, 14.5kDa
  Uniprot ID: O95298
  ENSP ID: ENSP00000434262
MIARRNPEPLRFLPDEARSLPPPKLTDPRLLYIGFLGYCSGLIDNLIRRRPIATADYLYAVRDREMFGYMKLHPEDFPEEDKKTYGEIFEKFHPIR

SEQ ID NO: 55164 - protein, 107 aa, Homo sapiens
  Payload ID: 10887
  Gene Symbol: NDUFC2
  Gene Name: NADH dehydrogenase (ubiquinone) 1, subcomplex unknown, 2, 14.5kDa
  ENSP ID: ENSP00000435017
MIARRNPEPLRFLPDEARSLPPPKLTDPRLLYIGFLGYCSGLIDNLIRRRPIATAGLHRQLLYITAFFFAGYYLVKREDYLYAVRDREMFGYMKLHPEDFPEEGISS

SEQ ID NO: 55165 - protein, 327 aa, Homo sapiens
  Payload ID: 10888
  Gene Symbol: NDUFAF1
  Gene Name: NADH dehydrogenase (ubiquinone) complex I, assembly factor 1
  Uniprot ID: Q9Y375
  ENSP ID: ENSP00000260361
MALVHKLLRGTYFLRKFSKPTSALYPFLGIRFAEYSSSLQKPVASPGKASSQRKTEGDLQGDHQKEVALDITSSEEKPDVSFDKAIRDEAIYHFRLLKDEIVDHWRGPEGHPLHEVLLEQAKVVWQFRGKEDLDKWTVTSDKTIGGRSEVFLKMGKNNQSALLYGTLSSEAPQDGESTRSGYCAMISRIPRGAFERKMSYDWSQFNTLYLRVRGDGRPWMVNIKEDTDFFQRTNQMYSYFMFTRGGPYWQEVKIPFSKFFFSNRGRIRDVQHELPLDKISSIGFTLADKVDGPFFLEIDFIGVFTDPAHTEEFAYENSPELNPRLFK

SEQ ID NO: 55166 - protein, 261 aa, Homo sapiens
  Payload ID: 10888
  Gene Symbol: NDUFAF1
  Gene Name: NADH dehydrogenase (ubiquinone) complex I, assembly factor 1
  ENSP ID: ENSP00000453027
MALVHKLLRGTYFLRKFSKPTSALYPFLGIRFAEYSSSLQKPVASPGKASSQRKTEGDLQGDHQKEVALDITSSEEKPDVSFDKAIRDEAIYHFRLLKDEIVDHWRGPEGHPLHEVLLEQAKVVWQFRGKEDLDKWTVTSDKTIGGRSEVFLKMGKNNQSALLYGTLSSEAPQDGESTRSGYCAMISRIPRGAFERKMSYDWSQFNTLYLRVRGDGRPWMVNIKEDTDFFQRTNQMYSYFMFTRGGPYWQEVKATLLKLVS

SEQ ID NO: 55167 - protein, 209 aa, Homo sapiens
  Payload ID: 10888
  Gene Symbol: NDUFAF1
  Gene Name: NADH dehydrogenase (ubiquinone) complex I, assembly factor 1
  ENSP ID: ENSP00000453944
MALVHKLLRGTYFLRKFSKPTSALYPFLGIRFAEYSSSLQKPVASPGKASSQRKTEGDLQGDHQKEVALDITSSEEKPDVSFDKAIRDEAIYHFRLLKDEIVDHWRGPEGHPLHEVLLEQAKVVWQFRGKEDLDKWTVTSDKTIGGRSEVFLKMGKNNQSALLYGTLSSEAPQDGESTRSGYCAMISRIPRGAFERKMSYDWSQFNTLY

SEQ ID NO: 55168 - protein, 191 aa, Homo sapiens
  Payload ID: 10888
  Gene Symbol: NDUFAF1
  Gene Name: NADH dehydrogenase (ubiquinone) complex I, assembly factor 1
  ENSP ID: ENSP00000454083
MALVHKLLRGTYFLRKFSKPTSALYPFLGIRFAEYSSSLQKPVASPGKASSQRKTEGDLQGDHQKEVALDITSSEEKPDVSFDKAIRDEAIYHFRLLKDEIVDHWRGPEGHPLHEVLLEQAKVVWQFRGKEDLDKWTVTSDKTIGGRSEVFLKMGKNNQSALLYGTLSSEAPQDGESTRSGYCAMISRIPR

SEQ ID NO: 55169 - protein, 169 aa, Homo sapiens
  Payload ID: 10889
  Gene Symbol: NDUFAF2
  Gene Name: NADH dehydrogenase (ubiquinone) complex I, assembly factor 2
  Uniprot ID: Q8N183
  ENSP ID: ENSP00000296597
MGWSQDLFRALWRSLSREVKEHVGTDQFGNKYYYIPQYKNWRGQTIREKRIVEAANKKEVDYEAGDIPTEWEAWIRRTRKTPPTMEEILKNEKHREEIKIKSQDFYEKEKLLSKETSEELLPPPVQTQIKGHASAPYFGKEEPSVAPSSTGKTFQPGSWMPRDGKSHNQ

SEQ ID NO: 55170 - protein, 60 aa, Homo sapiens
  Payload ID: 10889
  Gene Symbol: NDUFAF2
  Gene Name: NADH dehydrogenase (ubiquinone) complex I, assembly factor 2
  ENSP ID: ENSP00000423377
MGWSQDLFRALWRSLSREVKEHVGTDQFGNKYYYIPQYKNWRGEVAAWAAIAWSVIASLD

SEQ ID NO: 55171 - protein, 51 aa, Homo sapiens
  Payload ID: 10889
  Gene Symbol: NDUFAF2
  Gene Name: NADH dehydrogenase (ubiquinone) complex I, assembly factor 2
  ENSP ID: ENSP00000426149
  MOD_RES (1)..(1): Any amino acid
XFGNKYYYIPQYKNWRGQTIREKRIVEAANKKEVDYEAGDIPTEWEGNTKE

SEQ ID NO: 55172 - protein, 127 aa, Homo sapiens
  Payload ID: 10890
  Gene Symbol: NDUFAF3
  Gene Name: NADH dehydrogenase (ubiquinone) complex I, assembly factor 3
  Uniprot ID: Q9BU61
  ENSP ID: ENSP00000323003
MYIDSYNSRGFMINGNRVLGPCALLPHSVVQWNVGSHQDITEDSFSLFWLLEPRIEIVVVGTGDRTERLQSQVLQAMRQRGIAVEVQDTPNACATFNFLCHEGRVTGAALIPPPGGTSLTSLGQAAQ

SEQ ID NO: 55173 - protein, 184 aa, Homo sapiens
  Payload ID: 10890
  Gene Symbol: NDUFAF3
  Gene Name: NADH dehydrogenase (ubiquinone) complex I, assembly factor 3
  Uniprot ID: Q9BU61
  ENSP ID: ENSP00000323076
MATALALRSLYRARPSLRCPPVELPWAPRRGHRLSPADDELYQRTRISLLQREAAQAMYIDSYNSRGFMINGNRVLGPCALLPHSVVQWNVGSHQDITEDSFSLFWLLEPRIEIVVVGTGDRTERLQSQVLQAMRQRGIAVEVQDTPNACATFNFLCHEGRVTGAALIPPPGGTSLTSLGQAAQ

SEQ ID NO: 55174 - protein, 127 aa, Homo sapiens; identical to SEQ ID NO: 55172
  Payload ID: 10890
  Gene Symbol: NDUFAF3
  Gene Name: NADH dehydrogenase (ubiquinone) complex I, assembly factor 3
  Uniprot ID: Q9BU61
  ENSP ID: ENSP00000378843

SEQ ID NO: 55175 - protein, 127 aa, Homo sapiens; identical to SEQ ID NO: 55172
  Payload ID: 10890
  Gene Symbol: NDUFAF3
  Gene Name: NADH dehydrogenase (ubiquinone) complex I, assembly factor 3
  Uniprot ID: Q9BU61
  ENSP ID: ENSP00000402465

SEQ ID NO: 55176 - protein, 175 aa, Homo sapiens
  Payload ID: 10891
  Gene Symbol: NDUFAF4
  Gene Name: NADH dehydrogenase (ubiquinone) complex I, assembly factor 4
  Uniprot ID: Q9P032
  ENSP ID: ENSP00000358272
MGALVIRGIRNFNLENRAEREISKMKPSVAPRHPSTNSLLREQISLYPEVKGEIARKDEKLLSFLKDVYVDSKDPVSSLQVKAAETCQEPKEFRLPKDHHFDMINIKSIPKGKISIVEALTLLNNHKLFPETWTAEKIMQEYQLEQKDVNSLLKYFVTFEVEIFPPEDKKAIRSK

SEQ ID NO: 55177 - protein, 345 aa, Homo sapiens
  Payload ID: 10892
  Gene Symbol: NDUFAF5
  Gene Name: NADH dehydrogenase (ubiquinone) complex I, assembly factor 5
  Uniprot ID: Q5TEU4
  ENSP ID: ENSP00000367346
MLRPAGLWRLCRRPWAARVPAENLGRREVTSGVSPRGSTSPRTLNIFDRDLKRKQKNWAARQPEPTKFDYLKEEVGSRIADRVYDIPRNFPLALDLGCGRGYIAQYLNKETIGKFFQADIAENALKNSSETEIPTVSVLADEEFLPFKENTFDLVVSSLSLHWVNDLPRALEQIHYILKPDGVFIGAMFGGDTLYELRCSLQLAETEREGGFSPHISPFTAVNDLGHLLGRAGFNTLTVDTDEIQVNYPGMFELMEDLQGMGESNCAWNRKALLHRDTMLAAAAVYREMYRNEDGSVPATYQIYYMIGWKYHESQARPAERGSATVSFGELGKINNLMPPGKKSQ

SEQ ID NO: 55178 - protein, 317 aa, Homo sapiens
  Payload ID: 10892
  Gene Symbol: NDUFAF5
  Gene Name: NADH dehydrogenase (ubiquinone) complex I, assembly factor 5
  Uniprot ID: Q5TEU4
  ENSP ID: ENSP00000420497
MLRPAGLWRLCRRPWAARVPAENLGRREVTSGVSPRGSTSPRTLNIFDRDLKRKQKNWAARQPEPTKFDYLKEEVGSRIADRVYDIPRNFPLALDLGCGRGYIAQYLNKLQLFHCRKLLESFSKLTLQKMLCLHWVNDLPRALEQIHYILKPDGVFIGAMFGGDTLYELRCSLQLAETEREGGFSPHISPFTAVNDLGHLLGRAGFNTLTVDTDEIQVNYPGMFELMEDLQGMGESNCAWNRKALLHRDTMLAAAAVYREMYRNEDGSVPATYQIYYMIGWKYHESQARPAERGSATVSFGELGKINNLMPPGKKSQ

SEQ ID NO: 55179 - protein, 267 aa, Homo sapiens
  Payload ID: 10892
  Gene Symbol: NDUFAF5
  Gene Name: NADH dehydrogenase (ubiquinone) complex I, assembly factor 5
  ENSP ID: ENSP00000437325
MLRPAGLWRLCRRPWAARVPAENLGRREVTSGVSPRGSTSPRTLNIFDRDLKRKQKNWAARQPEPTKFDYLKEEVGSRIADRVYDIPRNFPLALDLGCGRGYIAQYLNKETIGKFFQADIAENALKNSSETEIPTVSVLADEEFLPFKENTFDLVVSSLSLHWVNDLPRALEQIHYILKPDGVFIGAMFGGDTLYELRCSLQLAETEREGGFSPHISPFTAVNDLGHLLGRAGFNTLTVDTDEIQVNYPGMFELMEDLQEQKSRMLT

SEQ ID NO: 55180 - protein, 241 aa, Homo sapiens
  Payload ID: 10893
  Gene Symbol: NDUFAF6
  Gene Name: NADH dehydrogenase (ubiquinone) complex I, assembly factor 6
  ENSP ID: ENSP00000379417
MWNWLRLVKDSVSEKTIGLMRMQFWKKTVEDIYCDNPPHQPVAIELWKAVKRHNLTKRWLMKIVDEREKNLDDKAYRNIKELENYAENTQSSLLYLTLEILGIKDLHADHAASHIGKAQGIVTCLRATPYHGSRRKVFLPMDICMLHGVSQEDFLRRNQDKNVRDVIYDIASQAHLHLKHARSFHKTVPVKAFPAFLQTVSLEDFLKKIQRVDFDIFHPSLQQKNTLLPLYLYIQSWRKTY

SEQ ID NO: 55181 - protein, 241 aa, Homo sapiens; identical to SEQ ID NO: 55180
  Payload ID: 10893
  Gene Symbol: NDUFAF6
  Gene Name: NADH dehydrogenase (ubiquinone) complex I, assembly factor 6
  ENSP ID: ENSP00000379419

SEQ ID NO: 55182 - protein, 333 aa, Homo sapiens
  Payload ID: 10893
  Gene Symbol: NDUFAF6
  Gene Name: NADH dehydrogenase (ubiquinone) complex I, assembly factor 6
  Uniprot ID: Q330K2
  ENSP ID: ENSP00000379430
MAASAHGSVWGPLRLGIPGLCCRRPPLGLYARMRRLPGPEVSGRSVAAASGPGAWGTDHYCLELLRKRDYEGYLCSLLLPAESRSSVFALRAFNVELAQVKDSVSEKTIGLMRMQFWKKTVEDIYCDNPPHQPVAIELWKAVKRHNLTKRWLMKIVDEREKNLDDKAYRNIKELENYAENTQSSLLYLTLEILGIKDLHADHAASHIGKAQGIVTCLRATPYHGSRRKVFLPMDICMLHGVSQEDFLRRNQDKNVRDVIYDIASQAHLHLKHARSFHKTVPVKAFPAFLQTVSLEDFLKKIQRVDFDIFHPSLQQKNTLLPLYLYIQSWRKTY

SEQ ID NO: 55183 - protein, 82 aa, Homo sapiens
  Payload ID: 10893
  Gene Symbol: NDUFAF6
  Gene Name: NADH dehydrogenase (ubiquinone) complex I, assembly factor 6
  ENSP ID: ENSP00000404060
  MOD_RES (1)..(1): Any amino acid
XCCRRPPLGLYARMRRLPGPEVSGRSVAAASGPGAWGTDHYCLELLRKRDYEGYLCSLLLPAESRSSVFALRAFNVELAQAG

SEQ ID NO: 55184 - protein, 133 aa, Homo sapiens
  Payload ID: 10893
  Gene Symbol: NDUFAF6
  Gene Name: NADH dehydrogenase (ubiquinone) complex I, assembly factor 6
  ENSP ID: ENSP00000428034
MWNWLRLVKDSVSEKTIGLMRMQFWKKTVEDIYCDNPPHQPVAIELWKAVKRHNLTKRWLMKIVDEREKNLDDKAYRNIKELENYAENTQSSLLYLTLEILGIKDLHADHAASHIGKAQGIVTCLRATPYHGS

SEQ ID NO: 55185 - protein, 58 aa, Homo sapiens
  Payload ID: 10893
  Gene Symbol: NDUFAF6
  Gene Name: NADH dehydrogenase (ubiquinone) complex I, assembly factor 6
  ENSP ID: ENSP00000428410
  MOD_RES (1)..(1): Any amino acid
XCCRRPPLGLYARMRRLPGPEVSGRSVAAASGPGAWGTDHYCLELLRLKTQSLRKQLD

SEQ ID NO: 55186 - protein, 93 aa, Homo sapiens
  Payload ID: 10893
  Gene Symbol: NDUFAF6
  Gene Name: NADH dehydrogenase (ubiquinone) complex I, assembly factor 6
  ENSP ID: ENSP00000428666
VWGPLRLGIPGLCCRRPPLGLYARMRRLPGPEVSGRSVAAASGPGAWGTDHYCLELLRKRDYEGYLCSLLLPAESRSSVFALRAFNVELAQAG

SEQ ID NO: 55187 - protein, 121 aa, Homo sapiens
  Payload ID: 10893
  Gene Symbol: NDUFAF6
  Gene Name: NADH dehydrogenase (ubiquinone) complex I, assembly factor 6
  Uniprot ID: Q330K2
  ENSP ID: ENSP00000428788
MAASAHGSVWGPLRLGIPGLCCRRPPLGLYARMRRLPGPEVSGRSVAAASGPGAWGTDHYCLELLRKRDYEGYLCSLLLPAESRSSVFALRAFNVELAQAGLLLLLSCCTVCHWDLNTKHC

SEQ ID NO: 55188 - protein, 121 aa, Homo sapiens; identical to SEQ ID NO: 55187
  Payload ID: 10893
  Gene Symbol: NDUFAF6
  Gene Name: NADH dehydrogenase (ubiquinone) complex I, assembly factor 6
  Uniprot ID: Q330K2
  ENSP ID: ENSP00000429038

SEQ ID NO: 55189 - protein, 95 aa, Homo sapiens
  Payload ID: 10893
  Gene Symbol: NDUFAF6
  Gene Name: NADH dehydrogenase (ubiquinone) complex I, assembly factor 6
  ENSP ID: ENSP00000429585
MRMQFWKKTVEDIYCDNPPHQPVAIELWKAVKRHNLTKRWLMKIVDEREKNLDDKAYRNIKELENYAENTQSSLLYLTLEILGIKDLHADHAASH

SEQ ID NO: 55190 - protein, 97 aa, Homo sapiens
  Payload ID: 10893
  Gene Symbol: NDUFAF6
  Gene Name: NADH dehydrogenase (ubiquinone) complex I, assembly factor 6
  ENSP ID: ENSP00000430099
AHGSVWGPLRLGIPGLCCRRPPLGLYARMRRLPGPEVSGRSVAAASGPGAWGTDHYCLELLRKRDYEGYLCSLLLPAESRSSVFALRAFNVELAQAG

SEQ ID NO: 55191 - protein, 102 aa, Homo sapiens
  Payload ID: 10893
  Gene Symbol: NDUFAF6
  Gene Name: NADH dehydrogenase (ubiquinone) complex I, assembly factor 6
  ENSP ID: ENSP00000430230
MRMQFWKKTVEDIYCDNPPHQPVAIELWKAVKRHNLTKRWLMKIVDEREKNLDDKAYRNIKELENYAENTQSSLLYLTLEILGIKDLHADHAASHIGKAQGI

SEQ ID NO: 55192 - protein, 142 aa, Homo sapiens
  Payload ID: 10893
  Gene Symbol: NDUFAF6
  Gene Name: NADH dehydrogenase (ubiquinone) complex I, assembly factor 6
  ENSP ID: ENSP00000430311
  MOD_RES (1)..(1): Any amino acid
XCCRRPPLGLYARMRRLPGPEVSGRSVAAASGPGAWGTDHYCLELLRKRDYEGYLCSLLLPAESRSSVFALRAFNVELAQVKDSVSEKTIGLMRMQFWKKTVEDIYCDNPPHQPVAIELWKVCTPAEAGPVSGPQIDFTEPQ

SEQ ID NO: 55193 - protein, 102 aa, Homo sapiens
  Payload ID: 10893
  Gene Symbol: NDUFAF6
  Gene Name: NADH dehydrogenase (ubiquinone) complex I, assembly factor 6
  ENSP ID: ENSP00000430991
LCCRRPPLGLYARMRRLPGPEVSGRSVAAASGPGAWGTDHYCLELLRKRDYEGYLCSLLLPAESRSSVFALRAFNVELAQAGLLLLLSCCTVCHWDLNTKHC

SEQ ID NO: 55194 - protein, 441 aa, Homo sapiens
  Payload ID: 10894
  Gene Symbol: NDUFAF7
  Gene Name: NADH dehydrogenase (ubiquinone) complex I, assembly factor 7
  Uniprot ID: Q7L592
  ENSP ID: ENSP00000002125
MSVLLRSGLGPLCAVARAAIPFIWRGKYFSSGNEPAENPVTPMLRHLMYKIKSTGPITVAEYMKEVLTNPAKGYYVYRDMLGEKGDFITSPEISQIFGELLGIWFISEWMATGKSTAFQLVELGPGRGTLVGDILRVFTQLGSVLKNCDISVHLVEVSQKLSEIQALTLTKEKVPLERNAGSPVYMKGVTKSGIPISWYRDLHDVPKGYSFYLAHEFFDVLPVHKFQKTPQGWREVFVDIDPQVSDKLRFVLAPSATPAEAFIQHDETRDHVEVCPDAGVIIEELSQRIALTGGAALVADYGHDGTKTDTFRGFCDHKLHDVLIAPGTADLTADVDFSYLRRMAQGKVASLGPIKQHTFLKNMGIDVRLKVLLDKSNEPSVRQQLLQGYDMLMNPKKMGERFNFFALLPHQRLQGGRYQRNARQSKPFASVVAGFSELAWQ

SEQ ID NO: 55195 - protein, 343 aa, Homo sapiens
  Payload ID: 10894
  Gene Symbol: NDUFAF7
  Gene Name: NADH dehydrogenase (ubiquinone) complex I, assembly factor 7
  Uniprot ID: Q7L592
  ENSP ID: ENSP00000337431
MSVLLRSGLGPLCAVARAAIPFIWRGKYFSSGNEPAENPVTPMLRHLMYKIKSTGPITVAEYMKEVLTNPAKLLGIWFISEWMATGKSTAFQLVELGPGRGTLVGDILRVFTQLGSVLKNCDISVHLVEKTPQGWREVFVDIDPQVSDKLRFVLAPSATPAEAFIQHDETRDHVEVCPDAGVIIEELSQRIALTGGAALVADYGHDGTKTDTFRGFCDHKLHDVLIAPGTADLTADVDFSYLRRMAQGKVASLGPIKQHTFLKNMGIDVRLKVLLDKSNEPSVRQQLLQGYDMLMNPKKMGERFNFFALLPHQRLQGGRYQRNARQSKPFASVVAGFSELAWQ

SEQ ID NO: 55196 - protein, 267 aa, Homo sapiens
  Payload ID: 10894
  Gene Symbol: NDUFAF7
  Gene Name: NADH dehydrogenase (ubiquinone) complex I, assembly factor 7
  ENSP ID: ENSP00000394436
MLRHLMYKIKSTGPITVAEYMKEVLTNPAKGYYVYRDMLGEKGDFITSPEISQIFGELLGIWFISEWMATGKSTAFQLVELGPGRGTLVGDILRVFTQLGSVLKNCDISVHLVEVSQKLSEIQALTLTKEKVPLERNAGSPVYMKGVTKSGIPISWYRDLHDVPKGYSFYLAHEFFDVLPVHKFQKTPQGWREVFVDIDPQVSDKLRFVLAPSATPAEAFIQHDETRDHVEVCPDAGVIIEELSQRIALTGGAALVADYGHDGTKTD

SEQ ID NO: 55197 - protein, 230 aa, Homo sapiens
  Payload ID: 10894
  Gene Symbol: NDUFAF7
  Gene Name: NADH dehydrogenase (ubiquinone) complex I, assembly factor 7
  ENSP ID: ENSP00000399207
MLGEKGDFITSPEISQIFGELLGIWFISEWMATGKSTAFQLVELGPGRGTLVGDILRVFTQLGSVLKNCDISVHLVEVSQKLSEIQALTLTKEKVPLERNAGSPVYMKGVTKSGIPISWYRDLHDVPKGYSFYLAHEFFDVLPVHKFQKTPQGWREVFVDIDPQVSDKLRFVLAPSATPAEAFIQHDETRDHVEVCPDAGVIIEELSQRIALTGGAALVADYGHDGTKTD

SEQ ID NO: 55198 - protein, 148 aa, Homo sapiens
  Payload ID: 10894
  Gene Symbol: NDUFAF7
  Gene Name: NADH dehydrogenase (ubiquinone) complex I, assembly factor 7
  ENSP ID: ENSP00000402959
MLRHLMYKIKSTGPITVAEYMKEVLTNPAKGYYVYRDMLGEKGDFITSPEISQIFGELLGIWFISEWMATGKSTAFQLVELGPGRGTLVGDILRVFTQLGSVLKNCDISVHLVEVSQKLSEIQALTLTKEKVPLERNAGSPVYMKGVT

SEQ ID NO: 55199 - protein, 111 aa, Homo sapiens
  Payload ID: 10894
  Gene Symbol: NDUFAF7
  Gene Name: NADH dehydrogenase (ubiquinone) complex I, assembly factor 7
  ENSP ID: ENSP00000410181
MLRHLMYKIKSTGPITVAEYMKEVLTNPAKGYYVYRDMLGEKGDFITSPEISQIFGELLGIWFISEWMATGKSTAFQLVELGPGRGTLVGDILRVFTQLGSVLKNCDISVH

SEQ ID NO: 55200 - protein, 88 aa, Homo sapiens
  Payload ID: 10894
  Gene Symbol: NDUFAF7
  Gene Name: NADH dehydrogenase (ubiquinone) complex I, assembly factor 7
  ENSP ID: ENSP00000412942
GFCDHKLHDVLIAPGTADLTADVDFSYLRRMAQGKVASLGPIKQHTFLKNMGIDVRLKRLQGGRYQRNARQSKPFASVVAGFSELAWQ

SEQ ID NO: 55201 - protein, 137 aa, Homo sapiens
  Payload ID: 10894
  Gene Symbol: NDUFAF7
  Gene Name: NADH dehydrogenase (ubiquinone) complex I, assembly factor 7
  ENSP ID: ENSP00000416594
MSVLLRSGLGPLCAVARAAIPFIWRGKYFSSGNEPAENPVTPMLRHLMYKIKSTGPITVAEYMKEVLTNPAKGYYVYRDMLGEKGDFITSPEISQIFGELLGIWFISEWMATGKSTAFQLVELGPGVHSTWICAEKL

SEQ ID NO: 55202 - protein, 727 aa, Homo sapiens
  Payload ID: 10895
  Gene Symbol: NDUFS1
  Gene Name: NADH dehydrogenase (ubiquinone) Fe-S protein 1, 75kDa (NADH-coenzyme Q reductase)
  Uniprot ID: P28331
  ENSP ID: ENSP00000233190
MLRIPVRKALVGLSKSPKGCVRTTATAASNLIEVFVDGQSVMVEPGTTVLQACEKVGMQIPRFCYHERLSVAGNCRMCLVEIEKAPKVVAACAMPVMKGWNILTNSEKSKKAREGVMEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNYLLNTTIAGVEEADVVLLVGTNPRFEAPLFNARIRKSWLHNDLKVALIGSPVDLTYTYDHLGDSPKILQDIASGSHPFSQVLKEAKKPMVVLGSSALQRNDGAAILAAVSSIAQKIRMTSGVTGDWKVMNILHRIASQVAALDLGYKPGVEAIRKNPPKVLFLLGADGGCITRQDLPKDCFIIYQGHHGDVGAPIADVILPGAAYTEKSATYVNTEGRAQQTKVAVTPPGLAREDWKIIRALSEIAGMTLPYDTLDQVRNRLEEVSPNLVRYDDIEGANYFQQANELSKLVNQQLLADPLVPPQLTIKDFYMTDSISRASQTMAKCVKAVTEGAQAVEEPSIC

SEQ ID NO: 55203 - protein, 130 aa, Homo sapiens
  Payload ID: 10895
  Gene Symbol: NDUFS1
  Gene Name: NADH dehydrogenase (ubiquinone) Fe-S protein 1, 75kDa (NADH-coenzyme Q reductase)
  ENSP ID: ENSP00000389413
MLRIPVRKALVGLSKSPKGCVRTTATAASNLIEVFVDGQSVMVEPGTTVLQACEKVGMQIPRFCYHERLSVAGNCRMCLVEIEKAPKVVAACAMPVMKGWNILTNSEKSKKAREGVMEFLLANHPLDCPI

SEQ ID NO: 55204 - protein, 741 aa, Homo sapiens
  Payload ID: 10895
  Gene Symbol: NDUFS1
  Gene Name: NADH dehydrogenase (ubiquinone) Fe-S protein 1, 75kDa (NADH-coenzyme Q reductase)
  Uniprot ID: P28331
  ENSP ID: ENSP00000392709
MRIRGSSGTLSRINMLRIPVRKALVGLSKSPKGCVRTTATAASNLIEVFVDGQSVMVEPGTTVLQACEKVGMQIPRFCYHERLSVAGNCRMCLVEIEKAPKVVAACAMPVMKGWNILTNSEKSKKAREGVMEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNYLLNTTIAGVEEADVVLLVGTNPRFEAPLFNARIRKSWLHNDLKVALIGSPVDLTYTYDHLGDSPKILQDIASGSHPFSQVLKEAKKPMVVLGSSALQRNDGAAILAAVSSIAQKIRMTSGVTGDWKVMNILHRIASQVAALDLGYKPGVEAIRKNPPKVLFLLGADGGCITRQDLPKDCFIIYQGHHGDVGAPIADVILPGAAYTEKSATYVNTEGRAQQTKVAVTPPGLAREDWKIIRALSEIAGMTLPYDTLDQVRNRLEEVSPNLVRYDDIEGANYFQQANELSKLVNQQLLADPLVPPQLTIKDFYMTDSISRASQTMAKCVKAVTEGAQAVEEPSIC

SEQ ID NO: 55205 - protein, 91 aa, Homo sapiens
  Payload ID: 10895
  Gene Symbol: NDUFS1
  Gene Name: NADH dehydrogenase (ubiquinone) Fe-S protein 1, 75kDa (NADH-coenzyme Q reductase)
  ENSP ID: ENSP00000395553
MLRIPVRKALVGLSKSPKGCVRTTATAASNLIEVFVDGQSVMVEPGTTVLQACEKVGMQIPRFCYHERLSVAGNCRMCLVEIEKAPKVLDT

SEQ ID NO: 55206 - protein, 670 aa, Homo sapiens
  Payload ID: 10895
  Gene Symbol: NDUFS1
  Gene Name: NADH dehydrogenase (ubiquinone) Fe-S protein 1, 75kDa (NADH-coenzyme Q reductase)
  Uniprot ID: P28331
  ENSP ID: ENSP00000397760
MQIPRFCYHERLSVAGNCRMCLVEIEKAPKVVAACAMPVMKGWNILTNSEKSKKAREGVMEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNYLLNTTIAGVEEADVVLLVGTNPRFEAPLFNARIRKSWLHNDLKVALIGSPVDLTYTYDHLGDSPKILQDIASGSHPFSQVLKEAKKPMVVLGSSALQRNDGAAILAAVSSIAQKIRMTSGVTGDWKVMNILHRIASQVAALDLGYKPGVEAIRKNPPKVLFLLGADGGCITRQDLPKDCFIIYQGHHGDVGAPIADVILPGAAYTEKSATYVNTEGRAQQTKVAVTPPGLAREDWKIIRALSEIAGMTLPYDTLDQVRNRLEEVSPNLVRYDDIEGANYFQQANELSKLVNQQLLADPLVPPQLTIKDFYMTDSISRASQTMAKCVKAVTEGAQAVEEPSIC

SEQ ID NO: 55207 - protein, 727 aa, Homo sapiens; identical to SEQ ID NO: 55202
  Payload ID: 10895
  Gene Symbol: NDUFS1
  Gene Name: NADH dehydrogenase (ubiquinone) Fe-S protein 1, 75kDa (NADH-coenzyme Q reductase)
  Uniprot ID: P28331
  ENSP ID: ENSP00000399912

SEQ ID NO: 55208 - protein, 611 aa, Homo sapiens
  Payload ID: 10895
  Gene Symbol: NDUFS1
  Gene Name: NADH dehydrogenase (ubiquinone) Fe-S protein 1, 75kDa (NADH-coenzyme Q reductase)
  ENSP ID: ENSP00000400976
MEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNYLLNTTIAGVEEADVVLLVGTNPRFEAPLFNARIRKSWLHNDLKVALIGSPVDLTYTYDHLGDSPKILQDIASGSHPFSQVLKEAKKPMVVLGSSALQRNDGAAILAAVSSIAQKIRMTSGVTGDWKVMNILHRIASQVAALDLGYKPGVEAIRKNPPKVLFLLGADGGCITRQDLPKDCFIIYQGHHGDVGAPIADVILPGAAYTEKSATYVNTEGRAQQTKVAVTPPGLAREDWKIIRALSEIAGMTLPYDTLDQVRNRLEEVSPNLVRYDDIEGANYFQQANELSKLVNQQLLADPLVPPQLTIKDFYMTDSISRASQTMAKCVKAVTEGAQAVEEPSIC

SEQ ID NO: 55209 - protein, 616 aa, Homo sapiens
  Payload ID: 10895
  Gene Symbol: NDUFS1
  Gene Name: NADH dehydrogenase (ubiquinone) Fe-S protein 1, 75kDa (NADH-coenzyme Q reductase)
  Uniprot ID: P28331
  ENSP ID: ENSP00000409689
MWEGVMEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNYLLNTTIAGVEEADVVLLVGTNPRFEAPLFNARIRKSWLHNDLKVALIGSPVDLTYTYDHLGDSPKILQDIASGSHPFSQVLKEAKKPMVVLGSSALQRNDGAAILAAVSSIAQKIRMTSGVTGDWKVMNILHRIASQVAALDLGYKPGVEAIRKNPPKVLFLLGADGGCITRQDLPKDCFIIYQGHHGDVGAPIADVILPGAAYTEKSATYVNTEGRAQQTKVAVTPPGLAREDWKIIRALSEIAGMTLPYDTLDQVRNRLEEVSPNLVRYDDIEGANYFQQANELSKLVNQQLLADPLVPPQLTIKDFYMTDSISRASQTMAKCVKAVTEGAQAVEEPSIC

SEQ ID NO: 55210 - protein, 691 aa, Homo sapiens
  Payload ID: 10895
  Gene Symbol: NDUFS1
  Gene Name: NADH dehydrogenase (ubiquinone) Fe-S protein 1, 75kDa (NADH-coenzyme Q reductase)
  Uniprot ID: P28331
  ENSP ID: ENSP00000409766
MLRIPVRKALVGLSKSPKGCVRTTATAASNLIEVFVDGQSVMVEPGTTVLQVVAACAMPVMKGWNILTNSEKSKKAREGVMEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNYLLNTTIAGVEEADVVLLVGTNPRFEAPLFNARIRKSWLHNDLKVALIGSPVDLTYTYDHLGDSPKILQDIASGSHPFSQVLKEAKKPMVVLGSSALQRNDGAAILAAVSSIAQKIRMTSGVTGDWKVMNILHRIASQVAALDLGYKPGVEAIRKNPPKVLFLLGADGGCITRQDLPKDCFIIYQGHHGDVGAPIADVILPGAAYTEKSATYVNTEGRAQQTKVAVTPPGLAREDWKIIRALSEIAGMTLPYDTLDQVRNRLEEVSPNLVRYDDIEGANYFQQANELSKLVNQQLLADPLVPPQLTIKDFYMTDSISRASQTMAKCVKAVTEGAQAVEEPSIC

SEQ ID NO: 55211 - protein, 463 aa, Homo sapiens
  Payload ID: 10896
  Gene Symbol: NDUFS2
  Gene Name: NADH dehydrogenase (ubiquinone) Fe-S protein 2, 49kDa (NADH-coenzyme Q reductase)
  Uniprot ID: O75306
  ENSP ID: ENSP00000356972
MAALRALCGFRGVAAQVLRPGAGVRLPIQPSRGVRQWQPDVEWAQQFGGAVMYPSKETAHWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQDLPLGLMDDIYQFSKNFSLRLDELEELLTNNRIWRNRTIDIGVVTAEEALNYGFSGVMLRGSGIQWDLRKTQPYDVYDQVEFDVPVGSRGDCYDRYLCRVEEMRQSLRIIAQCLNKMPPGEIKVDDAKVSPPKRAEMKTSMESLIHHFKLYTEGYQVPPGATYTAIEAPKGEFGVYLVSDGSSRPYRCKIKAPGFAHLAGLDKMSKGHMLADVVAIIGTQDIVFGEVDR

SEQ ID NO: 55212 - protein, 457 aa, Homo sapiens
  Payload ID: 10896
  Gene Symbol: NDUFS2
  Gene Name: NADH dehydrogenase (ubiquinone) Fe-S protein 2, 49kDa (NADH-coenzyme Q reductase)
  Uniprot ID: O75306
  ENSP ID: ENSP00000376018
MAALRALCGFRGVAAQVLRPGAGVRLPIQPSRGVRQWQPDVEWAQQFGGAVMYPSKETAHWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQDLPLGLMDDIYQFSKNFSLRLDELEELLTNNRIWRNRTIDIGVVTAEEALNYGFSGVMLRGSGIQWDLRKTQPYDVYDQVEFDVPVGSRGDCYDRYLCRVEEMRQSLRIIAQCLNKMPPGEIKVDDAKVSPPKRAEMKTSMESLIHHFKLYTEGYQVPPGATYTAIEAPKGEFGVYLVSDGSSRPYRCKIKAPGFAHLAGLDKMSKGHMLADVVAIIGTRPIV

SEQ ID NO: 55213 - protein, 264 aa, Homo sapiens
  Payload ID: 10897
  Gene Symbol: NDUFS3
  Gene Name: NADH dehydrogenase (ubiquinone) Fe-S protein 3, 30kDa (NADH-coenzyme Q reductase)
  Uniprot ID: O75489
  ENSP ID: ENSP00000263774
MAAAAVARLWWRGILGASALTRGTGRPSVLLLPVRRESAGADTRPTVRPRNDVAHKQLSAFGEYVAEILPKYVQQVQVSCFNELEVCIHPDGVIPVLTFLRDHTNAQFKSLVDLTAVDVPTRQNRFEIVYNLLSLRFNSRIRVKTYTDELTPIESAVSVFKAANWYEREIWDMFGVFFANHPDLRRILTDYGFEGHPFRKDFPLSGYVELRYDDEVKRVVAEPVELAQEFRKFDLNSPWEAFPVYRQPPESLKLEAGDKKPDAK

SEQ ID NO: 55214 - protein, 77 aa, Homo sapiens
  Payload ID: 10897
  Gene Symbol: NDUFS3
  Gene Name: NADH dehydrogenase (ubiquinone) Fe-S protein 3, 30kDa (NADH-coenzyme Q reductase)
  ENSP ID: ENSP00000431588
MAAAAVARLWWRGILGASALTRATVRPRNDVAHKQLSAFGEYVAEILPKYVQQVQVSCFNELEVCIHPDGVIPVLTF

SEQ ID NO: 55215 - protein, 161 aa, Homo sapiens
  Payload ID: 10897
  Gene Symbol: NDUFS3
  Gene Name: NADH dehydrogenase (ubiquinone) Fe-S protein 3, 30kDa (NADH-coenzyme Q reductase)
  ENSP ID: ENSP00000432099
MAAAAVARLWWRGILGASALTRGTGRPSVLLLPVRRESAGADTRPTVRPRNDVAHKQLSAFGEYVAEILPKYVQQVQVSCFNELEVCIHPDGVIPVLTFLRDHTNAQFKSLVDLTAVDVPTRQNRFETESCSVARLECSGMILAHCNLRLPGSSDSPASAP

SEQ ID NO: 55216 - protein, 121 aa, Homo sapiens
  Payload ID: 10897
  Gene Symbol: NDUFS3
  Gene Name: NADH dehydrogenase (ubiquinone) Fe-S protein 3, 30kDa (NADH-coenzyme Q reductase)
  ENSP ID: ENSP00000433405
MAAAAVARLWWRGILGASALTRGTGRPSVLLLPVRRESAGADTRPTVRPRNDVAHKQLSAFGEYVAEILPKYVQQVQVILTNVIWVWVKKEPCSQGMWEWADLFQRNYRFLHPKLGLFSQH

SEQ ID NO: 55217 - protein, 67 aa, Homo sapiens
  Payload ID: 10897
  Gene Symbol: NDUFS3
  Gene Name: NADH dehydrogenase (ubiquinone) Fe-S protein 3, 30kDa (NADH-coenzyme Q reductase)
  ENSP ID: ENSP00000433753
MAAAAVARLWWRGILGASALTRGTGRPSVLLLPVRRESAGADTRREYVRAALFSELSAGPLRCLSLP

SEQ ID NO: 55218 - protein, 132 aa, Homo sapiens
  Payload ID: 10897
  Gene Symbol: NDUFS3
  Gene Name: NADH dehydrogenase (ubiquinone) Fe-S protein 3, 30kDa (NADH-coenzyme Q reductase)
  Uniprot ID: O75489
  ENSP ID: ENSP00000434970
MAAAAVARLWWRGILGASALTRGTGRPSVLLLPVRRESAGADTRPTVRPRNDVAHKQLSAFGEYVAEILPKYVQQVQVSCFNELEVCIHPDGVIPVLTFLRDHTNAQFKSLVDLTAVDVPTRQNRFEVSWEI

SEQ ID NO: 55219 - protein, 175 aa, Homo sapiens
  Payload ID: 10898
  Gene Symbol: NDUFS4
  Gene Name: NADH dehydrogenase (ubiquinone) Fe-S protein 4, 18kDa (NADH-coenzyme Q reductase)
  Uniprot ID: O43181
  ENSP ID: ENSP00000296684
MAAVSMSVVLRQTLWRRRAVAVAALSVSRVPTRSLRTSTWRLAQDQTQDTQLITVDEKLDITTLTGVPEEHIKTRKVRIFVPARNNMQSGVNNTKKWKMEFDTRERWENPLMGWASTADPLSNMVLTFSTKEDAVSFAEKNGWSYDIEERKVPKPKSKSYGANFSWNKRTRVSTK

SEQ ID NO: 55220 - protein, 73 aa, Homo sapiens
  Payload ID: 10898
  Gene Symbol: NDUFS4
  Gene Name: NADH dehydrogenase (ubiquinone) Fe-S protein 4, 18kDa (NADH-coenzyme Q reductase)
  ENSP ID: ENSP00000422177
MAAVSMSVVLRQTLWRRRAVAVAALSVSRVPTRSLRTSTWRLAQDQTQDTQLITVDEKLAFGVPVHSTWMHFN

SEQ ID NO: 55221 - protein, 116 aa, Homo sapiens
  Payload ID: 10898
  Gene Symbol: NDUFS4
  Gene Name: NADH dehydrogenase (ubiquinone) Fe-S protein 4, 18kDa (NADH-coenzyme Q reductase)
  ENSP ID: ENSP00000424570
SMSVVLRQTLWRRRAVAVAALSVSRVPTRSLRTSTWRLAQDQTQDTQLITVDEKLDITTLTGVPEEHIKTRKVRIFVPARNNMQSGVNNTKKWKMEFDTRERWENPLMGWASTMEL

SEQ ID NO: 55222 - protein, 49 aa, Homo sapiens
  Payload ID: 10898
  Gene Symbol: NDUFS4
  Gene Name: NADH dehydrogenase (ubiquinone) Fe-S protein 4, 18kDa (NADH-coenzyme Q reductase)
  ENSP ID: ENSP00000424993
MAAVSMSVVLRQTLWRRRAVAVAALSVSRVPTRDRALLCHPGWSAVVQS

SEQ ID NO: 55223 - protein, 131 aa, Homo sapiens
  Payload ID: 10898
  Gene Symbol: NDUFS4
  Gene Name: NADH dehydrogenase (ubiquinone) Fe-S protein 4, 18kDa (NADH-coenzyme Q reductase)
  ENSP ID: ENSP00000425967
MAAVSMSVVLRQTLWRRRAVAVAALSVSRVPTRSLRTSTWRLAQDQTQDTQLITVDEKLVYLVPLCFTFCGLATPSLELATLFPASRHLEFLFTLPGCILTNPEDFIRSPSTYSSNGYHYFNWSSRRAYKN

SEQ ID NO: 55224 - protein, 106 aa, Homo sapiens
  Payload ID: 10899
  Gene Symbol: NDUFS5
  Gene Name: NADH dehydrogenase (ubiquinone) Fe-S protein 5, 15kDa (NADH-coenzyme Q reductase)
  Uniprot ID: O43920
  ENSP ID: ENSP00000362058
MPFLDIQKRFGLNIDRWLTIQSGEQPYKMAGRCHAFEKEWIECAHGIGYTRAEKECKIEYDDFVECLLRQKTMRRAGTIRKQRDKLIKEGKYTPPPHHIGKGEPRP

SEQ ID NO: 55225 - protein, 106 aa, Homo sapiens; identical to SEQ ID NO: 55224
  Payload ID: 10899
  Gene Symbol: NDUFS5
  Gene Name: NADH dehydrogenase (ubiquinone) Fe-S protein 5, 15kDa (NADH-coenzyme Q reductase)
  Uniprot ID: O43920
  ENSP ID: ENSP00000362060

SEQ ID NO: 55226 - protein, 124 aa, Homo sapiens
  Payload ID: 10900
  Gene Symbol: NDUFS6
  Gene Name: NADH dehydrogenase (ubiquinone) Fe-S protein 6, 13kDa (NADH-coenzyme Q reductase)
  Uniprot ID: O75380
  ENSP ID: ENSP00000274137
MAAAMTFCRLLNRCGEAARSLPLGARCFGVRVSPTGEKVTHTGQVYDDKDYRRIRFVGRQKEVNENFAIDLIAEQPVSEVETRVIACDGGGGALGHPKVYINLDKETKTGTCGYCGLQFRQHHH

SEQ ID NO: 55227 - protein, 172 aa, Homo sapiens
  Payload ID: 10900
  Gene Symbol: NDUFS6
  Gene Name: NADH dehydrogenase (ubiquinone) Fe-S protein 6, 13kDa (NADH-coenzyme Q reductase)
  ENSP ID: ENSP00000422557
MAAAMTFCRLLNRCGEAARSLPLGARCFGVRVSPTGEKVTHTGQVYDDKDYRRIRFVGRQKEVNENFAIDLIAEQPVSEVETRVIACDGGGGALGHPKVYINLVRSWPPVHMLGQPARPHTPLHSQCLFFLSSSLPAPEAALTGFTLLAHSPYSATLQGLHRAACPKTPFQL

SEQ ID NO: 55228 - protein, 213 aa, Homo sapiens
  Payload ID: 10901
  Gene Symbol: NDUFS7
  Gene Name: NADH dehydrogenase (ubiquinone) Fe-S protein 7, 20kDa (NADH-coenzyme Q reductase)
  Uniprot ID: O75251
  ENSP ID: ENSP00000233627
MAVLSAPGLRGFRILGLRSSVGPAVQARGVHQSVATDGPSSTQPALPKARAVAPKPSSRGEYVVAKLDDLVNWARRSSLWPMTFGLACCAVEMMHMAAPRYDMDRFGVVFRASPRQSDVMIVAGTLTNKMAPALRKVYDQMPEPRYVVSMGSCANGGGYYHYSYSVVRGCDRIVPVDIYIPGCPPTAEALLYGILQLQRKIKRERRLQIWYRR

SEQ ID NO: 55229 - protein, 206 aa, Homo sapiens
  Payload ID: 10901
  Gene Symbol: NDUFS7
  Gene Name: NADH dehydrogenase (ubiquinone) Fe-S protein 7, 20kDa (NADH-coenzyme Q reductase)
  Uniprot ID: O75251
  ENSP ID: ENSP00000364262
MAVLSAPGLRGFRILGLRSSVGPAVQARGVHQSVATDGPSSTQPALPKARAVAPKPSSRGEYVVAKLDDLVNWARRSSLWPMTFGLACCAVEMMHMAAPRYDMDRFGVVFRASPRQSDVMIVAGTLTNKMAPALRKVYDQMPEPRYVVSMGSCANGGGYYHYSYSVVRGCDRIVPVDIYIPGRAGTAPPTRELETGPAPHGARRPL

SEQ ID NO: 55230 - protein, 236 aa, Homo sapiens
  Payload ID: 10901
  Gene Symbol: NDUFS7
  Gene Name: NADH dehydrogenase (ubiquinone) Fe-S protein 7, 20kDa (NADH-coenzyme Q reductase)
  ENSP ID: ENSP00000406630
MAVLSAPGLRGFRILGLRSSVGPAVQARGVHQSVATDGPSRPLAAAVGARIRLWEAPAWLTPPVPVCLCASTQPALPKARAVAPKPSSRGEYVVAKLDDLVNWARRSSLWPMTFGLACCAVEMMHMAAPRYDMDRFGVVFRASPRQSDVMIVAGTLTNKMAPALRKVYDQMPEPRYVVSMGSCANGGGYYHYSYSVVRGCDRIVPVDIYIPGRAGTAPPTRELETGPAPHGARRPL

SEQ ID NO: 55231 - protein, 206 aa, Homo sapiens; identical to SEQ ID NO: 55229
  Payload ID: 10901
  Gene Symbol: NDUFS7
  Gene Name: NADH dehydrogenase (ubiquinone) Fe-S protein 7, 20kDa (NADH-coenzyme Q reductase)
  Uniprot ID: O75251
  ENSP ID: ENSP00000440348

SEQ ID NO: 55232 - protein, 66 aa, Homo sapiens
  Payload ID: 10901
  Gene Symbol: NDUFS7
  Gene Name: NADH dehydrogenase (ubiquinone) Fe-S protein 7, 20kDa (NADH-coenzyme Q reductase)
  ENSP ID: ENSP00000442822
MAVLSWPARLPDPWSALQRGPGCAGTRCPSERGHRWPKQHPACPAKGQSRGSQTQQPGRVCGGQAG

SEQ ID NO: 55233 - protein, 182 aa, Homo sapiens
  Payload ID: 10901
  Gene Symbol: NDUFS7
  Gene Name: NADH dehydrogenase (ubiquinone) Fe-S protein 7, 20kDa (NADH-coenzyme Q reductase)
  ENSP ID: ENSP00000443273
MAVLSAPGLRGFRILGLRSSVGPAVQARGVHQSVATDGPSSTQPALPKARAVAPKPSSRGEYVVAKLDDLVNWARRSSLWPMTFGLACCAVEMMHMAAPRYDMDRFGVVFRASPRQSDVMIVAGTLTNKMAPALRKVYDQMPEPRYVVSMGSCANGGGYYHYSYSVVRGCDRIVPVDIYIPD

SEQ ID NO: 55234 - protein, 41 aa, Homo sapiens
  Payload ID: 10901
  Gene Symbol: NDUFS7
  Gene Name: NADH dehydrogenase (ubiquinone) Fe-S protein 7, 20kDa (NADH-coenzyme Q reductase)
  ENSP ID: ENSP00000467094
MAVLSDGVSLCHPSWSAVAQPLLTATSTSRVQVILLPQPLE

SEQ ID NO: 55235 - protein, 214 aa, Homo sapiens
  Payload ID: 10901
  Gene Symbol: NDUFS7
  Gene Name: NADH dehydrogenase (ubiquinone) Fe-S protein 7, 20kDa (NADH-coenzyme Q reductase)
  ENSP ID: ENSP00000477895
MAVLSAPGLRGFRILGLRSSVGPAVQARGVHQSVATDGPSSTQPALPKARAVAPKPSSRGEYVVAKLDDLVNWARRSSLWPMTFGLACCAVEMMHMAAPRYDMDRFGVVFRASPRQSDVMIVAGTLTNKMAPALRKPPSRPQNAGAALRGLHGELRQRRRLLPLFLLGGEGLRPHRARGHLHPRLPTAEALLYGILQLQRKIKRERRLQIWYRR

SEQ ID NO: 55236 - protein, 214 aa, Homo sapiens
  Payload ID: 10901
  Gene Symbol: NDUFS7
  Gene Name: NADH dehydrogenase (ubiquinone) Fe-S protein 7, 20kDa (NADH-coenzyme Q reductase)
  ENSP ID: ENSP00000480984
MAVLSAPGLRGFRILGLRSSVGPAVQARGVHQSVATDGPSSTQPALPKARAVAPKPSSRGEYVVAKLDDLVNWARRSSLWPMTFGLACCAVEMMHMAAPRYDMDRFGVVFRASPRQSDVMIVAGTLTNKMAPALRKSSLRPDAGAALRGLHGELRQRRRLLPLFLLGGEGLRPHRARGHLHPRLPTTAEALLYGILQLQRKIKRERRLQIWYRR

SEQ ID NO: 55237 - protein, 210 aa, Homo sapiens
  Payload ID: 10902
  Gene Symbol: NDUFS8
  Gene Name: NADH dehydrogenase (ubiquinone) Fe-S protein 8, 23kDa (NADH-coenzyme Q reductase)
  Uniprot ID: O00217
  ENSP ID: ENSP00000315774
MRCLTTPMLLRALAQAARAGPPGGRSLHSSAVAATYKYVNMQDPEMDMKSVTDRAARTLLWTELFRGLGMTLSYLFREPATINYPFEKGPLSPRFRGEHALRRYPSGEERCIACKLCEAICPAQAITIEAEPRADGSRRTTRYDIDMTKCIYCGFCQEACPVDAIVEGPNFEFSTETHEELLYNKEKLLNNGDKWEAEIAANIQADYLYR

SEQ ID NO: 55238 - protein, 124 aa, Homo sapiens
  Payload ID: 10902
  Gene Symbol: NDUFS8
  Gene Name: NADH dehydrogenase (ubiquinone) Fe-S protein 8, 23kDa (NADH-coenzyme Q reductase)
  ENSP ID: ENSP00000403972
MRCLTTPMLLRALAQAARAGPPGGRSLHSSAVAATYKYVNMQDPEMDMKSVTDRAARTLLWTELFRGLGMTLSYLFREPATINYPFEKGPLSPRFRGEHALRRYPSGEERCIACKLCEAICPAQ

SEQ ID NO: 55239 - protein, 40 aa, Homo sapiens
  Payload ID: 10902
  Gene Symbol: NDUFS8
  Gene Name: NADH dehydrogenase (ubiquinone) Fe-S protein 8, 23kDa (NADH-coenzyme Q reductase)
  ENSP ID: ENSP00000431293
LTTPMLLRALAQAARAGPPGGRSLHSSAVAATYSEYLGGL

SEQ ID NO: 55240 - protein, 64 aa, Homo sapiens
  Payload ID: 10902
  Gene Symbol: NDUFS8
  Gene Name: NADH dehydrogenase (ubiquinone) Fe-S protein 8, 23kDa (NADH-coenzyme Q reductase)
  ENSP ID: ENSP00000432848
MTKCIYCGFCQEACPVDAIVEGPNFEFSTETHEELLYNKEKLLNNGDKWEAEIAANIQADYLYR

SEQ ID NO: 55241 - protein, 110 aa, Homo sapiens
  Payload ID: 10902
  Gene Symbol: NDUFS8
  Gene Name: NADH dehydrogenase (ubiquinone) Fe-S protein 8, 23kDa (NADH-coenzyme Q reductase)
  ENSP ID: ENSP00000432968
MRCLTTPMLLRALAQAARAGPPGGRSLHSSAVAATYKYVNMQDPEMDMKSVTDRAARTLLWTELFRGLGMTLSYLFREPATINYPFEKGPLSPRFRGEHALRRYPSGEER

SEQ ID NO: 55242 - protein, 70 aa, Homo sapiens
  Payload ID: 10902
  Gene Symbol: NDUFS8
  Gene Name: NADH dehydrogenase (ubiquinone) Fe-S protein 8, 23kDa (NADH-coenzyme Q reductase)
  ENSP ID: ENSP00000433054
MRRPLCATGLVRVGDHWEDALPDHAYAAAGPGPGCTCRTSWWPEPPQQCSGSHLQVCEHAGSRDGHEVSD

SEQ ID NO: 55243 - protein, 138 aa, Homo sapiens
  Payload ID: 10902
  Gene Symbol: NDUFS8
  Gene Name: NADH dehydrogenase (ubiquinone) Fe-S protein 8, 23kDa (NADH-coenzyme Q reductase)
  ENSP ID: ENSP00000433521
MRRPLCATGLVRVGDHWEEYVNMQDPEMDMKSVTDRAARTLLWTELFRGLGMTLSYLFREPATINYPFEKGPLSPRFRGEHALRRYPSGEERCIACKLCEAICPAQAITIEAEPRADGSRRTTRYDIDMTKCIYCGFC

SEQ ID NO: 55244 - protein, 43 aa, Homo sapiens
  Payload ID: 10902
  Gene Symbol: NDUFS8
  Gene Name: NADH dehydrogenase (ubiquinone) Fe-S protein 8, 23kDa (NADH-coenzyme Q reductase)
  ENSP ID: ENSP00000433645
MRCLTTPMLLRALAQAARAGPPGGRSLHSSAVAATYSEYLGGL

SEQ ID NO: 55245 - protein, 93 aa, Homo sapiens
  Payload ID: 10902
  Gene Symbol: NDUFS8
  Gene Name: NADH dehydrogenase (ubiquinone) Fe-S protein 8, 23kDa (NADH-coenzyme Q reductase)
  ENSP ID: ENSP00000434283
  MOD_RES (1)..(1): Any amino acid
XEPATINYPFEKGPLSPRFRGEHALRRYPSGEERCIACKLCEAICPAQGETLRAAGATLNKAVNSPLVRGGSWQMTPAADKQARQAGHGGSRL

SEQ ID NO: 55246 - protein, 184 aa, Homo sapiens
  Payload ID: 10902
  Gene Symbol: NDUFS8
  Gene Name: NADH dehydrogenase (ubiquinone) Fe-S protein 8, 23kDa (NADH-coenzyme Q reductase)
  ENSP ID: ENSP00000436287
MRCLTTPMLLRALAQAARAGPPGGRSLHSSAVAATYKYVNMQDPEMDMKSVTDRAARTLLWTELFRGLGMTLSYLFREPATINYPFEKGPLSPRFRGEHALRRYPSGEERCIACKLCEAICPAQAITIEAEPRADGSRRTTRYDIDMTKCIYCGFCQEACPVDAIVEGPNFEFSTETHEELLYN

SEQ ID NO: 55247 - protein, 464 aa, Homo sapiens
  Payload ID: 10903
  Gene Symbol: NDUFV1
  Gene Name: NADH dehydrogenase (ubiquinone) flavoprotein 1, 51kDa
  Uniprot ID: P49821
  ENSP ID: ENSP00000322450
MLATRRLLGWSLPARVSVRFSGDTTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQRFAQQHQARQAAS

SEQ ID NO: 55248 - protein, 457 aa, Homo sapiens
  Payload ID: 10903
  Gene Symbol: NDUFV1
  Gene Name: NADH dehydrogenase (ubiquinone) flavoprotein 1, 51kDa
  ENSP ID: ENSP00000395368
MLATRRLLGWSLPARVSTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQRFAQQHQARQAAS

SEQ ID NO: 55249 - protein, 95 aa, Homo sapiens
  Payload ID: 10903
  Gene Symbol: NDUFV1
  Gene Name: NADH dehydrogenase (ubiquinone) flavoprotein 1, 51kDa
  ENSP ID: ENSP00000431751
MNKPSDGRPKYLVVNADEGEPGTCKDREILRHDPHKLLEGCLVGGRAMGARAAYIYIRGEFYNEASNLQVAIREAYEAGLIGKNACGSGYDFDVF

SEQ ID NO: 55250 - protein, 363 aa, Homo sapiens
  Payload ID: 10903
  Gene Symbol: NDUFV1
  Gene Name: NADH dehydrogenase (ubiquinone) flavoprotein 1, 51kDa
  ENSP ID: ENSP00000432015
MNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQRFAQQHQARQAAS

SEQ ID NO: 55251 - protein, 127 aa, Homo sapiens
  Payload ID: 10903
  Gene Symbol: NDUFV1
  Gene Name: NADH dehydrogenase (ubiquinone) flavoprotein 1, 51kDa
  ENSP ID: ENSP00000432637
CPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSVWTG

SEQ ID NO: 55252 - protein, 178 aa, Homo sapiens
  Payload ID: 10903
  Gene Symbol: NDUFV1
  Gene Name: NADH dehydrogenase (ubiquinone) flavoprotein 1, 51kDa
  ENSP ID: ENSP00000434438
MLATRRLLGWSLPARVSVRFSGDTDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSG

SEQ ID NO: 55253 - protein, 43 aa, Homo sapiens
  Payload ID: 10903
  Gene Symbol: NDUFV1
  Gene Name: NADH dehydrogenase (ubiquinone) flavoprotein 1, 51kDa
  ENSP ID: ENSP00000434575
MLATRRLLGWSLPARVSVRFSGDTSSAWRKFCRQHPRKPHLAR

SEQ ID NO: 55254 - protein, 52 aa, Homo sapiens
  Payload ID: 10903
  Gene Symbol: NDUFV1
  Gene Name: NADH dehydrogenase (ubiquinone) flavoprotein 1, 51kDa
  ENSP ID: ENSP00000434581
MNKPSDGRPKYLVVNADEGEPGTCKDREILRHDPHKLLEGCLVGGRAMGARA

SEQ ID NO: 55255 - protein, 133 aa, Homo sapiens
  Payload ID: 10903
  Gene Symbol: NDUFV1
  Gene Name: NADH dehydrogenase (ubiquinone) flavoprotein 1, 51kDa
  ENSP ID: ENSP00000435199
EAYEAGLIGKNACGSGYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAVCV

SEQ ID NO: 55256 - protein, 136 aa, Homo sapiens
  Payload ID: 10903
  Gene Symbol: NDUFV1
  Gene Name: NADH dehydrogenase (ubiquinone) flavoprotein 1, 51kDa
  ENSP ID: ENSP00000435202
MNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPFPADVGKAW

SEQ ID NO: 55257 - protein, 455 aa, Homo sapiens
  Payload ID: 10903
  Gene Symbol: NDUFV1
  Gene Name: NADH dehydrogenase (ubiquinone) flavoprotein 1, 51kDa
  Uniprot ID: P49821
  ENSP ID: ENSP00000436766
MLATRRLLGWSLPARTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQRFAQQHQARQAAS

SEQ ID NO: 55258 - protein, 75 aa, Homo sapiens
  Payload ID: 10903
  Gene Symbol: NDUFV1
  Gene Name: NADH dehydrogenase (ubiquinone) flavoprotein 1, 51kDa
  ENSP ID: ENSP00000436906
MGIPSPSAAPKKTSFGSLKDEDRIFTNLYGRHDWRLKGSLSRGDWYKTKEILLKGPDWILGEIKTSGLRGRGGAG

SEQ ID NO: 55259 - protein, 144 aa, Homo sapiens
  Payload ID: 10903
  Gene Symbol: NDUFV1
  Gene Name: NADH dehydrogenase (ubiquinone) flavoprotein 1, 51kDa
  ENSP ID: ENSP00000436936
MKTGFSPTCTAAMTGGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIG

SEQ ID NO: 55260 - protein, 178 aa, Homo sapiens
  Payload ID: 10903
  Gene Symbol: NDUFV1
  Gene Name: NADH dehydrogenase (ubiquinone) flavoprotein 1, 51kDa
  ENSP ID: ENSP00000437267
MLATRRLLGWSLPARVSVRFSGDTTAPKKTSFGSLKDEDRIFTNLLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKN

SEQ ID NO: 55261 - protein, 249 aa, Homo sapiens
  Payload ID: 10904
  Gene Symbol: NDUFV2
  Gene Name: NADH dehydrogenase (ubiquinone) flavoprotein 2, 24kDa
  Uniprot ID: P19404
  ENSP ID: ENSP00000327268
MFFSAALRARAAGLTAHWGRHVRNLHKTVMQNGAGGALFVHRDTPENNPDTPFDFTPENYKRIEAIVKNYPEGHKAAAVLPVLDLAQRQNGWLPISAMNKVAEVLQVPPMRVYEVATFYTMYNRKPVGKYHIQVCTTTPCMLRNSDSILEAIQKKLGIKVGETTPDKLFTLIEVECLGACVNAPMVQINDNYYEDLTAKDIEEIIDELKAGKIPKPGPRSGRFSCEPAGGLTSLTEPPKGPGFGVQAGL

SEQ ID NO: 55262 - protein, 252 aa, Homo sapiens
  Payload ID: 10904
  Gene Symbol: NDUFV2
  Gene Name: NADH dehydrogenase (ubiquinone) flavoprotein 2, 24kDa
  ENSP ID: ENSP00000382908
MRSHPLLLETLQTICFYKNGKGRHVRNLHKTVMQNGAGGALFVHRDTPENNPDTPFDFTPENYKRIEAIVKNYPEGHKAAAVLPVLDLAQRQNGWLPISAMNKVAEVLQVPPMRVYEVATFYTMYNRKPVGKYHIQVCTTTPCMLRNSDSILEAIQKKLGIKVGETTPDKLFTLIEVECLGACVNAPMVQINDNYYEDLTAKDIEEIIDELKAGKIPKPGPRSGRFSCEPAGGLTSLTEPPKGPGFGVQAGL

SEQ ID NO: 55263 - protein, 39 aa, Homo sapiens
  Payload ID: 10904
  Gene Symbol: NDUFV2
  Gene Name: NADH dehydrogenase (ubiquinone) flavoprotein 2, 24kDa
  ENSP ID: ENSP00000461911
MFFSAALRARAAGLTAHWVRRLKLSPALPPPFSCSPCLP

SEQ ID NO: 55264 - protein, 21 aa, Homo sapiens
  Payload ID: 10904
  Gene Symbol: NDUFV2
  Gene Name: NADH dehydrogenase (ubiquinone) flavoprotein 2, 24kDa
  ENSP ID: ENSP00000464504
MFFSAALRARAAGLTAHWRRI

SEQ ID NO: 55265 - protein, 108 aa, Homo sapiens
  Payload ID: 10905
  Gene Symbol: NDUFV3
  Gene Name: NADH dehydrogenase (ubiquinone) flavoprotein 3, 10kDa
  Uniprot ID: P56181
  ENSP ID: ENSP00000342895
MAAPCLLRQGRAGALKTMLQEAQVFRGLASTVSLSAESGKSEKGQPQNSKKQSPPKKPAPVPAEPFDNTTYKNLQHHDYSTYTFLDLNLELSKFRMPQPSSGRESPRH

SEQ ID NO: 55266 - protein, 473 aa, Homo sapiens
  Payload ID: 10905
  Gene Symbol: NDUFV3
  Gene Name: NADH dehydrogenase (ubiquinone) flavoprotein 3, 10kDa
  Uniprot ID: P56181
  ENSP ID: ENSP00000346196
MAAPCLLRQGRAGALKTMLQEAQVFRGLASTVSLSAESGKSEKGQPQNSKKQSPPKNVVEPKERGKLLATQTAAELSKNLSSPSSYPPAVNKGRKVASPSPSGSVLFTDEGVPKFLSRKTLVEFPQKVLSPFRKQGSDSEARQVGRKVTSPSSSSSSSSSDSESDDEADVSEVTPRVVSKGRGGLRKPEASHSFENRAPRVTVSAKEKTLLQKPHVDITDPEKPHQPKKKGSPAKPSEGRENARPKTTMPRSQVDEEFLKQSLKEKQLQKTFRLNEIDKESQKPFEVKGPLPVHTKSGLSAPPKGSPAPAVLAEEARAEGQLQASPPGAAEGHLEKPVPEPQRKAAPPLPRKETSGTQGIEGHLKGGQAIVEDQIPPSNLETVPVENNHGFHEKTAALKLEAEGEAMEDAAAPGDDRGGTQEPAPVPAEPFDNTTYKNLQHHDYSTYTFLDLNLELSKFRMPQPSSGRESPRH

SEQ ID NO: 55267 - protein, 133 aa, Homo sapiens; identical to SEQ ID NO: 55008
  Payload ID: 10906
  Gene Symbol: NDUFA10
  Gene Name: NADH dehydrogenase [ubiquinone] 1 alpha subcomplex subunit 10, mitochondrial
  ENSP ID: ENSP00000485694
  MOD_RES (1)..(1): Any amino acid

SEQ ID NO: 55268 - protein, 355 aa, Homo sapiens; identical to SEQ ID NO: 55012
  Payload ID: 10906
  Gene Symbol: NDUFA10
  Gene Name: NADH dehydrogenase [ubiquinone] 1 alpha subcomplex subunit 10, mitochondrial
  ENSP ID: ENSP00000485839

SEQ ID NO: 55269 - protein, 244 aa, Homo sapiens; identical to SEQ ID NO: 55011
  Payload ID: 10906
  Gene Symbol: NDUFA10
  Gene Name: NADH dehydrogenase [ubiquinone] 1 alpha subcomplex subunit 10, mitochondrial
  ENSP ID: ENSP00000486057

SEQ ID NO: 55270 - protein, 390 aa, Homo sapiens; identical to SEQ ID NO: 55006
  Payload ID: 10906
  Gene Symbol: NDUFA10
  Gene Name: NADH dehydrogenase [ubiquinone] 1 alpha subcomplex subunit 10, mitochondrial
  ENSP ID: ENSP00000486091

SEQ ID NO: 55271 - protein, 129 aa, Homo sapiens; identical to SEQ ID NO: 55009
  Payload ID: 10906
  Gene Symbol: NDUFA10
  Gene Name: NADH dehydrogenase [ubiquinone] 1 alpha subcomplex subunit 10, mitochondrial
  ENSP ID: ENSP00000486296

SEQ ID NO: 55272 - protein, 201 aa, Homo sapiens; identical to SEQ ID NO: 55005
  Payload ID: 10906
  Gene Symbol: NDUFA10
  Gene Name: NADH dehydrogenase [ubiquinone] 1 alpha subcomplex subunit 10, mitochondrial
  ENSP ID: ENSP00000486593

SEQ ID NO: 55273 - protein, 355 aa, Homo sapiens; identical to SEQ ID NO: 55003
  Payload ID: 10906
  Gene Symbol: NDUFA10
  Gene Name: NADH dehydrogenase [ubiquinone] 1 alpha subcomplex subunit 10, mitochondrial
  ENSP ID: ENSP00000486639

SEQ ID NO: 55274 - protein, 138 aa, Homo sapiens; identical to SEQ ID NO: 55010
  Payload ID: 10906
  Gene Symbol: NDUFA10
  Gene Name: NADH dehydrogenase [ubiquinone] 1 alpha subcomplex subunit 10, mitochondrial
  ENSP ID: ENSP00000486728

SEQ ID NO: 55275 - protein, 94 aa, Homo sapiens; identical to SEQ ID NO: 55007
  Payload ID: 10906
  Gene Symbol: NDUFA10
  Gene Name: NADH dehydrogenase [ubiquinone] 1 alpha subcomplex subunit 10, mitochondrial
  ENSP ID: ENSP00000487201

SEQ ID NO: 55276 - protein, 429 aa, Homo sapiens; identical to SEQ ID NO: 55004
  Payload ID: 10906
  Gene Symbol: NDUFA10
  Gene Name: NADH dehydrogenase [ubiquinone] 1 alpha subcomplex subunit 10, mitochondrial
  ENSP ID: ENSP00000487517

SEQ ID NO: 55277 - protein, 113 aa, Homo sapiens; identical to SEQ ID NO: 55086
  Payload ID: 10907
  Gene Symbol:
  Gene Name: NADH dehydrogenase [ubiquinone] 1 alpha subcomplex subunit 7  [Source:UniProtKB/Swiss-Prot
  Acc:O95182]
  Uniprot ID: O95182
  ENSP ID: ENSP00000470609

SEQ ID NO: 55278 - protein, 359 aa, Homo sapiens
  Payload ID: 10908
  Gene Symbol: NOXRED1
  Gene Name: NADP-dependent oxidoreductase domain containing 1
  Uniprot ID: Q6NXP6
  ENSP ID: ENSP00000370215
MDMLQDLESLQFEYGVPEEDRIWLYLQGRSRGLMIEACAHATFFCKLLYNLRASLNKNQSSRHLSIGSLNSATPEEFKVGIIGGGHLGKQLAGTLLQLGPIPAESLRISTRRPETLGELQKLGIKCFYHNADLVSWADVIFLCCLPSQLPNICVEIYTSLEKASIVYSFVAAIPLPRLKLLLNHTNILRPQYQYDEDSVSVWGANKGVIAALQDPTILQATCPYSPAGGIILNIKWLEGVFYAALNICTARNMAHSQVLQLLSELFLSVHFEDCGKDTASCPKLQLTDFVSKAYGKNLSQERPFPWFDLTAVQLKETPFSQHLSSSPVLQDHLTHLYCASFGISLTKEQPVISTGFPSQ

SEQ ID NO: 55279 - protein, 223 aa, Homo sapiens
  Payload ID: 10908
  Gene Symbol: NOXRED1
  Gene Name: NADP-dependent oxidoreductase domain containing 1
  ENSP ID: ENSP00000450597
MDMLQDLESLQFEYGVPEEDRIWLYLQGRSRGLMIEACAHATFFCKLLYNLRASLNKNQSSRHLSIGSLNSATPEEFKVGIIGGGHLGKQLAGTLLQLGPIPAESLRISTRRPETLGELQKLGIKCFYHNADLVSWADVIFLCCLPSQLPNICVEIYTSLEKASIVYSFVAAIPLPRLKLLLNHTNILRPQYQYDEDSVSVWGANKGVIAALQDPTILQATCP

SEQ ID NO: 55280 - protein, 597 aa, Homo sapiens
  Payload ID: 10909
  Gene Symbol: NDOR1
  Gene Name: NADPH dependent diflavin oxidoreductase 1
  Uniprot ID: Q9UHB4
  ENSP ID: ENSP00000343344
MPSPQLLVLFGSQTGTAQDVSERLGREARRRRLGCRVQALDSYPVVNLINEPLVIFVCATTGQGDPPDNMKNFWRFIFRKNLPSTALCQMDFAVLGLGDSSYAKFNFVAKKLHRRLLQLGGSALLPVCLGDDQHELGPDAAVDPWLRDLWDRVLGLYPPPPGLTEIPPGVPLPSKFTLLFLQEAPSTGSEGQRVAHPGSQEPPSESKPFLAPMISNQRVTGPSHFQDVRLIEFDILGSGISFAAGDVVLIQPSNSAAHVQRFCQVLGLDPDQLFMLQPREPDVSSPTRLPQPCSMRHLVSHYLDIASVPRRSFFELLACLSLHELEREKLLEFSSAQGQEELFEYCNRPRRTILEVLCDFPHTAAAIPPDYLLDLIPVIRPRAFSIASSLLTHPSRLQILVAVVQFQTRLKEPRRGLCSSWLASLDPGQGPVRVPLWVRPGSLAFPETPDTPVIMVGPGTGVAPFRAAIQERVAQGQTGNFLFFGCRWRDQDFYWEAEWQELEKRDCLTLIPAFSREQEQKVYVQHRLRELGSLVWELLDRQGAYFYLAGNAKSMPADVSEALMSIFQEEGGLCSPDAAAYLARLQQTRRFQTETWA

SEQ ID NO: 55281 - protein, 606 aa, Homo sapiens
  Payload ID: 10909
  Gene Symbol: NDOR1
  Gene Name: NADPH dependent diflavin oxidoreductase 1
  Uniprot ID: Q9UHB4
  ENSP ID: ENSP00000360576
MPSPQLLVLFGSQTGTAQDVSERLGREARRRRLGCRVQALDSYPVVNLINEPLVIFVCATTGQGDPPDNMKNFWRFIFRKNLPSTALCQMDFAVLGLGDSSYAKFNFVAKKLHRRLLQLGGSALLPVCLGDDQHELGPDAAVDPWLRDLWDRVLGLYPPPPGLTEIPPGVPLPSKFTLLFLQEAPSTGSEGQRVAHPGSQEPPSESKPFLAPMISNQRVTGPSHFQDVRLIEFDILGSGISFAAGDVVLIQPSNSAAHVQRFCQVLGLDPDQLFMLQPREPDVSSPTRLPQPCSMRHLVSHYLDIASVPRRSFFELLACLSLHELEREKLLEFSSAQGQEELFEYCNRPRRTILEVLCDFPHTAAAIPPDYLLDLIPVIRPRAFSIASSLLTHPSRLQILVAVVQFQTRLKEPRRGLCSSWLASLDPGQGPVRVPLWVRPGSLAFPETPDTPVIMVGPGTGVAPFRAAIQERVAQGQTGNFLFFGCRWRDQDFYWEAEWQELEKRDCLTLIPAFSREQPPALFSALQEQKVYVQHRLRELGSLVWELLDRQGAYFYLAGNAKSMPADVSEALMSIFQEEGGLCSPDAAAYLARLQQTRRFQTETWA

SEQ ID NO: 55282 - protein, 590 aa, Homo sapiens
  Payload ID: 10909
  Gene Symbol: NDOR1
  Gene Name: NADPH dependent diflavin oxidoreductase 1
  Uniprot ID: Q9UHB4
  ENSP ID: ENSP00000389905
MPSPQLLVLFGSQTGTAQDVSERLGREARRRRLGCRVQALDSYPVVNLINEPLVIFVCATTGQGDPPDNMKNFWRFIFRKNLPSTALCQMDFAVLGLGDSSYAKFNFVAKKLHRRLLQLGGSALLPVCLGDDQHELGPDAAVDPWLRDLWDRVLGLYPPPPGLTEIPPGVPLPSKFTLLFLQEAPSTGSEGQRVAHPGSQEPPSESKPFLAPMISNQRVTGPSHFQDVRLIEFDILGSGISFAAGDVVLIQPSNSAAHVQRFCQVLGLDPDQLFMLQPREPDVSSPTRLPQPCSMRHLVSHYLDIASVPRRSFFELLACLSLHELEREKLLEFSSAQGQEELFEYCNRPRRTILEVLCDFPHTAAAIPPDYLLDLIPVIRPRAFSIASSLLILVAVVQFQTRLKEPRRGLCSSWLASLDPGQGPVRVPLWVRPGSLAFPETPDTPVIMVGPGTGVAPFRAAIQERVAQGQTGNFLFFGCRWRDQDFYWEAEWQELEKRDCLTLIPAFSREQEQKVYVQHRLRELGSLVWELLDRQGAYFYLAGNAKSMPADVSEALMSIFQEEGGLCSPDAAAYLARLQQTRRFQTETWA

SEQ ID NO: 55283 - protein, 521 aa, Homo sapiens
  Payload ID: 10909
  Gene Symbol: NDOR1
  Gene Name: NADPH dependent diflavin oxidoreductase 1
  Uniprot ID: Q9UHB4
  ENSP ID: ENSP00000394309
MPSPQLLVLFGSQTGTAQDVSERLGREARRRRLGCRVQALDSYPVVNLINEPLVIFVCATTGQGDPPDNMKNFWRFIFRKNLPSTALCQMDFAVLGLGDSSYAKFNFVAKKLHRRLLQLGGSALLPVCLGDDQHELGLPSKFTLLFLQEAPSTGSEGQRVAHPGSQEPPSESKPFLAPMISNQRVTGPSHFQDVRLIEFDILGSGISFAAGDVVLIQPSNSAAHVQRFCQVLGLDPDQLFMLQPREPDVSSPTRLPQPCSMRHLVSHYLDIASVPRRSFFELLACLSLHELEREKLLEFSSAQGQEELFEYCNRPRRTILEVLCDFPHTAAAIPPDYLLDLIPVIRPRAFSIASSLLTHPSRLQILVAVVQFQTRLKEPRRGLCSSWLASLDPGQGPVRVPLWVRPGSLAFPETPDTPVIMVGPGTGVAPFRAAIQERVAQGQTGNFLFFGCRWRDQDFYWEAEWQELEKRDCLTLIPAFSREQEQKVYVQHRLRELGSLVWELLDRQATPSPCQRTSRKP

SEQ ID NO: 55284 - protein, 515 aa, Homo sapiens
  Payload ID: 10910
  Gene Symbol: NOX1
  Gene Name: NADPH oxidase 1
  Uniprot ID: Q9Y5S8
  ENSP ID: ENSP00000217885
MGNWVVNHWFSVLFLVVWLGLNVFLFVDAFLKYEKADKYYYTRKILGSTLACARASALCLNFNSTLILLPVCRNLLSFLRGTCSFCSRTLRKQLDHNLTFHKLVAYMICLHTAIHIIAHLFNFDCYSRSRQATDGSLASILSSLSHDEKKGGSWLNPIQSRNTTVEYVTFTSIAGLTGVIMTIALILMVTSATEFIRRSYFEVFWYTHHLFIFYILGLGIHGIGGIVRGQTEESMNESHPRKCAESFEMWDDRDSHCRRPKFEGHPPESWKWILAPVILYICERILRFYRSQQKVVITKVVMHPSKVLELQMNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKVGHAALNFDKATDIVTGLKQKTSFGRPMWDNEFSTIATSHPKSVVGVFLCGPRTLAKSLRKCCHRYSSLDPRKVQFYFNKENF

SEQ ID NO: 55285 - protein, 527 aa, Homo sapiens
  Payload ID: 10910
  Gene Symbol: NOX1
  Gene Name: NADPH oxidase 1
  ENSP ID: ENSP00000362051
MGNWVVNHWFSVLFLVVWLGLNVFLFVDAFLKYEKADKYYYTRKILGFCSRTLRKQLDHNLTFHKLVAYMICLHTAIHIIAHLFNFDCYSRSRQATDGSLASILSSLSHDEKKGGSWLNPIQSRNTTVEYVTFTSIAGLTGVIMTIALILMVTSATEFIRRSYFEVFWYTHHLFIFYILGLGIHGIGGIVRGQTEESMNESHPRKCAESFEMWDDRDSHCRRPKFEGHPPESWKWILAPVILYICERILRFYRSQQKVVITKVVMHPSKVLELQMNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKIYFYWICRETGAFSWFNNLLTSLEQEMEELGKVGFLNYRLFLTGWDSNIVGHAALNFDKATDIVTGLKQKTSFGRPMWDNEFSTIATSHPKSVVGVFLCGPRTLAKSLRKCCHRYSSLDPRKVQFYFNKENF

SEQ ID NO: 55286 - protein, 192 aa, Homo sapiens
  Payload ID: 10910
  Gene Symbol: NOX1
  Gene Name: NADPH oxidase 1
  ENSP ID: ENSP00000362055
MGNWVVNHWFSVLFLVVWLGLNVFLFVDAFLKYEKADKYYYTRKILGSTLACARASALCLNFNSTLILLPVCRNLLSFLRGTCSFCSRTLRKQLDHNLTFHKLVAYMICLHTAIHIIAHLFNFDCYSRSRQATDGSLASILSSLSHDEKKGGSWLNPIHPHITPTVYMFTVTFDMVLSSVNSNLFLFLLIKK

SEQ ID NO: 55287 - protein, 564 aa, Homo sapiens
  Payload ID: 10910
  Gene Symbol: NOX1
  Gene Name: NADPH oxidase 1
  Uniprot ID: Q9Y5S8
  ENSP ID: ENSP00000362057
MGNWVVNHWFSVLFLVVWLGLNVFLFVDAFLKYEKADKYYYTRKILGSTLACARASALCLNFNSTLILLPVCRNLLSFLRGTCSFCSRTLRKQLDHNLTFHKLVAYMICLHTAIHIIAHLFNFDCYSRSRQATDGSLASILSSLSHDEKKGGSWLNPIQSRNTTVEYVTFTSIAGLTGVIMTIALILMVTSATEFIRRSYFEVFWYTHHLFIFYILGLGIHGIGGIVRGQTEESMNESHPRKCAESFEMWDDRDSHCRRPKFEGHPPESWKWILAPVILYICERILRFYRSQQKVVITKVVMHPSKVLELQMNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKIYFYWICRETGAFSWFNNLLTSLEQEMEELGKVGFLNYRLFLTGWDSNIVGHAALNFDKATDIVTGLKQKTSFGRPMWDNEFSTIATSHPKSVVGVFLCGPRTLAKSLRKCCHRYSSLDPRKVQFYFNKENF

SEQ ID NO: 55288 - protein, 175 aa, Homo sapiens
  Payload ID: 10910
  Gene Symbol: NOX1
  Gene Name: NADPH oxidase 1
  ENSP ID: ENSP00000396992
  MOD_RES (1)..(1): Any amino acid
XFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKIYFYWICRETGAFSWFNNLLTSLEQEMEELGKSLRKCCHRYSSLDPRKVQFYFNKENF

SEQ ID NO: 55289 - protein, 568 aa, Homo sapiens
  Payload ID: 10911
  Gene Symbol: NOX3
  Gene Name: NADPH oxidase 3
  Uniprot ID: Q9HBY0
  ENSP ID: ENSP00000159060
MMGCWILNEGLSTILVLSWLGINFYLFIDTFYWYEEEESFHYTRVILGSTLAWARASALCLNFNCMLILIPVSRNLISFIRGTSICCRGPWRRQLDKNLRFHKLVAYGIAVNATIHIVAHFFNLERYHWSQSEEAQGLLAALSKLGNTPNESYLNPVRTFPTNTTTELLRTIAGVTGLVISLALVLIMTSSTEFIRQASYELFWYTHHVFIVFFLSLAIHGTGRIVRGQTQDSLSLHNITFCRDRYAEWQTVAQCPVPQFSGKEPSAWKWILGPVVLYACERIIRFWRFQQEVVITKVVSHPSGVLELHMKKRGFKMAPGQYILVQCPAISSLEWHPFTLTSAPQEDFFSVHIRAAGDWTAALLEAFGAEGQALQEPWSLPRLAVDGPFGTALTDVFHYPVCVCVAAGIGVTPFAALLKSIWYKCSEAQTPLKLSKVYFYWICRDARAFEWFADLLLSLETRMSEQGKTHFLSYHIFLTGWDENQALHIALHWDENTDVITGLKQKTFYGRPNWNNEFKQIAYNHPSSSIGVFFCGPKALSRTLQKMCHLYSSADPRGVHFYYNKESF

SEQ ID NO: 55290 - protein, 578 aa, Homo sapiens
  Payload ID: 10912
  Gene Symbol: NOX4
  Gene Name: NADPH oxidase 4
  Uniprot ID: Q9NPH5
  ENSP ID: ENSP00000263317
MAVSWRSWLANEGVKHLCLFIWLSMNVLLFWKTFLLYNQGPEYHYLHQMLGLGLCLSRASASVLNLNCSLILLPMCRTLLAYLRGSQKVPSRRTRRLLDKSRTFHITCGVTICIFSGVHVAAHLVNALNFSVNYSEDFVELNAARYRDEDPRKLLFTTVPGLTGVCMVVVLFLMITASTYAIRVSNYDIFWYTHNLFFVFYMLLTLHVSGGLLKYQTNLDTHPPGCISLNRTSSQNISLPEYFSEHFHEPFPEGFSKPAEFTQHKFVKICMEEPRFQANFPQTWLWISGPLCLYCAERLYRYIRSNKPVTIISVMSHPSDVMEIRMVKENFKARPGQYITLHCPSVSALENHPFTLTMCPTETKATFGVHLKIVGDWTERFRDLLLPPSSQDSEILPFIQSRNYPKLYIDGPFGSPFEESLNYEVSLCVAGGIGVTPFASILNTLLDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 55291 - protein, 554 aa, Homo sapiens
  Payload ID: 10912
  Gene Symbol: NOX4
  Gene Name: NADPH oxidase 4
  Uniprot ID: Q9NPH5
  ENSP ID: ENSP00000344747
MNVLLFWKTFLLYNQGPEYHYLHQMLGLGLCLSRASASVLNLNCSLILLPMCRTLLAYLRGSQKVPSRRTRRLLDKSRTFHITCGVTICIFSGVHVAAHLVNALNFSVNYSEDFVELNAARYRDEDPRKLLFTTVPGLTGVCMVVVLFLMITASTYAIRVSNYDIFWYTHNLFFVFYMLLTLHVSGGLLKYQTNLDTHPPGCISLNRTSSQNISLPEYFSEHFHEPFPEGFSKPAEFTQHKFVKICMEEPRFQANFPQTWLWISGPLCLYCAERLYRYIRSNKPVTIISVMSHPSDVMEIRMVKENFKARPGQYITLHCPSVSALENHPFTLTMCPTETKATFGVHLKIVGDWTERFRDLLLPPSSQDSEILPFIQSRNYPKLYIDGPFGSPFEESLNYEVSLCVAGGIGVTPFASILNTLLDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 55292 - protein, 271 aa, Homo sapiens
  Payload ID: 10912
  Gene Symbol: NOX4
  Gene Name: NADPH oxidase 4
  Uniprot ID: Q9NPH5
  ENSP ID: ENSP00000365146
MAVSWRSWLANEGVKHLCLFIWLSMNVLLFWKTFLLYNQGPEYHYLHQMLGCPTETKATFGVHLKIVGDWTERFRDLLLPPSSQDSEILPFIQSRNYPKLYIDGPFGSPFEESLNYEVSLCVAGGIGVTPFASILNTLLDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 55293 - protein, 54 aa, Homo sapiens
  Payload ID: 10912
  Gene Symbol: NOX4
  Gene Name: NADPH oxidase 4
  Uniprot ID: Q9NPH5
  ENSP ID: ENSP00000376961
MAVSWRSWLANEGVKHLCLFIWLSMNVLLFWKTFLLYNQGPEYHYLHQMLGELS

SEQ ID NO: 55294 - protein, 554 aa, Homo sapiens; identical to SEQ ID NO: 55291
  Payload ID: 10912
  Gene Symbol: NOX4
  Gene Name: NADPH oxidase 4
  Uniprot ID: Q9NPH5
  ENSP ID: ENSP00000412446

SEQ ID NO: 55295 - protein, 554 aa, Homo sapiens; identical to SEQ ID NO: 55291
  Payload ID: 10912
  Gene Symbol: NOX4
  Gene Name: NADPH oxidase 4
  Uniprot ID: Q9NPH5
  ENSP ID: ENSP00000433797

SEQ ID NO: 55296 - protein, 514 aa, Homo sapiens
  Payload ID: 10912
  Gene Symbol: NOX4
  Gene Name: NADPH oxidase 4
  Uniprot ID: Q9NPH5
  ENSP ID: ENSP00000434924
MNVLLFWKTFLLYNQGPEYHYLHQMLGLGLCLSRASASVLNLNCSLILLPMCRTLLAYLRGSQKVPSRRTRRLLDKSRTFHITCGVTICIFSGVHVAAHLVNALNFSVNYSEDFVELNAARYRDEDPRKLLFTTVPGLTGVCMVVVLFLMITASTYAIRVSNYDIFWYTHNLFFVFYMLLTLHVSGGLLKYQTNLDTHPPGCISLNRTSSQNISLPEYFSEHFHEPFPEGFSKPAEFTQHKFVKICMEEPRFQANFPQTWLWISGPLCLYCAERLYRYIRSNKPVTIISVMSHPSDVMEIRMVKENFKARPGQYITLHCPSVSALENHPFTLTMCPTETKATFGVHLKIVGDWTERFRDLLLPPSSQDSEILPFIQSRNYPKDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 55297 - protein, 231 aa, Homo sapiens
  Payload ID: 10912
  Gene Symbol: NOX4
  Gene Name: NADPH oxidase 4
  Uniprot ID: Q9NPH5
  ENSP ID: ENSP00000435039
MAVSWRSWLANEGVKHLCLFIWLSMNVLLFWKTFLLYNQGPEYHYLHQMLGCPTETKATFGVHLKIVGDWTERFRDLLLPPSSQDSEILPFIQSRNYPKDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 55298 - protein, 224 aa, Homo sapiens
  Payload ID: 10912
  Gene Symbol: NOX4
  Gene Name: NADPH oxidase 4
  Uniprot ID: Q9NPH5
  ENSP ID: ENSP00000435474
MAVSWRSWLANEGVKHLCLFIWLSMNVLLFWKTFLLYNQGPEYHYLHQMLGLGLCLSRASASVLNLNCSLILLPMCRTLLAYLRGSQKVPSRRTRRLLDKSRTFHITCGVTICIFSGVHVAAHLVNALNFSVNYSEDFVELNAARYRDEDPRKLLFTTVPGLTGVCMVVVLFLMITASTYAIRVSNYDIFWYTHNLFFVFYMLLTLHVSGVQLKPKQHLGFILK

SEQ ID NO: 55299 - protein, 391 aa, Homo sapiens
  Payload ID: 10912
  Gene Symbol: NOX4
  Gene Name: NADPH oxidase 4
  ENSP ID: ENSP00000436093
MVVVLFLMITASTYAIRVSNYDIFWYTHNLFFVFYMLLTLHVSGGLLKYQTNLDTHPPGCISLNRTSSQNISLPEYFSEHFHEPFPEGFSKPAEFTQHKFVKICMEEPRFQANFPQTWLWISGPLCLYCAERLYRYIRSNKPVTIISVMSHPSDVMEIRMVKENFKARPGQYITLHCPSVSALENHPFTLTMCPTETKATFGVHLKIVGDWTERFRDLLLPPSSQDSEILPFIQSRNYPKLYIDGPFGSPFEESLNYEVSLCVAGGIGVTPFASILNTLLDDWKPYKLRRLYFIWFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 55300 - protein, 342 aa, Homo sapiens
  Payload ID: 10912
  Gene Symbol: NOX4
  Gene Name: NADPH oxidase 4
  ENSP ID: ENSP00000436716
MAVSWRSWLANEGVKHLCLFIWLSMNVLLFWKTFLLYNQGPEYHYLHQMLGLGLCLSRASASVLNLNCSLILLPMCRTLLAYLRGSQKVPSRRTRRLLDKSRTFHITCGVTICIFSGVHVAAHLVNALNFSVNYSEDFVELNAARYRDEDPRKLLFTTVPGLTGVCMVVVLFLMITASTYAIRVSNYDIFWYTHNLFFVFYMLLTLHVSGDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 55301 - protein, 538 aa, Homo sapiens
  Payload ID: 10912
  Gene Symbol: NOX4
  Gene Name: NADPH oxidase 4
  Uniprot ID: Q9NPH5
  ENSP ID: ENSP00000436892
MAVSWRSWLANEGVKHLCLFIWLSMNVLLFWKTFLLYNQGPEYHYLHQMLGLGLCLSRASASVLNLNCSLILLPMCRTLLAYLRGSQKVPSRRTRRLLDKSRTFHITCGVTICIFSGVHVAAHLVNALNFSVNYSEDFVELNAARYRDEDPRKLLFTTVPGLTGVCMVVVLFLMITASTYAIRVSNYDIFWYTHNLFFVFYMLLTLHVSGGLLKYQTNLDTHPPGCISLNRTSSQNISLPEYFSEHFHEPFPEGFSKPAEFTQHKFVKICMEEPRFQANFPQTWLWISGPLCLYCAERLYRYIRSNKPVTIISVMSHPSDVMEIRMVKENFKARPGQYITLHCPSVSALENHPFTLTMCPTETKATFGVHLKIVGDWTERFRDLLLPPSSQDSEILPFIQSRNYPKDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 55302 - protein, 553 aa, Homo sapiens
  Payload ID: 10912
  Gene Symbol: NOX4
  Gene Name: NADPH oxidase 4
  ENSP ID: ENSP00000436970
MLSAVTDLGSIESTVSKNLPVVSIHQLGLCLSRASASVLNLNCSLILLPMCRTLLAYLRGSQKVPSRRTRRLLDKSRTFHITCGVTICIFSGVHVAAHLVNALNFSVNYSEDFVELNAARYRDEDPRKLLFTTVPGLTGVCMVVVLFLMITASTYAIRVSNYDIFWYTHNLFFVFYMLLTLHVSGGLLKYQTNLDTHPPGCISLNRTSSQNISLPEYFSEHFHEPFPEGFSKPAEFTQHKFVKICMEEPRFQANFPQTWLWISGPLCLYCAERLYRYIRSNKPVTIISVMSHPSDVMEIRMVKENFKARPGQYITLHCPSVSALENHPFTLTMCPTETKATFGVHLKIVGDWTERFRDLLLPPSSQDSEILPFIQSRNYPKLYIDGPFGSPFEESLNYEVSLCVAGGIGVTPFASILNTLLDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 55303 - protein, 483 aa, Homo sapiens
  Payload ID: 10913
  Gene Symbol: NOXA1
  Gene Name: NADPH oxidase activator 1
  Uniprot ID: Q86UR1
  ENSP ID: ENSP00000342848
MASLGDLVRAWHLGAQAVDRGDWARALHLFSGVPAPPARLCFNAGCVHLLAGDPEAALRAFDQAVTKDTCMAVGFFQRGVANFQLARFQEALSDFWLALEQLRGHAAIDYTQLGLRFKLQAWEVLHNVASAQCQLGLWTEAASSLREAMSKWPEGSLNGLDSALDQVQRRGSLPPRQVPRGEVFRPHRWHLKHLEPVDFLGKAKVVASAIPDDQGWGVRPQQPQGPGANHDARSLIMDSPRAGTHQGPLDAETEVGADRCTSTAYQEQRPQVEQVGKQAPLSPGLPAMGGPGPGPCEDPAGAGGAGAGGSEPLVTVTVQCAFTVALRARRGADLSSLRALLGQALPHQAQLGQLSYLAPGEDGHWVPIPEEESLQRAWQDAAACPRGLQLQCRGAGGRPVLYQVVAQHSYSAQGPEDLGFRQGDTVDVLCEEPDVPLAVDQAWLEGHCDGRIGIFPKCFVVPAGPRMSGAPGRLPRSQQGDQP

SEQ ID NO: 55304 - protein, 427 aa, Homo sapiens
  Payload ID: 10913
  Gene Symbol: NOXA1
  Gene Name: NADPH oxidase activator 1
  Uniprot ID: Q86UR1
  ENSP ID: ENSP00000376562
MASLGDLVRAWHLGAQAVDRGDWARALHLFSGVPAPPARLCFNAGCVHLLAGDPEAALRAFDQAVTKDTCMAVGFFQRGVANFQLARFQEALSDFWLALEQLRGHAAIDYTQLGLRFKLQAWEVLHNVASAQCQLGLWTEAASSLREAMSKWPEGSLNGLDSALDQVQGPGANHDARSLIMDSPRAGTHQGPLDAETEVGADRCTSTAYQEQRPQVEQVGKQAPLSPGLPAMGGPGPGPCEDPAGAGGAGAGGSEPLVTVTVQCAFTVALRARRGADLSSLRALLGQALPHQAQLGQLSYLAPGEDGHWVPIPEEESLQRAWQDAAACPRGLQLQCRGAGGRPVLYQVVAQHSYSAQGPEDLGFRQGDTVDVLCEEPDVPLAVDQAWLEGHCDGRIGIFPKCFVVPAGPRMSGAPGRLPRSQQGDQP

SEQ ID NO: 55305 - protein, 370 aa, Homo sapiens
  Payload ID: 10914
  Gene Symbol: NOXO1
  Gene Name: NADPH oxidase organizer 1
  Uniprot ID: Q8NFA2
  ENSP ID: ENSP00000346195
MAGPRYPVSVQGAALVQIKRLQTFAFSVRWSDGSDTFVRRSWDEFRQLKTLKETFPVEAGLLRRSDRVLPKLLDAPLLGRVGRTSRGLARLQLLETYSRRLLATAERVARSPTITGFFAPQPLDLEPALPPGSRVILPTPEEQPLSRAAGRLSIHSLEAQSLRCLQPFCTQDTRDRPFQAQAQESLDVLLRHPSGWWLVENEDRQTAWFPAPYLEEAAPGQGREGGPSLGSSGPQFCASRAYESSRADELSVPAGARVRVLETSDRGWWLCRYGDRAGLLPAVLLRPEGLGALLSGTGFRGGDDPAGEARGFPEPSQATAPPPTVPTRPSPGAIQSRCCTVTRRALERRPRRQGRPRGCVDSVPHPTTEQ

SEQ ID NO: 55306 - protein, 371 aa, Homo sapiens
  Payload ID: 10914
  Gene Symbol: NOXO1
  Gene Name: NADPH oxidase organizer 1
  Uniprot ID: Q8NFA2
  ENSP ID: ENSP00000348435
MAGPRYPVSVQGAALVQIKRLQTFAFSVRWSDGSDTFVRRSWDEFRQLKKTLKETFPVEAGLLRRSDRVLPKLLDAPLLGRVGRTSRGLARLQLLETYSRRLLATAERVARSPTITGFFAPQPLDLEPALPPGSRVILPTPEEQPLSRAAGRLSIHSLEAQSLRCLQPFCTQDTRDRPFQAQAQESLDVLLRHPSGWWLVENEDRQTAWFPAPYLEEAAPGQGREGGPSLGSSGPQFCASRAYESSRADELSVPAGARVRVLETSDRGWWLCRYGDRAGLLPAVLLRPEGLGALLSGTGFRGGDDPAGEARGFPEPSQATAPPPTVPTRPSPGAIQSRCCTVTRRALERRPRRQGRPRGCVDSVPHPTTEQ

SEQ ID NO: 55307 - protein, 376 aa, Homo sapiens
  Payload ID: 10914
  Gene Symbol: NOXO1
  Gene Name: NADPH oxidase organizer 1
  Uniprot ID: Q8NFA2
  ENSP ID: ENSP00000380450
MAGPRYPVSVQGAALVQIKRLQTFAFSVRWSDGSDTFVRRSWDEFRQLKKTLKETFPVEAGLLRRSDRVLPKLLGQASLDAPLLGRVGRTSRGLARLQLLETYSRRLLATAERVARSPTITGFFAPQPLDLEPALPPGSRVILPTPEEQPLSRAAGRLSIHSLEAQSLRCLQPFCTQDTRDRPFQAQAQESLDVLLRHPSGWWLVENEDRQTAWFPAPYLEEAAPGQGREGGPSLGSSGPQFCASRAYESSRADELSVPAGARVRVLETSDRGWWLCRYGDRAGLLPAVLLRPEGLGALLSGTGFRGGDDPAGEARGFPEPSQATAPPPTVPTRPSPGAIQSRCCTVTRRALERRPRRQGRPRGCVDSVPHPTTEQ

SEQ ID NO: 55308 - protein, 76 aa, Homo sapiens
  Payload ID: 10914
  Gene Symbol: NOXO1
  Gene Name: NADPH oxidase organizer 1
  ENSP ID: ENSP00000454644
MAGPRYPVSVQGAALVQIKRLQTFAFSVRWSDGSDTFVRRSWDEFRQLKKTLKETFPVEAGLLRRSDRVLPKLLDA

SEQ ID NO: 55309 - protein, 375 aa, Homo sapiens
  Payload ID: 10914
  Gene Symbol: NOXO1
  Gene Name: NADPH oxidase organizer 1
  Uniprot ID: Q8NFA2
  ENSP ID: ENSP00000456800
MAGPRYPVSVQGAALVQIKRLQTFAFSVRWSDGSDTFVRRSWDEFRQLKTLKETFPVEAGLLRRSDRVLPKLLGQASLDAPLLGRVGRTSRGLARLQLLETYSRRLLATAERVARSPTITGFFAPQPLDLEPALPPGSRVILPTPEEQPLSRAAGRLSIHSLEAQSLRCLQPFCTQDTRDRPFQAQAQESLDVLLRHPSGWWLVENEDRQTAWFPAPYLEEAAPGQGREGGPSLGSSGPQFCASRAYESSRADELSVPAGARVRVLETSDRGWWLCRYGDRAGLLPAVLLRPEGLGALLSGTGFRGGDDPAGEARGFPEPSQATAPPPTVPTRPSPGAIQSRCCTVTRRALERRPRRQGRPRGCVDSVPHPTTEQ

SEQ ID NO: 55310 - protein, 765 aa, Homo sapiens
  Payload ID: 10915
  Gene Symbol: NOX5
  Gene Name: NADPH oxidase, EF-hand calcium binding domain 5
  Uniprot ID: Q96PH1
  ENSP ID: ENSP00000373518
MNTSGDPAQTGPEGCRGTMSAEEDARWLRWVTQQFKTIAGEDGEISLQEFKAALHVKESFFAERFFALFDSDRSGTITLQELQEALTLLIHGSPMDKLKFLFQVYDIDVCARQGASAGTEWGAGAGPHWASSPLGTGSGSIDPDELRTVLQSCLRESAISLPDEKLDQLTLALFESADADGNGAITFEELRDELQRFPGVMENLTISAAHWLTAPAPRPRPRRPRQLTRAYWHNHRSQLFCLATYAGLHVLLFGLAASAHRDLGASVMVAKGCGQCLNFDCSFIAVLMLRRCLTWLRATWLAQVLPLDQNIQFHQLMGYVVVGLSLVHTVAHTVNFVLQAQAEASPFQFWELLLTTRPGIGWVHGSASPTGVALLLLLLLMFICSSSCIRRSGHFEVFYWTHLSYLLVWLLLIFHGPNFWKWLLVPGILFFLEKAIGLAVSRMAAVCIMEVNLLPSKVTHLLIKRPPFFHYRPGDYLYLNIPTIARYEWHPFTISSAPEQKDTIWLHIRSQGQWTNRLYESFKASDPLGRGSKRLSRSVTMRKSQRSSKGSEILLEKHKFCNIKCYIDGPYGTPTRRIFASEHAVLIGAGIGITPFASILQSIMYRHQKRKHTCPSCQHSWIEGVQDNMKLHKVDFIWINRDQRSFEWFVSLLTKLEMDQAEEAQYGRFLELHMYMTSALGKNDMKAIGLQMALDLLANKEKKDSITGLQTRTQPGRPDWSKVFQKVAAEKKGKVQVFFCGSPALAKVLKGHCEKFGFRFFQENF

SEQ ID NO: 55311 - protein, 719 aa, Homo sapiens
  Payload ID: 10915
  Gene Symbol: NOX5
  Gene Name: NADPH oxidase, EF-hand calcium binding domain 5
  Uniprot ID: Q96PH1
  ENSP ID: ENSP00000410887
MSAEEDARWLRWVTQQFKTIAGEDGEISLQEFKAALHVKESFFAERFFALFDSDRSGTITLQELQEALTLLIHGSPMDKLKFLFQVYDIDGSGSIDPDELRTVLQSCLRESAISLPDEKLDQLTLALFESADADGNGAITFEELRDELQRFPGVMENLTISAAHWLTAPAPRPRPRRPRQLTRAYWHNHRSQLFCLATYAGLHVLLFGLAASAHRDLGASVMVAKGCGQCLNFDCSFIAVLMLRRCLTWLRATWLAQVLPLDQNIQFHQLMGYVVVGLSLVHTVAHTVNFVLQAQAEASPFQFWELLLTTRPGIGWVHGSASPTGVALLLLLLLMFICSSSCIRRSGHFEVFYWTHLSYLLVWLLLIFHGPNFWKWLLVPGILFFLEKAIGLAVSRMAAVCIMEVNLLPSKVTHLLIKRPPFFHYRPGDYLYLNIPTIARYEWHPFTISSAPEQKDTIWLHIRSQGQWTNRLYESFKASDPLGRGSKRLSRSVTMRKSQRSSKGSEILLEKHKFCNIKCYIDGPYGTPTRRIFASEHAVLIGAGIGITPFASILQSIMYRHQKRKHTCPSCQHSWIEGVQDNMKLHKVDFIWINRDQRSFEWFVSLLTKLEMDQAEEAQYGRFLELHMYMTSALGKNDMKAIGLQMALDLLANKEKKDSITGLQTRTQPGRPDWSKVFQKVAAEKKGKVQVFFCGSPALAKVLKGHCEKFGFRFFQENF

SEQ ID NO: 55312 - protein, 730 aa, Homo sapiens
  Payload ID: 10915
  Gene Symbol: NOX5
  Gene Name: NADPH oxidase, EF-hand calcium binding domain 5
  Uniprot ID: Q96PH1
  ENSP ID: ENSP00000416828
MAFVCAGLSDTMSAEEDARWLRWVTQQFKTIAGEDGEISLQEFKAALHVKESFFAERFFALFDSDRSGTITLQELQEALTLLIHGSPMDKLKFLFQVYDIDGSGSIDPDELRTVLQSCLRESAISLPDEKLDQLTLALFESADADGNGAITFEELRDELQRFPGVMENLTISAAHWLTAPAPRPRPRRPRQLTRAYWHNHRSQLFCLATYAGLHVLLFGLAASAHRDLGASVMVAKGCGQCLNFDCSFIAVLMLRRCLTWLRATWLAQVLPLDQNIQFHQLMGYVVVGLSLVHTVAHTVNFVLQAQAEASPFQFWELLLTTRPGIGWVHGSASPTGVALLLLLLLMFICSSSCIRRSGHFEVFYWTHLSYLLVWLLLIFHGPNFWKWLLVPGILFFLEKAIGLAVSRMAAVCIMEVNLLPSKVTHLLIKRPPFFHYRPGDYLYLNIPTIARYEWHPFTISSAPEQKDTIWLHIRSQGQWTNRLYESFKASDPLGRGSKRLSRSVTMRKSQRSSKGSEILLEKHKFCNIKCYIDGPYGTPTRRIFASEHAVLIGAGIGITPFASILQSIMYRHQKRKHTCPSCQHSWIEGVQDNMKLHKVDFIWINRDQRSFEWFVSLLTKLEMDQAEEAQYGRFLELHMYMTSALGKNDMKAIGLQMALDLLANKEKKDSITGLQTRTQPGRPDWSKVFQKVAAEKKGKVQVFFCGSPALAKVLKGHCEKFGFRFFQENF

SEQ ID NO: 55313 - protein, 737 aa, Homo sapiens
  Payload ID: 10915
  Gene Symbol: NOX5
  Gene Name: NADPH oxidase, EF-hand calcium binding domain 5
  Uniprot ID: Q96PH1
  ENSP ID: ENSP00000432440
MNTSGDPAQTGPEGCRGTMSAEEDARWLRWVTQQFKTIAGEDGEISLQEFKAALHVKESFFAERFFALFDSDRSGTITLQELQEALTLLIHGSPMDKLKFLFQVYDIDGSGSIDPDELRTVLQSCLRESAISLPDEKLDQLTLALFESADADGNGAITFEELRDELQRFPGVMENLTISAAHWLTAPAPRPRPRRPRQLTRAYWHNHRSQLFCLATYAGLHVLLFGLAASAHRDLGASVMVAKGCGQCLNFDCSFIAVLMLRRCLTWLRATWLAQVLPLDQNIQFHQLMGYVVVGLSLVHTVAHTVNFVLQAQAEASPFQFWELLLTTRPGIGWVHGSASPTGVALLLLLLLMFICSSSCIRRSGHFEVFYWTHLSYLLVWLLLIFHGPNFWKWLLVPGILFFLEKAIGLAVSRMAAVCIMEVNLLPSKVTHLLIKRPPFFHYRPGDYLYLNIPTIARYEWHPFTISSAPEQKDTIWLHIRSQGQWTNRLYESFKASDPLGRGSKRLSRSVTMRKSQRSSKGSEILLEKHKFCNIKCYIDGPYGTPTRRIFASEHAVLIGAGIGITPFASILQSIMYRHQKRKHTCPSCQHSWIEGVQDNMKLHKVDFIWINRDQRSFEWFVSLLTKLEMDQAEEAQYGRFLELHMYMTSALGKNDMKAIGLQMALDLLANKEKKDSITGLQTRTQPGRPDWSKVFQKVAAEKKGKVQVFFCGSPALAKVLKGHCEKFGFRFFQENF

SEQ ID NO: 55314 - protein, 747 aa, Homo sapiens
  Payload ID: 10915
  Gene Symbol: NOX5
  Gene Name: NADPH oxidase, EF-hand calcium binding domain 5
  Uniprot ID: Q96PH1
  ENSP ID: ENSP00000454143
MSAEEDARWLRWVTQQFKTIAGEDGEISLQEFKAALHVKESFFAERFFALFDSDRSGTITLQELQEALTLLIHGSPMDKLKFLFQVYDIDVCARQGASAGTEWGAGAGPHWASSPLGTGSGSIDPDELRTVLQSCLRESAISLPDEKLDQLTLALFESADADGNGAITFEELRDELQRFPGVMENLTISAAHWLTAPAPRPRPRRPRQLTRAYWHNHRSQLFCLATYAGLHVLLFGLAASAHRDLGASVMVAKGCGQCLNFDCSFIAVLMLRRCLTWLRATWLAQVLPLDQNIQFHQLMGYVVVGLSLVHTVAHTVNFVLQAQAEASPFQFWELLLTTRPGIGWVHGSASPTGVALLLLLLLMFICSSSCIRRSGHFEVFYWTHLSYLLVWLLLIFHGPNFWKWLLVPGILFFLEKAIGLAVSRMAAVCIMEVNLLPSKVTHLLIKRPPFFHYRPGDYLYLNIPTIARYEWHPFTISSAPEQKDTIWLHIRSQGQWTNRLYESFKASDPLGRGSKRLSRSVTMRKSQRSSKGSEILLEKHKFCNIKCYIDGPYGTPTRRIFASEHAVLIGAGIGITPFASILQSIMYRHQKRKHTCPSCQHSWIEGVQDNMKLHKVDFIWINRDQRSFEWFVSLLTKLEMDQAEEAQYGRFLELHMYMTSALGKNDMKAIGLQMALDLLANKEKKDSITGLQTRTQPGRPDWSKVFQKVAAEKKGKVQVFFCGSPALAKVLKGHCEKFGFRFFQENF

SEQ ID NO: 55315 - protein, 294 aa, Homo sapiens
  Payload ID: 10915
  Gene Symbol: NOX5
  Gene Name: NADPH oxidase, EF-hand calcium binding domain 5
  ENSP ID: ENSP00000455703
MENLTISAAHWLTAPAPRPRPRRPRQLTRAYWHNHRSQLFCLATYAGLHVLLFGLAASAHRDLGASVMVAKGCGQCLNFDCSFIAVLMLRRCLTWLRATWLAQVLPLDQNIQFHQLMGYVVVGLSLVHTVAHTVNFVLQAQAEASPFQFWELLLTTRPGIGWVHGSASPTGVALLLLLLLMFICSSSCIRRSGHFEVFYWTHLSYLLVWLLLIFHGPNFWKWLLVPGILFFLEKAIGLAVSRMAAVCIMEVNLLPSKTLSGCTFGPKASGQTGCMSPSRHQTHWAVVLRGCRGV

SEQ ID NO: 55316 - protein, 470 aa, Homo sapiens
  Payload ID: 10916
  Gene Symbol: NKD1
  Gene Name: naked cuticle homolog 1 (Drosophila)
  Uniprot ID: Q969G9
  ENSP ID: ENSP00000268459
MGKLHSKPAAVCKRRESPEGDSFAVSAAWARKGIEEWIGRQRCPGGVSGPRQLRLAGTIGRSTRELVGDVLRDTLSEEEEDDFRLEVALPPEKTDGLGSGDEKKMERVSEPCPGSKKQLKFEELQCDVSMEEDSRQEWTFTLYDFDNNGKVTREDITSLLHTIYEVVDSSVNHSPTSSKMLRVKLTVAPDGSQSKRSVLVNQADLQSARPRAETKPTEDLRSWEKKQRAPLRFQGDSRLEQSGCYHHCVDENIERRNHYLDLAGIENYTSQFGPGSPSVAQKSELPPRTSNPTRSRSHEPEAIHIPHRKPQGVDPASFHFLDTPIAKVSELQQRLRGTQDGSKHFVRSPKAQGKSVGVGHVARGARNKPPLGPAIPAVSPSAHLAASPALLPSLAPLGHKKHKHRAKESQQGCRGLQAPLASGGPVLGREHLRELPALVVYESQAGQPVQRHEHHHHHEHHHHYHHFYQT

SEQ ID NO: 55317 - protein, 311 aa, Homo sapiens
  Payload ID: 10917
  Gene Symbol: NKD2
  Gene Name: naked cuticle homolog 2 (Drosophila)
  Uniprot ID: Q969F2
  ENSP ID: ENSP00000274150
MGKLQSKHAAAARKRRESPEGDSFVASAYASGRKGAEEAERRARDKQELPNGDPKEGPFREDQCPLQVALPAEKAEGREHPGQLLSADDGERAANREGPRGPGGQRLNIDALQCDVSVEEDDRQEWTFTLYDFDNCGKVTREDMSSLMHTIYEVVDASVNHSSGSSKTLRVKLTVSPEPSSKRKEGPPAGQDREPTRCRMEGELAEEPRVADRRLSAHVRRPSTDPQPCSERGPYCVDENTERRNHYLDLAGIENYTSRFGPGSQLCEKRSSAPRTHSGDKARGVGLCRELWSQAGHPQWPGPFPSGLVAV

SEQ ID NO: 55318 - protein, 451 aa, Homo sapiens
  Payload ID: 10917
  Gene Symbol: NKD2
  Gene Name: naked cuticle homolog 2 (Drosophila)
  Uniprot ID: Q969F2
  ENSP ID: ENSP00000296849
MGKLQSKHAAAARKRRESPEGDSFVASAYASGRKGAEEAERRARDKQELPNGDPKEGPFREDQCPLQVALPAEKAEGREHPGQLLSADDGERAANREGPRGPGGQRLNIDALQCDVSVEEDDRQEWTFTLYDFDNCGKVTREDMSSLMHTIYEVVDASVNHSSGSSKTLRVKLTVSPEPSSKRKEGPPAGQDREPTRCRMEGELAEEPRVADRRLSAHVRRPSTDPQPCSERGPYCVDENTERRNHYLDLAGIENYTSRFGPGSPPVQAKQEPQGRASHLQARSRSQEPDTHAVHHRRSQVLVEHVVPASEPAARALDTQPRPKGPEKQFLKSPKGSGKPPGVPASSKSGKAFSYYLPAVLPPQAPQDGHHLPQPPPPPYGHKRYRQKGREGHSPLKAPHAQPATVEHEVVRDLPPTPAGEGYAVPVIQRHEHHHHHEHHHHHHHHHFHPS

SEQ ID NO: 55319 - protein, 451 aa, Homo sapiens; identical to SEQ ID NO: 55318
  Payload ID: 10917
  Gene Symbol: NKD2
  Gene Name: naked cuticle homolog 2 (Drosophila)
  Uniprot ID: Q969F2
  ENSP ID: ENSP00000479003

SEQ ID NO: 55320 - protein, 311 aa, Homo sapiens; identical to SEQ ID NO: 55317
  Payload ID: 10917
  Gene Symbol: NKD2
  Gene Name: naked cuticle homolog 2 (Drosophila)
  Uniprot ID: Q969F2
  ENSP ID: ENSP00000482896

SEQ ID NO: 55321 - protein, 1630 aa, Homo sapiens
  Payload ID: 10918
  Gene Symbol: NHS
  Gene Name: Nance-Horan syndrome (congenital cataracts and dental anomalies)
  Uniprot ID: Q6T4R5
  ENSP ID: ENSP00000369400
MPFAKRIVEPQWLCRQRRPAPGPAVDASGGSAEPPPPLQPPGRRDLDEVEAPGPEEPARAVPAPSGLPPPPPPLPAPADQTQPPHGEASVAGEESTAGIPEAAPAAGEASSAAAAAAVLLMLDLCAVSNAALARVLRQLSDVARHACSLFQELESDIQLTHRRVWALQGKLGGVQRVLSTLDPKQEAVPVSNLDIESKLSVYYRAPWHQQRNIFLPATRPPCVEELHRHARQSLQALRREHRSRSDRREQRAAAPLSIAAPPLPAYPPAHSQRRREFKDRHFLTSHPPEDEDTDVMLGQRPKNPIHNIPSTLDKQTNWSKALPLPTPEEKMKQDAQVISSCIIPINVTGVGFDREASIRCSLVHSQSVLQRRRKLRRRKTISGIPRRVQQEIDSDESPVARERNVIVHTNPDPSNTVNRISGTRDSECQTEDILIAAPSRRRIRAQRGQSIAASLSHSAGNISALADKGDTMFTPAVSSRTRSRSLPREGNRGGDAEPKVGAKPSAYEEGESFVGDHERTPNDFSEAPSSPSAQDHQPTLGLACSQHLHSPQHKLSERGRSRLSRMAADSGSCDISSNSDTFGSPIHCISTAGVLLSSHMDQKDDHQSSSGNWSGSSSTCPSQTSETIPPAASPPLTGSSHCDSELSLNTAPHANEDASVFVTEQYNDHLDKVRGHRANSFTSTVADLLDDPNNSNTSDSEWNYLHHHHDASCRQDFSPERPKADSLGCPSFTSMATYDSFLEKSPSDKADTSSHFSVDTEGYYTSMHFDCGLKGNKSYVCHYAALGPENGQGVGASPGLPDCAWQDYLDHKRQGRPSISFRKPKAKPTPPKRSSSLRKSDGNADISEKKEPKISSGQHLPHSSREMKLPLDFANTPSRMENANLPTKQEPSWINQSEQGIKEPQLDASDIPPFKDEVAESTHYADLWLLNDLKTNDPYRSLSNSSTATGTTVIECIKSPESSESQTSQSESRATTPSLPSVDNEFKLASPEKLAGLASPSSGYSSQSETPTSSFPTAFFSGPLSPGGSKRKPKVPERKSSLQQPSLKDGTISLSKDLELPIIPPTHLDLSALHNVLNKPFHHRHPLHVFTHNKQNTVGETLRSNPPPSLAITPTILKSVNLRSINKSEEVKQKEENNTDLPYLEESTLTTAALSPSKIRPHTANKSVSRQYSTEDTILSFLDSSAVEMGPDKLHLEKNSTFDVKNRCDPETITSAGSSLLDSNVTKDQVRTETEPIPENTPTKNCAFPTEGFQRVSAARPNDLDGKIIQYGPGPDETLEQVQKAPSAGLEEVAQPESVDVITSQSDSPTRATDVSNQFKHQFVMSRHHDKVPGTISYESEITSVNSFPEKCSKQENIASGISAKSASDNSKAEETQGNVDEASLKESSPSDDSIISPLSEDSQAEAEGVFVSPNKPRTTEDLFAVIHRSKRKVLGRKDSGDMSVRSKSRAPLSSSSSSASSITSPSSNVTTPNSQRSPGLIYRNAKKSNTSNEEFKLLLLKKGSRSDSSYRMSATEILKSPILPKPPGELTAESPQSTDDAHQGSQGAEALSPLSPCSPRVNAEGFSSKSFATSASARVGRSRAPPAASSSRYSVRCRLYNTPMQAISEGETENSDGSPHDDRSSQSST

SEQ ID NO: 55322 - protein, 1474 aa, Homo sapiens
  Payload ID: 10918
  Gene Symbol: NHS
  Gene Name: Nance-Horan syndrome (congenital cataracts and dental anomalies)
  Uniprot ID: Q6T4R5
  ENSP ID: ENSP00000381170
MALACCMPKNAAVSNLDIESKLSVYYRAPWHQQRNIFLPATRPPCVEELHRHARQSLQALRREHRSRSDRREQRAAAPLSIAAPPLPAYPPAHSQRRREFKDRHFLTFNSTRSPSPTECCHMTPWSRKSHPPEDEDTDVMLGQRPKNPIHNIPSTLDKQTNWSKALPLPTPEEKMKQDAQVISSCIIPINVTGVGFDREASIRCSLVHSQSVLQRRRKLRRRKTISGIPRRVQQEIDSDESPVARERNVIVHTNPDPSNTVNRISGTRDSECQTEDILIAAPSRRRIRAQRGQSIAASLSHSAGNISALADKGDTMFTPAVSSRTRSRSLPREGNRGGDAEPKVGAKPSAYEEGESFVGDHERTPNDFSEAPSSPSAQDHQPTLGLACSQHLHSPQHKLSERGRSRLSRMAADSGSCDISSNSDTFGSPIHCISTAGVLLSSHMDQKDDHQSSSGNWSGSSSTCPSQTSETIPPAASPPLTGSSHCDSELSLNTAPHANEDASVFVTEQYNDHLDKVRGHRANSFTSTVADLLDDPNNSNTSDSEWNYLHHHHDASCRQDFSPERPKADSLGCPSFTSMATYDSFLEKSPSDKADTSSHFSVDTEGYYTSMHFDCGLKGNKSYVCHYAALGPENGQGVGASPGLPDCAWQDYLDHKRQGRPSISFRKPKAKPTPPKRSSSLRKSDGNADISEKKEPKISSGQHLPHSSREMKLPLDFANTPSRMENANLPTKQEPSWINQSEQGIKEPQLDASDIPPFKDEVAESTHYADLWLLNDLKTNDPYRSLSNSSTATGTTVIECIKSPESSESQTSQSESRATTPSLPSVDNEFKLASPEKLAGLASPSSGYSSQSETPTSSFPTAFFSGPLSPGGSKRKPKVPERKSSLQQPSLKDGTISLSKDLELPIIPPTHLDLSALHNVLNKPFHHRHPLHVFTHNKQNTVGETLRSNPPPSLAITPTILKSVNLRSINKSEEVKQKEENNTDLPYLEESTLTTAALSPSKIRPHTANKSVSRQYSTEDTILSFLDSSAVEMGPDKLHLEKNSTFDVKNRCDPETITSAGSSLLDSNVTKDQVRTETEPIPENTPTKNCAFPTEGFQRVSAARPNDLDGKIIQYGPGPDETLEQVQKAPSAGLEEVAQPESVDVITSQSDSPTRATDVSNQFKHQFVMSRHHDKVPGTISYESEITSVNSFPEKCSKQENIASGISAKSASDNSKAEETQGNVDEASLKESSPSDDSIISPLSEDSQAEAEGVFVSPNKPRTTEDLFAVIHRSKRKVLGRKDSGDMSVRSKSRAPLSSSSSSASSITSPSSNVTTPNSQRSPGLIYRNAKKSNTSNEEFKLLLLKKGSRSDSSYRMSATEILKSPILPKPPGELTAESPQSTDDAHQGSQGAEALSPLSPCSPRVNAEGFSSKSFATSASARVGRSRAPPAASSSRYSVRCRLYNTPMQAISEGETENSDGSPHDDRSSQSST

SEQ ID NO: 55323 - protein, 1447 aa, Homo sapiens
  Payload ID: 10918
  Gene Symbol: NHS
  Gene Name: Nance-Horan syndrome (congenital cataracts and dental anomalies)
  ENSP ID: ENSP00000478433
MPKNAAVSNLDIESKLSVYYRAPWHQQRNIFLPATRPPCVEELHRHARQSLQALRREHRSRSDRREQRAAAPLSIAAPPLPAYPPAHSQRRREFKDRHFLTSHPPEDEDTDVMLGQRPKNPIHNIPSTLDKQTNWSKALPLPTPEEKMKQDAQVISSCIIPINVTGVGFDREASIRCSLVHSQSVLQRRRKLRRRKTISGIPRRVQQEIDSDESPVARERNVIVHTNPDPSNTVNRISGTRDSECQTEDILIAAPSRRRIRAQRGQSIAASLSHSAGNISALADKGDTMFTPAVSSRTRSRSLPREGNRGGDAEPKVGAKPSAYEEGESFVGDHERTPNDFSEAPSSPSAQDHQPTLGLACSQHLHSPQHKLSERGRSRLSRMAADSGSCDISSNSDTFGSPIHCISTAGVLLSSHMDQKDDHQSSSGNWSGSSSTCPSQTSETIPPAASPPLTGSSHCDSELSLNTAPHANEDASVFVTEQYNDHLDKVRGHRANSFTSTVADLLDDPNNSNTSDSEWNYLHHHHDASCRQDFSPERPKADSLGCPSFTSMATYDSFLEKSPSDKADTSSHFSVDTEGYYTSMHFDCGLKGNKSYVCHYAALGPENGQGVGASPGLPDCAWQDYLDHKRQGRPSISFRKPKAKPTPPKRSSSLRKSDGNADISEKKEPKISSGQHLPHSSREMKLPLDFANTPSRMENANLPTKQEPSWINQSEQGIKEPQLDASDIPPFKDEVAESTHYADLWLLNDLKTNDPYRSLSNSSTATGTTVIECIKSPESSESQTSQSESRATTPSLPSVDNEFKLASPEKLAGLASPSSGYSSQSETPTSSFPTAFFSGPLSPGGSKRKPKVPERKSSLQQPSLKDGTISLSKDLELPIIPPTHLDLSALHNVLNKPFHHRHPLHVFTHNKQNTVGETLRSNPPPSLAITPTILKSVNLRSINKSEEVKQKEENNTDLPYLEESTLTTAALSPSKIRPHTANKSVSRQYSTEDTILSFLDSSAVEMGPDKLHLEKNSTFDVKNRCDPETITSAGSSLLDSNVTKDQVRTETEPIPENTPTKNCAFPTEGFQRVSAARPNDLDGKIIQYGPGPDETLEQVQKAPSAGLEEVAQPESVDVITSQSDSPTRATDVSNQFKHQFVMSRHHDKVPGTISYESEITSVNSFPEKCSKQENIASGISAKSASDNSKAEETQGNVDEASLKESSPSDDSIISPLSEDSQAEAEGVFVSPNKPRTTEDLFAVIHRSKRKVLGRKDSGDMSVRSKSRAPLSSSSSSASSITSPSSNVTTPNSQRSPGLIYRNAKKSNTSNEEFKLLLLKKGSRSDSSYRMSATEILKSPILPKPPGELTAESPQSTDDAHQGSQGAEALSPLSPCSPRVNAEGFSSKSFATSASARVGRSRAPPAASSSRYSVRCRLYNTPMQAISEGETENSDGSPHDDRSSQSST

SEQ ID NO: 55324 - protein, 1471 aa, Homo sapiens
  Payload ID: 10918
  Gene Symbol: NHS
  Gene Name: Nance-Horan syndrome (congenital cataracts and dental anomalies)
  ENSP ID: ENSP00000480113
MDNALFLAAVSNLDIESKLSVYYRAPWHQQRNIFLPATRPPCVEELHRHARQSLQALRREHRSRSDRREQRAAAPLSIAAPPLPAYPPAHSQRRREFKDRHFLTFNSTRSPSPTECCHMTPWSRKSHPPEDEDTDVMLGQRPKNPIHNIPSTLDKQTNWSKALPLPTPEEKMKQDAQVISSCIIPINVTGVGFDREASIRCSLVHSQSVLQRRRKLRRRKTISGIPRRVQQEIDSDESPVARERNVIVHTNPDPSNTVNRISGTRDSECQTEDILIAAPSRRRIRAQRGQSIAASLSHSAGNISALADKGDTMFTPAVSSRTRSRSLPREGNRGGDAEPKVGAKPSAYEEGESFVGDHERTPNDFSEAPSSPSAQDHQPTLGLACSQHLHSPQHKLSERGRSRLSRMAADSGSCDISSNSDTFGSPIHCISTAGVLLSSHMDQKDDHQSSSGNWSGSSSTCPSQTSETIPPAASPPLTGSSHCDSELSLNTAPHANEDASVFVTEQYNDHLDKVRGHRANSFTSTVADLLDDPNNSNTSDSEWNYLHHHHDASCRQDFSPERPKADSLGCPSFTSMATYDSFLEKSPSDKADTSSHFSVDTEGYYTSMHFDCGLKGNKSYVCHYAALGPENGQGVGASPGLPDCAWQDYLDHKRQGRPSISFRKPKAKPTPPKRSSSLRKSDGNADISEKKEPKISSGQHLPHSSREMKLPLDFANTPSRMENANLPTKQEPSWINQSEQGIKEPQLDASDIPPFKDEVAESTHYADLWLLNDLKTNDPYRSLSNSSTATGTTVIECIKSPESSESQTSQSESRATTPSLPSVDNEFKLASPEKLAGLASPSSGYSSQSETPTSSFPTAFFSGPLSPGGSKRKPKVPERKSSLQQPSLKDGTISLSKDLELPIIPPTHLDLSALHNVLNKPFHHRHPLHVFTHNKQNTVGETLRSNPPPSLAITPTILKSVNLRSINKSEEVKQKEENNTDLPYLEESTLTTAALSPSKIRPHTANKSVSRQYSTEDTILSFLDSSAVEMGPDKLHLEKNSTFDVKNRCDPETITSAGSSLLDSNVTKDQVRTETEPIPENTPTKNCAFPTEGFQRVSAARPNDLDGKIIQYGPGPDETLEQVQKAPSAGLEEVAQPESVDVITSQSDSPTRATDVSNQFKHQFVMSRHHDKVPGTISYESEITSVNSFPEKCSKQENIASGISAKSASDNSKAEETQGNVDEASLKESSPSDDSIISPLSEDSQAEAEGVFVSPNKPRTTEDLFAVIHRSKRKVLGRKDSGDMSVRSKSRAPLSSSSSSASSITSPSSNVTTPNSQRSPGLIYRNAKKSNTSNEEFKLLLLKKGSRSDSSYRMSATEILKSPILPKPPGELTAESPQSTDDAHQGSQGAEALSPLSPCSPRVNAEGFSSKSFATSASARVGRSRAPPAASSSRYSVRCRLYNTPMQAISEGETENSDGSPHDDRSSQSST

SEQ ID NO: 55325 - protein, 305 aa, Homo sapiens
  Payload ID: 10919
  Gene Symbol: NANOG
  Gene Name: Nanog homeobox
  Uniprot ID: Q9H9S0
  ENSP ID: ENSP00000229307
MSVDPACPQSLPCFEASDCKESSPMPVICGPEENYPSLQMSSAEMPHTETVSPLPSSMDLLIQDSPDSSTSPKGKQPTSAEKSVAKKEDKVPVKKQKTRTVFSSTQLCVLNDRFQRQKYLSLQQMQELSNILNLSYKQVKTWFQNQRMKSKRWQKNNWPKNSNGVTQKASAPTYPSLYSSYHQGCLVNPTGNLPMWSNQTWNNSTWSNQTQNIQSWSNHSWNTQTWCTQSWNNQAWNSPFYNCGEESLQSCMQFQPNSPASDLEAALEAAGEGLNVIQQTTRYFSTPQTMDLFLNYSMNMQPEDV

SEQ ID NO: 55326 - protein, 289 aa, Homo sapiens
  Payload ID: 10919
  Gene Symbol: NANOG
  Gene Name: Nanog homeobox
  Uniprot ID: Q9H9S0
  ENSP ID: ENSP00000435288
MSVDPACPQSLPCFEASDCKESSPMPVICGPEENYPSLQMSSAEMPHTETVSPLPSSMDLLIQDSPDSSTSPKGKQPTSAEKSVAKKEDKVPVKKQKTRTVFSSTQLCVLNDRFQRQKYLSLQQMQELSNILNLSYKQVKTWFQNQRMKSKRWQKNNWPKNSNGVTQGCLVNPTGNLPMWSNQTWNNSTWSNQTQNIQSWSNHSWNTQTWCTQSWNNQAWNSPFYNCGEESLQSCMQFQPNSPASDLEAALEAAGEGLNVIQQTTRYFSTPQTMDLFLNYSMNMQPEDV

SEQ ID NO: 55327 - protein, 186 aa, Homo sapiens
  Payload ID: 10919
  Gene Symbol: NANOG
  Gene Name: Nanog homeobox
  ENSP ID: ENSP00000444434
MPVICGPEENYPSLQMSSAEMPHTETVSPLPSSMDLLIQDSPDSSTSPKGKQPTSAEKSVAKKEDKVPVKKQKTRTVFSSTQLCVLNDRFQRQKYLSLQQMQELSNILNLSYKQVKTWFQNQRMKSKRWQKNNWPKNSNGVTQKASAPTYPSLYSSYHQGCLVNPTGNLPMWSNQTWNNSTWSNQT

SEQ ID NO: 55328 - protein, 289 aa, Homo sapiens
  Payload ID: 10920
  Gene Symbol: NANOGP8
  Gene Name: Nanog homeobox pseudogene 8
  ENSP ID: ENSP00000487045
MSVDPACPQSLPCFEESDCKESSPMPVICGPEENYPSLQMSSAEMPHTETVSPLPSSMDLLIQDSPDSSTSPKGKQPTSAENSVAKKEDKVPVKKQKTRTVFSSTQLCVLNDRFQRQKYLSLQQMQELSNILNLSYKQVKTWFQNQRMKSKRWQKNNWPKNSNGVTQGCLVNPTGNLPMWSNQTWNNSTWSNQTQNIQSWSNHSWNTQTWCTQSWNNQAWNSPFYNCGEESLQSCMHFQPNSPASDLEAALEAAGEGLNVIQQTTRYFSTPQTMDLFLNYSMNMQPEDV

SEQ ID NO: 55329 - protein, 305 aa, Homo sapiens
  Payload ID: 10920
  Gene Symbol: NANOGP8
  Gene Name: Nanog homeobox pseudogene 8
  ENSP ID: ENSP00000487073
MSVDPACPQSLPCFEESDCKESSPMPVICGPEENYPSLQMSSAEMPHTETVSPLPSSMDLLIQDSPDSSTSPKGKQPTSAENSVAKKEDKVPVKKQKTRTVFSSTQLCVLNDRFQRQKYLSLQQMQELSNILNLSYKQVKTWFQNQRMKSKRWQKNNWPKNSNGVTQKASAPTYPSLYSSYHQGCLVNPTGNLPMWSNQTWNNSTWSNQTQNIQSWSNHSWNTQTWCTQSWNNQAWNSPFYNCGEESLQSCMHFQPNSPASDLEAALEAAGEGLNVIQQTTRYFSTPQTMDLFLNYSMNMQPEDV

SEQ ID NO: 55330 - protein, 188 aa, Homo sapiens
  Payload ID: 10921
  Gene Symbol: NANOGNB
  Gene Name: NANOG neighbor homeobox
  Uniprot ID: Q7Z5D8
  ENSP ID: ENSP00000371553
MHRARWLTPVIPALWEAEAGRSRGQEIETILANKKQSAMPWDQDPEQSTGNYSEDEQNGKQKWREEGEAGRKREREKEEKNEKELQDEQENKRKRENEKQKQYPEKRLVSKSLMHTLWAKFKLNRCPTIQESLSLSFEFDMTHKQISQWFCKTRKKYNKEMSKRKHKKKHMRWRSLCCQGWSRTPALK

SEQ ID NO: 55331 - protein, 84 aa, Homo sapiens
  Payload ID: 10922
  Gene Symbol: NANOS1
  Gene Name: nanos homolog 1 (Drosophila)
  ENSP ID: ENSP00000345924
PELQVCVFCRNNKEAMALYTTHILKGPDGRVLCPVLRRYTCPLCGASGDNAHTIKYCPLSKVPPPPARPPPRSARDGPPGKKLR

SEQ ID NO: 55332 - protein, 292 aa, Homo sapiens
  Payload ID: 10922
  Gene Symbol: NANOS1
  Gene Name: nanos homolog 1 (Drosophila)
  Uniprot ID: Q8WY41
  ENSP ID: ENSP00000393275
MEAFPWAPRSPRRGRAPPPMALVPSARYVSAPGPAHPQPFSSWNDYLGLATLITKAVDGEPRFGCARGGNGGGGSPPSSSSSSCCSPHTGAGPGALGPALGPPDYDEDDDDDSDEPGSRGRYLGSALELRALELCAGPAEAGLLEERFAELSPFAGRAAAVLLGCAPAAAAAATTTSEATPREERAPAWAAEPRLHAASGAAAARLLKPELQVCVFCRNNKEAMALYTTHILKGPDGRVLCPVLRRYTCPLCGASGDNAHTIKYCPLSKVPPPPARPPPRSARDGPPGKKLR

SEQ ID NO: 55333 - protein, 138 aa, Homo sapiens
  Payload ID: 10923
  Gene Symbol: NANOS2
  Gene Name: nanos homolog 2 (Drosophila)
  Uniprot ID: P60321
  ENSP ID: ENSP00000341021
MQLPPFDMWKDYFNLSQVVWALIASRGQRLETQEIEEPSPGPPLGQDQGLGAPGANGGLGTLCNFCKHNGESRHVYSSHQLKTPDGVVVCPILRHYVCPVCGATGDQAHTLKYCPLNGGQQSLYRRSGRNSAGRRVKR

SEQ ID NO: 55334 - protein, 192 aa, Homo sapiens
  Payload ID: 10924
  Gene Symbol: NANOS3
  Gene Name: nanos homolog 3 (Drosophila)
  Uniprot ID: P60323
  ENSP ID: ENSP00000341992
MGTFDLWTDYLGLAHLVRALSGKEGPETRLSPQPEPEPMLEPVSALEPMPAPESVPVPGPKDQKRSLESSPAPERLCSFCKHNGESRAIYQSHVLKDEAGRVLCPILRDYVCPQCGATRERAHTRRFCPLTGQGYTSVYSHTTRNSAGKKLVRPDKAKTQDTGHRRGGGGGAGFRGAGKSEPSPSCSPSMST

SEQ ID NO: 55335 - protein, 173 aa, Homo sapiens
  Payload ID: 10924
  Gene Symbol: NANOS3
  Gene Name: nanos homolog 3 (Drosophila)
  Uniprot ID: P60323
  ENSP ID: ENSP00000380687
MGTFDLWTDYLGLAHLVRALSGKEGPETRLSPQPEPEPMLEPDQKRSLESSPAPERLCSFCKHNGESRAIYQSHVLKDEAGRVLCPILRDYVCPQCGATRERAHTRRFCPLTGQGYTSVYSHTTRNSAGKKLVRPDKAKTQDTGHRRGGGGGAGFRGAGKSEPSPSCSPSMST

SEQ ID NO: 55336 - protein, 420 aa, Homo sapiens
  Payload ID: 10925
  Gene Symbol: NAPSA
  Gene Name: napsin A aspartic peptidase
  Uniprot ID: O96009
  ENSP ID: ENSP00000253719
MSPPPLLQPLLLLLPLLNVEPSGATLIRIPLHRVQPGRRILNLLRGWREPAELPKLGAPSPGDKPIFVPLSNYRDVQYFGEIGLGTPPQNFTVAFDTGSSNLWVPSRRCHFFSVPCWLHHRFDPKASSSFQANGTKFAIQYGTGRVDGILSEDKLTIGGIKGASVIFGEALWEPSLVFAFAHFDGILGLGFPILSVEGVRPPMDVLVEQGLLDKPVFSFYLNRDPEEPDGGELVLGGSDPAHYIPPLTFVPVTVPAYWQIHMERVKVGPGLTLCAKGCAAILDTGTSLITGPTEEIRALHAAIGGIPLLAGEYIILCSEIPKLPAVSFLLGGVWFNLTAHDYVIQTTRNGVRLCLSGFQALDVPPPAGPFWILGDVFLGTYVAVFDRGDMKSSARVGLARARTRGADLGWGETAQAQFPG

SEQ ID NO: 55337 - protein, 268 aa, Homo sapiens
  Payload ID: 10925
  Gene Symbol: NAPSA
  Gene Name: napsin A aspartic peptidase
  ENSP ID: ENSP00000469061
MSPPPLLQPLLLLLPLLNVEPSGATLIRIPLHRVQPGRRILNLLRGWREPAELPKLGAPSPGDKPIFVPLSNYRDVQYFGEIGLGTPPQNFTVAFDTGSSNLWVPSRRCHFFSVPCSSSSFQANGTKFAIQYGTGRVDGILSEDKLTIGGIKGASVIFGEALWEPSLVFAFAHFDGILGLGFPILSVEGVRPPMDVLVEQGLLDKPVFSFYLNRDPEEPDGGELVLGGSDPAHYIPPLTFVPVTVPAYWQIHMERVKVGPGLTLCAKG

SEQ ID NO: 55338 - protein, 104 aa, Homo sapiens
  Payload ID: 10925
  Gene Symbol: NAPSA
  Gene Name: napsin A aspartic peptidase
  ENSP ID: ENSP00000469763
MSPPPLLQPLLLLLPLLNVEPSGATLIRIPLHRVQPGRRILNLLRGWREPAELPKLGAPSPGDKPIFVPLSNYRDGYTTDLIPKPLAPSRPMGPSLPFNMELGG

SEQ ID NO: 55339 - protein, 1151 aa, Homo sapiens
  Payload ID: 10926
  Gene Symbol: NRD1
  Gene Name: nardilysin (N-arginine dibasic convertase)
  Uniprot ID: O43847
  ENSP ID: ENSP00000262679
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGYHVYPTCRNTSGILGFSVTVGTQATKYNSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVVGYGKYELEEDGTPSSEDSNSSCEVMQLTYLPTSPLLADCIIPITDIRAFTTTLNLLPYHKIVK

SEQ ID NO: 55340 - protein, 1219 aa, Homo sapiens
  Payload ID: 10926
  Gene Symbol: NRD1
  Gene Name: nardilysin (N-arginine dibasic convertase)
  ENSP ID: ENSP00000346890
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQQLQSLFLLWSKLTDRLWFKSTYSKMSSTLLVETRNLYGVVGAESRSAPVQHLAGWQAEEQQGETDTVLSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGYHVYPTCRNTSGILGFSVTVGTQATKYNSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVVGYGKYELEEDGTPSSEDSNSSCEVMQLTYLPTSPLLADCIIPITDIRAFTTTLNLLPYHKIVK

SEQ ID NO: 55341 - protein, 538 aa, Homo sapiens
  Payload ID: 10926
  Gene Symbol: NRD1
  Gene Name: nardilysin (N-arginine dibasic convertase)
  ENSP ID: ENSP00000398464
  MOD_RES (1)..(1): Any amino acid
XKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVVGYGKYELEEDGTPSSEDSNSSCEVMQLTYLPTSPLLADCIIPITDIRAFTTTLNLLPYHKIVK

SEQ ID NO: 55342 - protein, 949 aa, Homo sapiens
  Payload ID: 10926
  Gene Symbol: NRD1
  Gene Name: nardilysin (N-arginine dibasic convertase)
  ENSP ID: ENSP00000442262
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQVRYQESKRIYAYGAACDAHGRTLF

SEQ ID NO: 55343 - protein, 1087 aa, Homo sapiens
  Payload ID: 10926
  Gene Symbol: NRD1
  Gene Name: nardilysin (N-arginine dibasic convertase)
  ENSP ID: ENSP00000444416
MEGKTGNTTDDEEEEEVEEEEEDDDEDSGAEIEDDDEEGFDDEDEFDDEHDDDLDTEDNELEELEERAEARKKTTEKQQLQSLFLLWSKLTDRLWFKSTYSKMSSTLLVETRNLYGVVGAESRSAPVQHLAGWQAEEQQGETDTVLSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGYHVYPTCRNTSGILGFSVTVGTQATKYNSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVVGYGKYELEEDGTPSSEDSNSSCEVMQLTYLPTSPLLADCIIPITDIRAFTTTLNLLPYHKIVK

SEQ ID NO: 55344 - protein, 1148 aa, Homo sapiens
  Payload ID: 10926
  Gene Symbol: NRD1
  Gene Name: nardilysin (N-arginine dibasic convertase)
  ENSP ID: ENSP00000481902
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGYHVYPTCRNTSGILGFSVTVGTQATKYNSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVVGYGKYELEEDGTPSSEDSNSSCEVMQLTYLPTSPLLAIVSSPLLISGLSQQHSTFSPTIK

SEQ ID NO: 55345 - protein, 215 aa, Homo sapiens
  Payload ID: 10927
  Gene Symbol: NACA
  Gene Name: nascent polypeptide-associated complex alpha subunit
  Uniprot ID: Q13765
  ENSP ID: ENSP00000349212
MPGEATETVPATEQELPQPQAETGSGTESDSDESVPELEEQDSTQATTQQAQLAAAAEIDEEPVSKAKQSRSEKKARKAMSKLGLRQVTGVTRVTIRKSKNILFVITKPDVYKSPASDTYIVFGEAKIEDLSQQAQLAAAEKFKVQGEAVSNIQENTQTPTVQEESEEEEVDETGVEVKDIELVMSQANVSRAKAVRALKNNSNDIVNAIMELTM

SEQ ID NO: 55346 - protein, 215 aa, Homo sapiens; identical to SEQ ID NO: 55345
  Payload ID: 10927
  Gene Symbol: NACA
  Gene Name: nascent polypeptide-associated complex alpha subunit
  Uniprot ID: Q13765
  ENSP ID: ENSP00000377469

SEQ ID NO: 55347 - protein, 2078 aa, Homo sapiens
  Payload ID: 10927
  Gene Symbol: NACA
  Gene Name: nascent polypeptide-associated complex alpha subunit
  Uniprot ID: E9PAV3
  ENSP ID: ENSP00000403817
MPGEATETVPATEQELPQPQAETAVLPMSSALSVTAALGQPGPTLPPPCSPAPQQCPLSAANQASPFPSPSTIASTPLEVPFPQSSSGTALPLGTAPEAPTFLPNLIGPPISPAALALASPMIAPTLKGTPSSSAPLALVALAPHSVQKSSAFPPNLLTSPPSVAVAESGSVITLSAPIAPSEPKTNLNKVPSEVVPNPKGTPSPPCIVSTVPYHCVTPMASIQSGVASLPQTTPTTTLAIASPQVKDTTISSVLISPQNPGSLSLKGPVSPPAALSLSTQSLPVVTSSQKTAGPNTPPDFPISLGSHLAPLHQSSFGSVQLLGQTGPSALSDPTVKTISVDHSSTGASYPSQRSVIPPLPSRNEVVPATVAAFPVVAPSVDKGPSTISSITCSPSGSLNVATSFSLSPTTSLILKSSPNATYHYPLVAQMPVSSVGTTPLVVTNPCTIAAAPTTTFEVATCVSPPMSSGPISNIEPTSPAALVMAPVAPKEPSTQVATTLRIPVSPPLPDPEDLKNLPSSVLVKFPTQKDLQTVPASLEGAPFSPAQAGLTTKKDPTVLPLVQAAPKNSPSFQSTSSSPEIPLSPEATLAKKSLGEPLPIGKPASSMTSPLGVNSSASVIKTDSYAGPDSAGPLLKSSLITPTVAAFPLESADPAGVAPTTAKGTSTYTTTASPFLEGTVSLAPKNHPVKEGTLTTLPLVPTASENCPVAPSPQNTCAPLATLVLAPEIPKSVPSPSLPPAGTPPGTKKVDGISHTSALAPVASSPKECPTEDSGASATASSKGTLTYLADSPSPLGVSVSPQTKRPPTKKGSAGPDTPIGNLSSPVSPVEASFLPENSLSFQGSKDSPATTHSPTPPSPKGAPTPSAVTPLSPKGVTLPPKETPTPSVVNLPFPKEGPATPAPKQAPALSMTSSSPKKARATPAPKGIPASPSPKGAPTPPAATPPSPKGGPATPSPKWAPTPPAATPPSPKGGPATPSPKGAPTPPAATPPSPKGGPATPSPKGAPTPPAVTPPSPKGSPAATPFPKGASTPPAATPPSPKGSPAATPLPKGAPTTPAATLPSPKGGPATPSLKGAPTPPAATPPSPKGGPATPSPKGAPMPPAATPPSPKGGLATPPHKGAPTTPAATPPSPKGGLATPPPKGAPTTPAATPPSPKGGLATPPPKGAPTTPAATPPSPKGGLATPSPKGAPTTPAATPPSPKGGLATPSPKGAPTTPAATPPSPKGGLATPSPKGAPTTPAATPPSPKGGPATPPPKGAPTPPAATPPSLKGGLATPPHKGAPNPAVVTPPSPKGGPATSPPKGAPTPPAATPPSPKGSPGTPPPKGAPTPPAVTPPSPKGTPTLPATTPSSKGGPTTPSSKEGPTPPAATPSHKGGPAMTPPSPKRGPAIPSPKGDPTSPAVIPLSPKKAPATPVTREGAATPSKGDLTPPAVTPVSLKKAPATSAPKGGPATPSSKGDPTLPAVTPPSPKEPPAPKQVATSSSPKKAPATPAPMGAPTLPAVIPSSPKEVPATPSSRRDPIAPTATLLSKKTPATLAPKEALIPPAMTVPSPKKTPAIPTPKEAPATPSSKEASSPPAVTPSTYKGAPSPKELLIPPAVTSPSPKEAPTPPAVTPPSPEKGPATPAPKGTPTSPPVTPSSLKDSPTSPASVTCKMGATVPQASKGLPAKKGPTALKEVLVAPAPESTPIITAPTRKGPQTKKSSATSPPICPDPSAKNGSKGPLSTVAPAPLLPVQKDSSKTAKGKDASHSPKGPLAPPESKASTPLTAAAFEKVLPKPESASVSAAPSPPVSLPLAPSPVPTLPPKQQFLPSSPGLVLESPSKPLAPADEDELLPLIPPEPISGGVPFQSVLVNMPTPKSAGIPVPTPSAKQPVTKNNKGSGTESDSDESVPELEEQDSTQATTQQAQLAAAAEIDEEPVSKAKQSRSEKKARKAMSKLGLRQVTGVTRVTIRKSKNILFVITKPDVYKSPASDTYIVFGEAKIEDLSQQAQLAAAEKFKVQGEAVSNIQENTQTPTVQEESEEEEVDETGVEVKDIELVMSQANVSRAKAVRALKNNSNDIVNAIMELTM

SEQ ID NO: 55348 - protein, 72 aa, Homo sapiens
  Payload ID: 10927
  Gene Symbol: NACA
  Gene Name: nascent polypeptide-associated complex alpha subunit
  ENSP ID: ENSP00000446745
MPGEATETVPATEQELPQPQAETGSGTESDSDESVPELEEQELLESLSGNLRISSLSSQNQMSTRALLQILT

SEQ ID NO: 55349 - protein, 215 aa, Homo sapiens; identical to SEQ ID NO: 55345
  Payload ID: 10927
  Gene Symbol: NACA
  Gene Name: nascent polypeptide-associated complex alpha subunit
  Uniprot ID: Q13765
  ENSP ID: ENSP00000446801

SEQ ID NO: 55350 - protein, 71 aa, Homo sapiens
  Payload ID: 10927
  Gene Symbol: NACA
  Gene Name: nascent polypeptide-associated complex alpha subunit
  ENSP ID: ENSP00000446933
MSKLGLRQVTGVTRVTIRKSKNILFVITKPDVYKSPASDTYIVFGEAKIEDLSQQAQLAAAEKFKVQGEAV

SEQ ID NO: 55351 - protein, 198 aa, Homo sapiens
  Payload ID: 10927
  Gene Symbol: NACA
  Gene Name: nascent polypeptide-associated complex alpha subunit
  ENSP ID: ENSP00000447133
MPGEATETVPATEQELPQPQAETGSGTESDSDESVPELEEQDSTQATTQQAQLAAAAEIDEEPVSKAKQSRSEKKARKAMSKLGLRQVTGVTRVTIRKSKNILFVITKPDVYKSPASDTYIVFGEAKIEDLSQQAQLAAAEKFKVQGEAVSNIQENTQTPTVQEESEEEEVDETGVEVKDIELVMSQANVSRAKAVRA

SEQ ID NO: 55352 - protein, 34 aa, Homo sapiens
  Payload ID: 10927
  Gene Symbol: NACA
  Gene Name: nascent polypeptide-associated complex alpha subunit
  ENSP ID: ENSP00000447207
MPGEATETVPATEQELPQPQAETVVSHLRVWNRI

SEQ ID NO: 55353 - protein, 5 aa, Homo sapiens
  Payload ID: 10927
  Gene Symbol: NACA
  Gene Name: nascent polypeptide-associated complex alpha subunit
  ENSP ID: ENSP00000447666
MPGEA

SEQ ID NO: 55354 - protein, 136 aa, Homo sapiens
  Payload ID: 10927
  Gene Symbol: NACA
  Gene Name: nascent polypeptide-associated complex alpha subunit
  ENSP ID: ENSP00000447705
MSKLGLRQVTGVTRVTIRKSKNILFVITKPDVYKSPASDTYIVFGEAKIEDLSQQAQLAAAEKFKVQGEAVSNIQENTQTPTVQEESEEEEVDETGVEVKDIELVMSQANVSRAKAVRALKNNSNDIVNAIMELTM

SEQ ID NO: 55355 - protein, 126 aa, Homo sapiens
  Payload ID: 10927
  Gene Symbol: NACA
  Gene Name: nascent polypeptide-associated complex alpha subunit
  ENSP ID: ENSP00000447764
MPGEATETVPATEQELPQPQAETGSGTESDSDESVPELEEQDSTQATTQQAQLAAAAEIDEEPVSKAKQSRSEKKARKAMSKLGLRQVTGVTRVTIRKSKNILFVITKPDVYKSPASDTYIVFGEA

SEQ ID NO: 55356 - protein, 215 aa, Homo sapiens; identical to SEQ ID NO: 55345
  Payload ID: 10927
  Gene Symbol: NACA
  Gene Name: nascent polypeptide-associated complex alpha subunit
  Uniprot ID: Q13765
  ENSP ID: ENSP00000447821

SEQ ID NO: 55357 - protein, 925 aa, Homo sapiens
  Payload ID: 10927
  Gene Symbol: NACA
  Gene Name: nascent polypeptide-associated complex alpha subunit
  Uniprot ID: E9PAV3
  ENSP ID: ENSP00000448035
MPGEATETVPATEQELPQPQAETAVLPMSSALSVTAALGQPGPTLPPPCSPAPQQCPLSAANQASPFPSPSTIASTPLEVPFPQSSSGTALPLGTAPEAPTFLPNLIGPPISPAALALASPMIAPTLKGTPSSSAPLALVALAPHSVQKSSAFPPNLLTSPPSVAVAESGSVITLSAPIAPSEPKTNLNKVPSEVVPNPKGTPSPPCIVSTVPYHCVTPMASIQSGVASLPQTTPTTTLAIASPQVKDTTISSVLISPQNPGSLSLKGPVSPPAALSLSTQSLPVVTSSQKTAGPNTPPDFPISLGSHLAPLHQSSFGSVQLLGQTGPSALSDPTVKTISVDHSSTGASYPSQRSVIPPLPSRNEVVPATVAAFPVVAPSVDKGPSTISSITCSPSGSLNVATSFSLSPTTSLILKSSPNATYHYPLVAQMPVSSVGTTPLVVTNPCTIAAAPTTTFEVATCVSPPMSSGPISNIEPTSPAALVMAPVAPKEPSTQVATTLRIPVSPPLPDPEDLKNLPSSVLVKFPTQKDLQTVPASLEGAPFSPAQAGLTTKKDPTVLPLVQAAPKNSPSFQSTSSSPEIPLSPEATLAKKSLGEPLPIVAAFPLESADPAGVAPTTAKAAAFEKVLPKPESASVSAAPSPPVSLPLAPSPVPTLPPKQQFLPSSPGLVLESPSKPLAPADEDELLPLIPPEPISGGVPFQSVLVNMPTPKSAGIPVPTPSAKQPVTKNNKGSGTESDSDESVPELEEQDSTQATTQQAQLAAAAEIDEEPVSKAKQSRSEKKARKAMSKLGLRQVTGVTRVTIRKSKNILFVITKPDVYKSPASDTYIVFGEAKIEDLSQQAQLAAAEKFKVQGEAVSNIQENTQTPTVQEESEEEEVDETGVEVKDIELVMSQANVSRAKAVRALKNNSNDIVNAIMELTM

SEQ ID NO: 55358 - protein, 213 aa, Homo sapiens
  Payload ID: 10927
  Gene Symbol: NACA
  Gene Name: nascent polypeptide-associated complex alpha subunit
  ENSP ID: ENSP00000448039
TVAAFPLESADPAGVAPTTAKGSGTESDSDESVPELEEQDSTQATTQQAQLAAAAEIDEEPVSKAKQSRSEKKARKAMSKLGLRQVTGVTRVTIRKSKNILFVITKPDVYKSPASDTYIVFGEAKIEDLSQQAQLAAAEKFKVQGEAVSNIQENTQTPTVQEESEEEEVDETGVEVKDIELVMSQANVSRAKAVRALKNNSNDIVNAIMELTM

SEQ ID NO: 55359 - protein, 148 aa, Homo sapiens
  Payload ID: 10927
  Gene Symbol: NACA
  Gene Name: nascent polypeptide-associated complex alpha subunit
  ENSP ID: ENSP00000450383
MPGEATETVPATEQELPQPQAETESDSDESVPELEEQDSTQATTQQAQLAAAAEIDEEPVSKAKQSRSEKKARKAMSKLGLRQVTGVTRVTIRKSKNILFVITKPDVYKSPASDTYIVFGEAKIEDLSQQAQLAAAEKFKVQGEAVSN

SEQ ID NO: 55360 - protein, 215 aa, Homo sapiens
  Payload ID: 10928
  Gene Symbol: NACA2
  Gene Name: nascent polypeptide-associated complex alpha subunit 2
  Uniprot ID: Q9H009
  ENSP ID: ENSP00000427802
MPGEATETVPATEQELPQSQAETGSGTASDSGESVPGIEEQDSTQTTTQKAWLVAAAEIDEEPVGKAKQSRSEKRARKAMSKLGLLQVTGVTRVTIWKSKNILFVITKLDVYKSPASDAYIVFGEAKIQDLSQQAQLAAAEKFRVQGEAVGNIQENTQTPTVQEESEEEEVDETGVEVKDVKLVMSQANVSRAKAVRALKNNSNDIVNAIMELTV

SEQ ID NO: 55361 - protein, 101 aa, Homo sapiens
  Payload ID: 10929
  Gene Symbol: NPPA
  Gene Name: natriuretic peptide A
  ENSP ID: ENSP00000365659
MPLEDEVVPPQVLSEPNEEAGAALSPLPEVPPWTGEVSPAQRDGGALGRGPWDSSDRSALLKSKLRALLTAPRSLRRSSCFGGRMDRIGAQSGLGCNSFRY

SEQ ID NO: 55362 - protein, 151 aa, Homo sapiens
  Payload ID: 10929
  Gene Symbol: NPPA
  Gene Name: natriuretic peptide A
  Uniprot ID: P01160
  ENSP ID: ENSP00000365663
MSSFSTTTVSFLLLLAFQLLGQTRANPMYNAVSNADLMDFKNLLDHLEEKMPLEDEVVPPQVLSEPNEEAGAALSPLPEVPPWTGEVSPAQRDGGALGRGPWDSSDRSALLKSKLRALLTAPRSLRRSSCFGGRMDRIGAQSGLGCNSFRY

SEQ ID NO: 55363 - protein, 152 aa, Homo sapiens [sequence omitted]

SEQ ID NO: 55364 - protein, 134 aa, Homo sapiens
  Payload ID: 10930
  Gene Symbol: NPPB
  Gene Name: natriuretic peptide B
  Uniprot ID: P16860
  ENSP ID: ENSP00000365651
MDPQTAPSRALLLLLFLHLAFLGGRSHPLGSPGSASDLETSGLQEQRNHLQGKLSELQVEQTSLEPLQESPRPTGVWKSREVATEGIRGHRKMVLYTLRAPRSPKMVQGSGCFGRKMDRISSSSGLGCKVLRRH

SEQ ID NO: 55365 - protein, 126 aa, Homo sapiens
  Payload ID: 10931
  Gene Symbol: NPPC
  Gene Name: natriuretic peptide C
  Uniprot ID: P23582
  ENSP ID: ENSP00000295440
MHLSQLLACALLLTLLSLRPSEAKPGAPPKVPRTPPAEELAEPQAAGGGQKKGDKAPGGGGANLKGDRSRLLRDLRVDTKSRAAWARLLQEHPNARKYKGANKKGLSKGCFGLKLDRIGSMSGLGC

SEQ ID NO: 55366 - protein, 126 aa, Homo sapiens; identical to SEQ ID NO: 55365
  Payload ID: 10931
  Gene Symbol: NPPC
  Gene Name: natriuretic peptide C
  Uniprot ID: P23582
  ENSP ID: ENSP00000387159

SEQ ID NO: 55367 - protein, 1061 aa, Homo sapiens
  Payload ID: 10932
  Gene Symbol: NPR1
  Gene Name: natriuretic peptide receptor 1
  Uniprot ID: P16066
  ENSP ID: ENSP00000357669
MPGPRRPAGSRLRLLLLLLLPPLLLLLRGSHAGNLTVAVVLPLANTSYPWSWARVGPAVELALAQVKARPDLLPGWTVRTVLGSSENALGVCSDTAAPLAAVDLKWEHNPAVFLGPGCVYAAAPVGRFTAHWRVPLLTAGAPALGFGVKDEYALTTRAGPSYAKLGDFVAALHRRLGWERQALMLYAYRPGDEEHCFFLVEGLFMRVRDRLNITVDHLEFAEDDLSHYTRLLRTMPRKGRVIYICSSPDAFRTLMLLALEAGLCGEDYVFFHLDIFGQSLQGGQGPAPRRPWERGDGQDVSARQAFQAAKIITYKDPDNPEYLEFLKQLKHLAYEQFNFTMEDGLVNTIPASFHDGLLLYIQAVTETLAHGGTVTDGENITQRMWNRSFQGVTGYLKIDSSGDRETDFSLWDMDPENGAFRVVLNYNGTSQELVAVSGRKLNWPLGYPPPDIPKCGFDNEDPACNQDHLSTLEVLALVGSLSLLGILIVSFFIYRKMQLEKELASELWRVRWEDVEPSSLERHLRSAGSRLTLSGRGSNYGSLLTTEGQFQVFAKTAYYKGNLVAVKRVNRKRIELTRKVLFELKHMRDVQNEHLTRFVGACTDPPNICILTEYCPRGSLQDILENESITLDWMFRYSLTNDIVKGMLFLHNGAICSHGNLKSSNCVVDGRFVLKITDYGLESFRDLDPEQGHTVYAKKLWTAPELLRMASPPVRGSQAGDVYSFGIILQEIALRSGVFHVEGLDLSPKEIIERVTRGEQPPFRPSLALQSHLEELGLLMQRCWAEDPQERPPFQQIRLTLRKFNRENSSNILDNLLSRMEQYANNLEELVEERTQAYLEEKRKAEALLYQILPHSVAEQLKRGETVQAEAFDSVTIYFSDIVGFTALSAESTPMQVVTLLNDLYTCFDAVIDNFDVYKVETIGDAYMVVSGLPVRNGRLHACEVARMALALLDAVRSFRIRHRPQEQLRLRIGIHTGPVCAGVVGLKMPRYCLFGDTVNTASRMESNGEALKIHLSSETKAVLEEFGGFELELRGDVEMKGKGKVRTYWLLGERGSSTRG

SEQ ID NO: 55368 - protein, 1047 aa, Homo sapiens
  Payload ID: 10933
  Gene Symbol: NPR2
  Gene Name: natriuretic peptide receptor 2
  Uniprot ID: P20594
  ENSP ID: ENSP00000341083
MALPSLLLLVAALAGGVRPPGARNLTLAVVLPEHNLSYAWAWPRVGPAVALAVEALGRALPVDLRFVSSELEGACSEYLAPLSAVDLKLYHDPDLLLGPGCVYPAASVARFASHWRLPLLTAGAVASGFSAKNDHYRTLVRTGPSAPKLGEFVVTLHGHFNWTARAALLYLDARTDDRPHYFTIEGVFEALQGSNLSVQHQVYAREPGGPEQATHFIRANGRIVYICGPLEMLHEILLQAQRENLTNGDYVFFYLDVFGESLRAGPTRATGRPWQDNRTREQAQALREAFQTVLVITYREPPNPEYQEFQNRLLIRAREDFGVELGPSLMNLIAGCFYDGILLYAEVLNETIQEGGTREDGLRIVEKMQGRRYHGVTGLVVMDKNNDRETDFVLWAMGDLDSGDFQPAAHYSGAEKQIWWTGRPIPWVKGAPPSDNPPCAFDLDDPSCDKTPLSTLAIVALGTGITFIMFGVSSFLIFRKLMLEKELASMLWRIRWEELQFGNSERYHKGAGSRLTLSLRGSSYGSLMTAHGKYQIFANTGHFKGNVVAIKHVNKKRIELTRQVLFELKHMRDVQFNHLTRFIGACIDPPNICIVTEYCPRGSLQDILENDSINLDWMFRYSLINDLVKGMAFLHNSIISSHGSLKSSNCVVDSRFVLKITDYGLASFRSTAEPDDSHALYAKKLWTAPELLSGNPLPTTGMQKADVYSFGIILQEIALRSGPFYLEGLDLSPKEIVQKVRNGQRPYFRPSIDRTQLNEELVLLMERCWAQDPAERPDFGQIKGFIRRFNKEGGTSILDNLLLRMEQYANNLEKLVEERTQAYLEEKRKAEALLYQILPHSVAEQLKRGETVQAEAFDSVTIYFSDIVGFTALSAESTPMQVVTLLNDLYTCFDAIIDNFDVYKVETIGDAYMVVSGLPGRNGQRHAPEIARMALALLDAVSSFRIRHRPHDQLRLRIGVHTGPVCAGVVGLKMPRYCLFGDTVNTASRMESNGQALKIHVSSTTKDALDELGCFQLELRGDVEMKGKGKMRTYWLLGERKGPPGLL

SEQ ID NO: 55369 - protein, 164 aa, Homo sapiens [sequence omitted]

SEQ ID NO: 55370 - protein, 275 aa, Homo sapiens
  Payload ID: 10933
  Gene Symbol: NPR2
  Gene Name: natriuretic peptide receptor 2
  ENSP ID: ENSP00000399204
  MOD_RES (1)..(1): Any amino acid
XSIISSHGSLKSSNCVVDSRFVLKITDYGLASFRSTAEPDDSHALYASMQKADVYSFGIILQEIALRSGPFYLEGLDLSPKEIVQKVRNGQRPYFRPSIDRTQLNEELVLLMERCWAQDPAERPDFGQIKGFIRRFNKEGGTSILDNLLLRMEQYANNLEKLVEERTQAYLEEKRKAEALLYQILPHSVAEQLKRGETVQAEAFDSVTIYFSDIVGFTALSAESTPMQVVTLLNDLYTCFDAIIDNFDVYKVETIGDAYMVVSGLPGRNGQRHAP

SEQ ID NO: 55371 - protein, 76 aa, Homo sapiens
  Payload ID: 10933
  Gene Symbol: NPR2
  Gene Name: natriuretic peptide receptor 2
  ENSP ID: ENSP00000402902
  MOD_RES (1)..(1): Any amino acid
XPHSVAEQLKRGETVQAEAFDSVTIYFSDIVGFTALSAESTPMQVVTLLNDLYTCFDAIIDNFDVYKGQSVLGLLA

SEQ ID NO: 55372 - protein, 541 aa, Homo sapiens
  Payload ID: 10934
  Gene Symbol: NPR3
  Gene Name: natriuretic peptide receptor 3
  Uniprot ID: P17342
  ENSP ID: ENSP00000265074
MPSLLVLTFSPCVLLGWALLAGGTGGGGVGGGGGGAGIGGGRQEREALPPQKIEVLVLLPQDDSYLFSLTRVRPAIEYALRSVEGNGTGRRLLPPGTRFQVAYEDSDCGNRALFSLVDRVAAARGAKPDLILGPVCEYAAAPVARLASHWDLPMLSAGALAAGFQHKDSEYSHLTRVAPAYAKMGEMMLALFRHHHWSRAALVYSDDKLERNCYFTLEGVHEVFQEEGLHTSIYSFDETKDLDLEDIVRNIQASERVVIMCASSDTIRSIMLVAHRHGMTSGDYAFFNIELFNSSSYGDGSWKRGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGIAGQVSIDANGDRYGDFSVIAMTDVEAGTQEVIGDYFGKEGRFEMRPNVKYPWGPLKLRIDENRIVEHTNSSPCKSSGGLEESAVTGIVVGALLGAGLLMAFYFFRKKYRITIERRTQQEESNLGKHRELREDSIRSHFSVA

SEQ ID NO: 55373 - protein, 324 aa, Homo sapiens
  Payload ID: 10934
  Gene Symbol: NPR3
  Gene Name: natriuretic peptide receptor 3
  Uniprot ID: P17342
  ENSP ID: ENSP00000318340
MEPSALGPWSLFPDLAPRDQEGQVLAPRRCFRRECGQNEKVVIMCASSDTIRSIMLVAHRHGMTSGDYAFFNIELFNSSSYGDGSWKRGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGIAGQVSIDANGDRYGDFSVIAMTDVEAGTQEVIGDYFGKEGRFEMRPNVKYPWGPLKLRIDENRIVEHTNSSPCKSCGLEESAVTGIVVGALLGAGLLMAFYFFRKKYRITIERRTQQEESNLGKHRELREDSIRSHFSVA

SEQ ID NO: 55374 - protein, 325 aa, Homo sapiens
  Payload ID: 10934
  Gene Symbol: NPR3
  Gene Name: natriuretic peptide receptor 3
  ENSP ID: ENSP00000388408
MEPSALGPWSLFPDLAPRDQEGQVLAPRRCFRRECGQNEKVVIMCASSDTIRSIMLVAHRHGMTSGDYAFFNIELFNSSSYGDGSWKRGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGIAGQVSIDANGDRYGDFSVIAMTDVEAGTQEVIGDYFGKEGRFEMRPNVKYPWGPLKLRIDENRIVEHTNSSPCKSSGGLEESAVTGIVVGALLGAGLLMAFYFFRKKYRITIERRTQQEESNLGKHRELREDSIRSHFSVA

SEQ ID NO: 55375 - protein, 540 aa, Homo sapiens
  Payload ID: 10934
  Gene Symbol: NPR3
  Gene Name: natriuretic peptide receptor 3
  Uniprot ID: P17342
  ENSP ID: ENSP00000398028
MPSLLVLTFSPCVLLGWALLAGGTGGGGVGGGGGGAGIGGGRQEREALPPQKIEVLVLLPQDDSYLFSLTRVRPAIEYALRSVEGNGTGRRLLPPGTRFQVAYEDSDCGNRALFSLVDRVAAARGAKPDLILGPVCEYAAAPVARLASHWDLPMLSAGALAAGFQHKDSEYSHLTRVAPAYAKMGEMMLALFRHHHWSRAALVYSDDKLERNCYFTLEGVHEVFQEEGLHTSIYSFDETKDLDLEDIVRNIQASERVVIMCASSDTIRSIMLVAHRHGMTSGDYAFFNIELFNSSSYGDGSWKRGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGIAGQVSIDANGDRYGDFSVIAMTDVEAGTQEVIGDYFGKEGRFEMRPNVKYPWGPLKLRIDENRIVEHTNSSPCKSCGLEESAVTGIVVGALLGAGLLMAFYFFRKKYRITIERRTQQEESNLGKHRELREDSIRSHFSVA

SEQ ID NO: 55376 - protein, 88 aa, Homo sapiens
  Payload ID: 10934
  Gene Symbol: NPR3
  Gene Name: natriuretic peptide receptor 3
  ENSP ID: ENSP00000423730
  MOD_RES (1)..(1): Any amino acid
XEMMLALFRHHHWSRAALVYSDDKLERNCYFTLEGVHEVFQEEGLHTSIYSFDETKDLDLEDIVRNIQASERVLGLICWNPSGRKFSS

SEQ ID NO: 55377 - protein, 252 aa, Homo sapiens
  Payload ID: 10934
  Gene Symbol: NPR3
  Gene Name: natriuretic peptide receptor 3
  ENSP ID: ENSP00000425325
MAEGCAVYGTWPWGGMFQLFRPSALAGLCSIGLVVIMCASSDTIRSIMLVAHRHGMTSGDYAFFNIELFNSSSYGDGSWKRGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGIAGQVSIDANGDRYGDFSVIAMTDVEAGTQEVIGDYFGKEGRFEMRPNVKYPWGPLKLRIDENRIVEHTNSSPCKS

SEQ ID NO: 55378 - protein, 304 aa, Homo sapiens
  Payload ID: 10935
  Gene Symbol: NCR1
  Gene Name: natural cytotoxicity triggering receptor 1
  ENSP ID: ENSP00000291890
MSSTLPALLCVGLCLSQRISAQQQTLPKPFIWAEPHFMVPKEKQVTICCQGNYGAVEYQLHFEGSLFAVDRPKPPERINKVQFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPADTWGTYLLTTETGLQKDHALWDHTAQNLLRMGLAFLVLVALVWFLVEDWLSRKRTRERASRASTWEGRRRLNTQTL

SEQ ID NO: 55379 - protein, 287 aa, Homo sapiens
  Payload ID: 10935
  Gene Symbol: NCR1
  Gene Name: natural cytotoxicity triggering receptor 1
  ENSP ID: ENSP00000339515
MSSTLPALLCVGLCLSQRISAQQQTLPKPFIWAEPHFMVPKEKQVTICCQGNYGAVEYQLHFEGSLFAVDRPKPPERINKVQFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPDHALWDHTAQNLLRMGLAFLVLVALVWFLVEDWLSRKRTRERASRASTWEGRRRLNTQTL

SEQ ID NO: 55380 - protein, 209 aa, Homo sapiens
  Payload ID: 10935
  Gene Symbol: NCR1
  Gene Name: natural cytotoxicity triggering receptor 1
  Uniprot ID: O76036
  ENSP ID: ENSP00000344358
MSSTLPALLCVGLCLSQRISAQQQMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPADTWGTYLLTTETGLQKDHALWDHTAQNLLRMGLAFLVLVALVWFLVEDWLSRKRTRERASRASTWEGRRRLNTQTL

SEQ ID NO: 55381 - protein, 197 aa, Homo sapiens
  Payload ID: 10935
  Gene Symbol: NCR1
  Gene Name: natural cytotoxicity triggering receptor 1
  Uniprot ID: O76036
  ENSP ID: ENSP00000349972
MSSTLPALLCVEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPADTWGTYLLTTETGLQKDHALWDHTAQNLLRMGLAFLVLVALVWFLVEDWLSRKRTRERASRASTWEGRRRLNTQTL

SEQ ID NO: 55382 - protein, 291 aa, Homo sapiens
  Payload ID: 10935
  Gene Symbol: NCR1
  Gene Name: natural cytotoxicity triggering receptor 1
  ENSP ID: ENSP00000469750
MSSTLPALLCVETLPKPFIWAEPHFMVPKEKQVTICCQGNYGAVEYQLHFEGSLFAVDRPKPPERINKVQFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPDTWGTYLLTTETGLQKDHALWDHTAQNLLRMGLAFLVLVALVWFLVEDWLSRKRTRERASRASTWEGRRRLNTQTL

SEQ ID NO: 55383 - protein, 303 aa, Homo sapiens
  Payload ID: 10935
  Gene Symbol: NCR1
  Gene Name: natural cytotoxicity triggering receptor 1
  ENSP ID: ENSP00000471986
MSSTLPALLCVGLCLSQRISAQQQTLPKPFIWAEPHFMVPKEKQVTICCQGNYGAVEYQLHFEGSLFAVDRPKPPERINKVQFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPDTWGTYLLTTETGLQKDHALWDHTAQNLLRMGLAFLVLVALVWFLVEDWLSRKRTRERASRASTWEGRRRLNTQTL

SEQ ID NO: 55384 - protein, 192 aa, Homo sapiens
  Payload ID: 10935
  Gene Symbol: NCR1
  Gene Name: natural cytotoxicity triggering receptor 1
  Uniprot ID: O76036
  ENSP ID: ENSP00000477625
MSSTLPALLCVGLCLSQRISAQQQMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPDHALWDHTAQNLLRMGLAFLVLVALVWFLVEDWLSRKRTRERASRASTWEGRRRLNTQTL

SEQ ID NO: 55385 - protein, 215 aa, Homo sapiens
  Payload ID: 10935
  Gene Symbol: NCR1
  Gene Name: natural cytotoxicity triggering receptor 1
  ENSP ID: ENSP00000477939
MSSTLPALLCVETLPKPFIWAEPHFMVPKEKQVTICCQGNYGAVEYQLHFEGSLFAVDRPKPPERINKVQFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFP

SEQ ID NO: 55386 - protein, 227 aa, Homo sapiens
  Payload ID: 10935
  Gene Symbol: NCR1
  Gene Name: natural cytotoxicity triggering receptor 1
  ENSP ID: ENSP00000477986
MSSTLPALLCVGLCLSQRISAQQQTLPKPFIWAEPHFMVPKEKQVTICCQGNYGAVEYQLHFEGSLFAVDRPKPPERINKVQFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFP

SEQ ID NO: 55387 - protein, 215 aa, Homo sapiens; identical to SEQ ID NO: 55385
  Payload ID: 10935
  Gene Symbol: NCR1
  Gene Name: natural cytotoxicity triggering receptor 1
  ENSP ID: ENSP00000478204

SEQ ID NO: 55388 - protein, 227 aa, Homo sapiens; identical to SEQ ID NO: 55386
  Payload ID: 10935
  Gene Symbol: NCR1
  Gene Name: natural cytotoxicity triggering receptor 1
  ENSP ID: ENSP00000478444

SEQ ID NO: 55389 - protein, 132 aa, Homo sapiens
  Payload ID: 10935
  Gene Symbol: NCR1
  Gene Name: natural cytotoxicity triggering receptor 1
  ENSP ID: ENSP00000478452
MSSTLPALLCVGLCLSQRISAQQQMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFP

SEQ ID NO: 55390 - protein, 291 aa, Homo sapiens
  Payload ID: 10935
  Gene Symbol: NCR1
  Gene Name: natural cytotoxicity triggering receptor 1
  ENSP ID: ENSP00000478483
MSSTLPALLCVETLPKPFIWAEPHFMVPKEKQVTICCQGNYGAVEYQLHFEGSLFAVDRPKPPERINKVKFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPDTWGTYLLTTETGLQKDHALWDHTAQNLLRMGLAFLVLVALVWFLVEDWLSRKRTRERASRASTWEGRRRLNTQTL

SEQ ID NO: 55391 - protein, 304 aa, Homo sapiens
  Payload ID: 10935
  Gene Symbol: NCR1
  Gene Name: natural cytotoxicity triggering receptor 1
  Uniprot ID: O76036
  ENSP ID: ENSP00000478507
MSSTLPALLCVGLCLSQRISAQQQTLPKPFIWAEPHFMVPKEKQVTICCQGNYGAVEYQLHFEGSLFAVDRPKPPERINKVKFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPADTWGTYLLTTETGLQKDHALWDHTAQNLLRMGLAFLVLVALVWFLVEDWLSRKRTRERASRASTWEGRRRLNTQTL

SEQ ID NO: 55392 - protein, 227 aa, Homo sapiens; identical to SEQ ID NO: 55386
  Payload ID: 10935
  Gene Symbol: NCR1
  Gene Name: natural cytotoxicity triggering receptor 1
  ENSP ID: ENSP00000478527

SEQ ID NO: 55393 - protein, 304 aa, Homo sapiens; identical to SEQ ID NO: 55391
  Payload ID: 10935
  Gene Symbol: NCR1
  Gene Name: natural cytotoxicity triggering receptor 1
  ENSP ID: ENSP00000478731

SEQ ID NO: 55394 - protein, 227 aa, Homo sapiens; identical to SEQ ID NO: 55386
  Payload ID: 10935
  Gene Symbol: NCR1
  Gene Name: natural cytotoxicity triggering receptor 1
  ENSP ID: ENSP00000478855

SEQ ID NO: 55395 - protein, 287 aa, Homo sapiens
  Payload ID: 10935
  Gene Symbol: NCR1
  Gene Name: natural cytotoxicity triggering receptor 1
  ENSP ID: ENSP00000479048
MSSTLPALLCVGLCLSQRISAQQQTLPKPFIWAEPHFMVPKEKQVTICCQGNYGAVEYQLHFEGSLFAVDRPKPPERINKVKFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPDHALWDHTAQNLLRMGLAFLVLVALVWFLVEDWLSRKRTRERASRASTWEGRRRLNTQTL

SEQ ID NO: 55396 - protein, 120 aa, Homo sapiens
  Payload ID: 10935
  Gene Symbol: NCR1
  Gene Name: natural cytotoxicity triggering receptor 1
  ENSP ID: ENSP00000479161
MSSTLPALLCVEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFP

SEQ ID NO: 55397 - protein, 197 aa, Homo sapiens; identical to SEQ ID NO: 55381
  Payload ID: 10935
  Gene Symbol: NCR1
  Gene Name: natural cytotoxicity triggering receptor 1
  Uniprot ID: O76036
  ENSP ID: ENSP00000479222

SEQ ID NO: 55398 - protein, 132 aa, Homo sapiens; identical to SEQ ID NO: 55389
  Payload ID: 10935
  Gene Symbol: NCR1
  Gene Name: natural cytotoxicity triggering receptor 1
  ENSP ID: ENSP00000479368

SEQ ID NO: 55399 - protein, 197 aa, Homo sapiens; identical to SEQ ID NO: 55381
  Payload ID: 10935
  Gene Symbol: NCR1
  Gene Name: natural cytotoxicity triggering receptor 1
  Uniprot ID: O76036
  ENSP ID: ENSP00000479388

SEQ ID NO: 55400 - protein, 287 aa, Homo sapiens; identical to SEQ ID NO: 55395
  Payload ID: 10935
  Gene Symbol: NCR1
  Gene Name: natural cytotoxicity triggering receptor 1
  ENSP ID: ENSP00000479416

SEQ ID NO: 55401 - protein, 227 aa, Homo sapiens; identical to SEQ ID NO: 55386
  Payload ID: 10935
  Gene Symbol: NCR1
  Gene Name: natural cytotoxicity triggering receptor 1
  ENSP ID: ENSP00000479507

SEQ ID NO: 55402 - protein, 304 aa, Homo sapiens; identical to SEQ ID NO: 55391
  Payload ID: 10935
  Gene Symbol: NCR1
  Gene Name: natural cytotoxicity triggering receptor 1
  ENSP ID: ENSP00000479525

SEQ ID NO: 55403 - protein, 197 aa, Homo sapiens; identical to SEQ ID NO: 55381
  Payload ID: 10935
  Gene Symbol: NCR1
  Gene Name: natural cytotoxicity triggering receptor 1
  ENSP ID: ENSP00000479600

SEQ ID NO: 55404 - protein, 209 aa, Homo sapiens; identical to SEQ ID NO: 55380
  Payload ID: 10935
  Gene Symbol: NCR1
  Gene Name: natural cytotoxicity triggering receptor 1
  ENSP ID: ENSP00000479705

SEQ ID NO: 55405 - protein, 227 aa, Homo sapiens; identical to SEQ ID NO: 55386
  Payload ID: 10935
  Gene Symbol: NCR1
  Gene Name: natural cytotoxicity triggering receptor 1
  ENSP ID: ENSP00000479804

SEQ ID NO: 55406 - protein, 287 aa, Homo sapiens; identical to SEQ ID NO: 55395
  Payload ID: 10935
  Gene Symbol: NCR1
  Gene Name: natural cytotoxicity triggering receptor 1
  ENSP ID: ENSP00000479809

SEQ ID NO: 55407 - protein, 304 aa, Homo sapiens; identical to SEQ ID NO: 55391
  Payload ID: 10935
  Gene Symbol: NCR1
  Gene Name: natural cytotoxicity triggering receptor 1
  ENSP ID: ENSP00000480002

SEQ ID NO: 55408 - protein, 287 aa, Homo sapiens; identical to SEQ ID NO: 55395
  Payload ID: 10935
  Gene Symbol: NCR1
  Gene Name: natural cytotoxicity triggering receptor 1
  Uniprot ID: O76036
  ENSP ID: ENSP00000480010

SEQ ID NO: 55409 - protein, 197 aa, Homo sapiens; identical to SEQ ID NO: 55381
  Payload ID: 10935
  Gene Symbol: NCR1
  Gene Name: natural cytotoxicity triggering receptor 1
  Uniprot ID: O76036
  ENSP ID: ENSP00000480145

SEQ ID NO: 55410 - protein, 197 aa, Homo sapiens; identical to SEQ ID NO: 55381
  Payload ID: 10935
  Gene Symbol: NCR1
  Gene Name: natural cytotoxicity triggering receptor 1
  ENSP ID: ENSP00000480657

SEQ ID NO: 55411 - protein, 120 aa, Homo sapiens; identical to SEQ ID NO: 55396
  Payload ID: 10935
  Gene Symbol: NCR1
  Gene Name: natural cytotoxicity triggering receptor 1
  ENSP ID: ENSP00000480741

SEQ ID NO: 55412 - protein, 292 aa, Homo sapiens
  Payload ID: 10935
  Gene Symbol: NCR1
  Gene Name: natural cytotoxicity triggering receptor 1
  ENSP ID: ENSP00000480921
MSSTLPALLCVETLPKPFIWAEPHFMVPKEKQVTICCQGNYGAVEYQLHFEGSLFAVDRPKPPERINKVKFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPADTWGTYLLTTETGLQKDHALWDHTAQNLLRMGLAFLVLVALVWFLVEDWLSRKRTRERASRASTWEGRRRLNTQTL

SEQ ID NO: 55413 - protein, 304 aa, Homo sapiens; identical to SEQ ID NO: 55391
  Payload ID: 10935
  Gene Symbol: NCR1
  Gene Name: natural cytotoxicity triggering receptor 1
  ENSP ID: ENSP00000480947

SEQ ID NO: 55414 - protein, 215 aa, Homo sapiens; identical to SEQ ID NO: 55385
  Payload ID: 10935
  Gene Symbol: NCR1
  Gene Name: natural cytotoxicity triggering receptor 1
  ENSP ID: ENSP00000480950

SEQ ID NO: 55415 - protein, 132 aa, Homo sapiens; identical to SEQ ID NO: 55389
  Payload ID: 10935
  Gene Symbol: NCR1
  Gene Name: natural cytotoxicity triggering receptor 1
  ENSP ID: ENSP00000480962

SEQ ID NO: 55416 - protein, 287 aa, Homo sapiens; identical to SEQ ID NO: 55395
  Payload ID: 10935
  Gene Symbol: NCR1
  Gene Name: natural cytotoxicity triggering receptor 1
  ENSP ID: ENSP00000481235

SEQ ID NO: 55417 - protein, 215 aa, Homo sapiens; identical to SEQ ID NO: 55385
  Payload ID: 10935
  Gene Symbol: NCR1
  Gene Name: natural cytotoxicity triggering receptor 1
  ENSP ID: ENSP00000481370

SEQ ID NO: 55418 - protein, 291 aa, Homo sapiens; identical to SEQ ID NO: 55390
  Payload ID: 10935
  Gene Symbol: NCR1
  Gene Name: natural cytotoxicity triggering receptor 1
  ENSP ID: ENSP00000481479

SEQ ID NO: 55419 - protein, 209 aa, Homo sapiens; identical to SEQ ID NO: 55380
  Payload ID: 10935
  Gene Symbol: NCR1
  Gene Name: natural cytotoxicity triggering receptor 1
  Uniprot ID: O76036
  ENSP ID: ENSP00000481540

SEQ ID NO: 55420 - protein, 227 aa, Homo sapiens; identical to SEQ ID NO: 55386
  Payload ID: 10935
  Gene Symbol: NCR1
  Gene Name: natural cytotoxicity triggering receptor 1
  ENSP ID: ENSP00000481612

SEQ ID NO: 55421 - protein, 287 aa, Homo sapiens; identical to SEQ ID NO: 55395
  Payload ID: 10935
  Gene Symbol: NCR1
  Gene Name: natural cytotoxicity triggering receptor 1
  ENSP ID: ENSP00000481618

SEQ ID NO: 55422 - protein, 303 aa, Homo sapiens
  Payload ID: 10935
  Gene Symbol: NCR1
  Gene Name: natural cytotoxicity triggering receptor 1
  Uniprot ID: O76036
  ENSP ID: ENSP00000481692
MSSTLPALLCVGLCLSQRISAQQQTLPKPFIWAEPHFMVPKEKQVTICCQGNYGAVEYQLHFEGSLFAVDRPKPPERINKVKFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPDTWGTYLLTTETGLQKDHALWDHTAQNLLRMGLAFLVLVALVWFLVEDWLSRKRTRERASRASTWEGRRRLNTQTL

SEQ ID NO: 55423 - protein, 304 aa, Homo sapiens; identical to SEQ ID NO: 55391
  Payload ID: 10935
  Gene Symbol: NCR1
  Gene Name: natural cytotoxicity triggering receptor 1
  ENSP ID: ENSP00000481747

SEQ ID NO: 55424 - protein, 120 aa, Homo sapiens; identical to SEQ ID NO: 55396
  Payload ID: 10935
  Gene Symbol: NCR1
  Gene Name: natural cytotoxicity triggering receptor 1
  ENSP ID: ENSP00000481792

SEQ ID NO: 55425 - protein, 304 aa, Homo sapiens; identical to SEQ ID NO: 55391
  Payload ID: 10935
  Gene Symbol: NCR1
  Gene Name: natural cytotoxicity triggering receptor 1
  Uniprot ID: O76036
  ENSP ID: ENSP00000481971

SEQ ID NO: 55426 - protein, 227 aa, Homo sapiens; identical to SEQ ID NO: 55386
  Payload ID: 10935
  Gene Symbol: NCR1
  Gene Name: natural cytotoxicity triggering receptor 1
  ENSP ID: ENSP00000482071

SEQ ID NO: 55427 - protein, 197 aa, Homo sapiens; identical to SEQ ID NO: 55381
  Payload ID: 10935
  Gene Symbol: NCR1
  Gene Name: natural cytotoxicity triggering receptor 1
  Uniprot ID: O76036
  ENSP ID: ENSP00000482092

SEQ ID NO: 55428 - protein, 209 aa, Homo sapiens; identical to SEQ ID NO: 55380
  Payload ID: 10935
  Gene Symbol: NCR1
  Gene Name: natural cytotoxicity triggering receptor 1
  ENSP ID: ENSP00000482189

SEQ ID NO: 55429 - protein, 227 aa, Homo sapiens; identical to SEQ ID NO: 55386
  Payload ID: 10935
  Gene Symbol: NCR1
  Gene Name: natural cytotoxicity triggering receptor 1
  ENSP ID: ENSP00000482342

SEQ ID NO: 55430 - protein, 197 aa, Homo sapiens; identical to SEQ ID NO: 55381
  Payload ID: 10935
  Gene Symbol: NCR1
  Gene Name: natural cytotoxicity triggering receptor 1
  ENSP ID: ENSP00000482380

SEQ ID NO: 55431 - protein, 304 aa, Homo sapiens; identical to SEQ ID NO: 55391
  Payload ID: 10935
  Gene Symbol: NCR1
  Gene Name: natural cytotoxicity triggering receptor 1
  Uniprot ID: O76036
  ENSP ID: ENSP00000482423

SEQ ID NO: 55432 - protein, 303 aa, Homo sapiens; identical to SEQ ID NO: 55422
  Payload ID: 10935
  Gene Symbol: NCR1
  Gene Name: natural cytotoxicity triggering receptor 1
  Uniprot ID: O76036
  ENSP ID: ENSP00000482536

SEQ ID NO: 55433 - protein, 209 aa, Homo sapiens; identical to SEQ ID NO: 55380
  Payload ID: 10935
  Gene Symbol: NCR1
  Gene Name: natural cytotoxicity triggering receptor 1
  ENSP ID: ENSP00000482541

SEQ ID NO: 55434 - protein, 209 aa, Homo sapiens; identical to SEQ ID NO: 55380
  Payload ID: 10935
  Gene Symbol: NCR1
  Gene Name: natural cytotoxicity triggering receptor 1
  Uniprot ID: O76036
  ENSP ID: ENSP00000482554

SEQ ID NO: 55435 - protein, 197 aa, Homo sapiens; identical to SEQ ID NO: 55381
  Payload ID: 10935
  Gene Symbol: NCR1
  Gene Name: natural cytotoxicity triggering receptor 1
  ENSP ID: ENSP00000482677

SEQ ID NO: 55436 - protein, 209 aa, Homo sapiens; identical to SEQ ID NO: 55380
  Payload ID: 10935
  Gene Symbol: NCR1
  Gene Name: natural cytotoxicity triggering receptor 1
  Uniprot ID: O76036
  ENSP ID: ENSP00000483028

SEQ ID NO: 55437 - protein, 209 aa, Homo sapiens; identical to SEQ ID NO: 55380
  Payload ID: 10935
  Gene Symbol: NCR1
  Gene Name: natural cytotoxicity triggering receptor 1
  ENSP ID: ENSP00000483184

SEQ ID NO: 55438 - protein, 304 aa, Homo sapiens; identical to SEQ ID NO: 55391
  Payload ID: 10935
  Gene Symbol: NCR1
  Gene Name: natural cytotoxicity triggering receptor 1
  Uniprot ID: O76036
  ENSP ID: ENSP00000483452

SEQ ID NO: 55439 - protein, 287 aa, Homo sapiens; identical to SEQ ID NO: 55395
  Payload ID: 10935
  Gene Symbol: NCR1
  Gene Name: natural cytotoxicity triggering receptor 1
  Uniprot ID: O76036
  ENSP ID: ENSP00000483611

SEQ ID NO: 55440 - protein, 287 aa, Homo sapiens; identical to SEQ ID NO: 55395
  Payload ID: 10935
  Gene Symbol: NCR1
  Gene Name: natural cytotoxicity triggering receptor 1
  Uniprot ID: O76036
  ENSP ID: ENSP00000483723

SEQ ID NO: 55441 - protein, 215 aa, Homo sapiens; identical to SEQ ID NO: 55385
  Payload ID: 10935
  Gene Symbol: NCR1
  Gene Name: natural cytotoxicity triggering receptor 1
  ENSP ID: ENSP00000483780

SEQ ID NO: 55442 - protein, 227 aa, Homo sapiens; identical to SEQ ID NO: 55386
  Payload ID: 10935
  Gene Symbol: NCR1
  Gene Name: natural cytotoxicity triggering receptor 1
  ENSP ID: ENSP00000483810

SEQ ID NO: 55443 - protein, 197 aa, Homo sapiens; identical to SEQ ID NO: 55381
  Payload ID: 10935
  Gene Symbol: NCR1
  Gene Name: natural cytotoxicity triggering receptor 1
  ENSP ID: ENSP00000483840

SEQ ID NO: 55444 - protein, 287 aa, Homo sapiens; identical to SEQ ID NO: 55395
  Payload ID: 10935
  Gene Symbol: NCR1
  Gene Name: natural cytotoxicity triggering receptor 1
  Uniprot ID: O76036
  ENSP ID: ENSP00000484067

SEQ ID NO: 55445 - protein, 304 aa, Homo sapiens; identical to SEQ ID NO: 55391
  Payload ID: 10935
  Gene Symbol: NCR1
  Gene Name: natural cytotoxicity triggering receptor 1
  Uniprot ID: O76036
  ENSP ID: ENSP00000484071

SEQ ID NO: 55446 - protein, 304 aa, Homo sapiens; identical to SEQ ID NO: 55391
  Payload ID: 10935
  Gene Symbol: NCR1
  Gene Name: natural cytotoxicity triggering receptor 1
  Uniprot ID: O76036
  ENSP ID: ENSP00000484221

SEQ ID NO: 55447 - protein, 120 aa, Homo sapiens; identical to SEQ ID NO: 55396
  Payload ID: 10935
  Gene Symbol: NCR1
  Gene Name: natural cytotoxicity triggering receptor 1
  ENSP ID: ENSP00000484235

SEQ ID NO: 55448 - protein, 209 aa, Homo sapiens; identical to SEQ ID NO: 55380
  Payload ID: 10935
  Gene Symbol: NCR1
  Gene Name: natural cytotoxicity triggering receptor 1
  Uniprot ID: O76036
  ENSP ID: ENSP00000484377

SEQ ID NO: 55449 - protein, 304 aa, Homo sapiens; identical to SEQ ID NO: 55391
  Payload ID: 10935
  Gene Symbol: NCR1
  Gene Name: natural cytotoxicity triggering receptor 1
  Uniprot ID: O76036
  ENSP ID: ENSP00000484520

SEQ ID NO: 55450 - protein, 209 aa, Homo sapiens; identical to SEQ ID NO: 55380
  Payload ID: 10935
  Gene Symbol: NCR1
  Gene Name: natural cytotoxicity triggering receptor 1
  ENSP ID: ENSP00000484779

SEQ ID NO: 55451 - protein, 192 aa, Homo sapiens; identical to SEQ ID NO: 55384
  Payload ID: 10935
  Gene Symbol: NCR1
  Gene Name: natural cytotoxicity triggering receptor 1
  Uniprot ID: O76036
  ENSP ID: ENSP00000484831

SEQ ID NO: 55452 - protein, 132 aa, Homo sapiens; identical to SEQ ID NO: 55389
  Payload ID: 10935
  Gene Symbol: NCR1
  Gene Name: natural cytotoxicity triggering receptor 1
  ENSP ID: ENSP00000484847

SEQ ID NO: 55453 - protein, 132 aa, Homo sapiens; identical to SEQ ID NO: 55389
  Payload ID: 10935
  Gene Symbol: NCR1
  Gene Name: natural cytotoxicity triggering receptor 1
  ENSP ID: ENSP00000484989

SEQ ID NO: 55454 - protein, 258 aa, Homo sapiens
  Payload ID: 10936
  Gene Symbol: NCR2
  Gene Name: natural cytotoxicity triggering receptor 2
  Uniprot ID: O95944
  ENSP ID: ENSP00000362175
MAWRALHPLLLLLLLFPGSQAQSKAQVLQSVAGQTLTVRCQYPPTGSLYEKKGWCKEASALVCIRLVTSSKPRTMAWTSRFTIWDDPDAGFFTVTMTDLREEDSGHYWCRIYRPSDNSVSKSVRFYLVVSPASASTQTSWTPRDLVSSQTQTQSCVPPTAGARQAPESPSTIPVPSQPQNSTLRPGPAAPIALVPVFCGLLVAKSLVLSALLVWWVLRNRHMQHQGRSLLHPAQPRPQAHRHFPLSHRAPGGTYGGKP

SEQ ID NO: 55455 - protein, 270 aa, Homo sapiens
  Payload ID: 10936
  Gene Symbol: NCR2
  Gene Name: natural cytotoxicity triggering receptor 2
  Uniprot ID: O95944
  ENSP ID: ENSP00000362178
MAWRALHPLLLLLLLFPGSQAQSKAQVLQSVAGQTLTVRCQYPPTGSLYEKKGWCKEASALVCIRLVTSSKPRTMAWTSRFTIWDDPDAGFFTVTMTDLREEDSGHYWCRIYRPSDNSVSKSVRFYLVVSPASASTQTSWTPRDLVSSQTQTQSCVPPTAGARQAPESPSTIPVPSHPSSPLPVPLPSRPQNSTLRPGPAAPIALVPVFCGLLVAKSLVLSALLVWWVLRNRHMQHQGRSLLHPAQPRPQAHRHFPLSHRAPGGTYGGKP

SEQ ID NO: 55456 - protein, 276 aa, Homo sapiens
  Payload ID: 10936
  Gene Symbol: NCR2
  Gene Name: natural cytotoxicity triggering receptor 2
  Uniprot ID: O95944
  ENSP ID: ENSP00000362181
MAWRALHPLLLLLLLFPGSQAQSKAQVLQSVAGQTLTVRCQYPPTGSLYEKKGWCKEASALVCIRLVTSSKPRTMAWTSRFTIWDDPDAGFFTVTMTDLREEDSGHYWCRIYRPSDNSVSKSVRFYLVVSPASASTQTSWTPRDLVSSQTQTQSCVPPTAGARQAPESPSTIPVPSQPQNSTLRPGPAAPIALVPVFCGLLVAKSLVLSALLVWWGDIWWKTMMELRSLDTQKATCHLQQVTDLPWTSVSSPVEREILYHTVARTKISDDDDEHTL

SEQ ID NO: 55457 - protein, 201 aa, Homo sapiens
  Payload ID: 10937
  Gene Symbol: NCR3
  Gene Name: natural cytotoxicity triggering receptor 3
  Uniprot ID: O14931
  ENSP ID: ENSP00000342156
MAWMLLLILIMVHPGSCALWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 55458 - protein, 165 aa, Homo sapiens
  Payload ID: 10937
  Gene Symbol: NCR3
  Gene Name: natural cytotoxicity triggering receptor 3
  Uniprot ID: O14931
  ENSP ID: ENSP00000365239
MAWMLLLILIMVHPGSCALWVSQPPEIRTLEGSSAFLPCSFNASQGRLAIGSVTWFRDEVVPGKEAELHIRDVRGHDASIYVCRVEVLGLGVGTGNGTRLVVEKEHPQLGAGTVLLLRAGFYAVSFLSVAVGSTVYYQGKCHCHMGTHCHSSDGPRGVIPEPRCP

SEQ ID NO: 55459 - protein, 190 aa, Homo sapiens
  Payload ID: 10937
  Gene Symbol: NCR3
  Gene Name: natural cytotoxicity triggering receptor 3
  Uniprot ID: O14931
  ENSP ID: ENSP00000365240
MAWMLLLILIMVHPGSCALWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCHCHMGTHCHSSDGPRGVIPEPRCP

SEQ ID NO: 55460 - protein, 177 aa, Homo sapiens
  Payload ID: 10937
  Gene Symbol: NCR3
  Gene Name: natural cytotoxicity triggering receptor 3
  Uniprot ID: O14931
  ENSP ID: ENSP00000365241
MAWMLLLILIMVHPGSCALWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKYAKSTLSGFPQL

SEQ ID NO: 55461 - protein, 190 aa, Homo sapiens; identical to SEQ ID NO: 55459
  Payload ID: 10937
  Gene Symbol: NCR3
  Gene Name: natural cytotoxicity triggering receptor 3
  Uniprot ID: O14931
  ENSP ID: ENSP00000372968

SEQ ID NO: 55462 - protein, 201 aa, Homo sapiens; identical to SEQ ID NO: 55457
  Payload ID: 10937
  Gene Symbol: NCR3
  Gene Name: natural cytotoxicity triggering receptor 3
  Uniprot ID: O14931
  ENSP ID: ENSP00000372969

SEQ ID NO: 55463 - protein, 177 aa, Homo sapiens; identical to SEQ ID NO: 55460
  Payload ID: 10937
  Gene Symbol: NCR3
  Gene Name: natural cytotoxicity triggering receptor 3
  Uniprot ID: O14931
  ENSP ID: ENSP00000372970

SEQ ID NO: 55464 - protein, 165 aa, Homo sapiens; identical to SEQ ID NO: 55458
  Payload ID: 10937
  Gene Symbol: NCR3
  Gene Name: natural cytotoxicity triggering receptor 3
  Uniprot ID: O14931
  ENSP ID: ENSP00000383100

SEQ ID NO: 55465 - protein, 201 aa, Homo sapiens; identical to SEQ ID NO: 55457
  Payload ID: 10937
  Gene Symbol: NCR3
  Gene Name: natural cytotoxicity triggering receptor 3
  Uniprot ID: O14931
  ENSP ID: ENSP00000389071

SEQ ID NO: 55466 - protein, 177 aa, Homo sapiens; identical to SEQ ID NO: 55460
  Payload ID: 10937
  Gene Symbol: NCR3
  Gene Name: natural cytotoxicity triggering receptor 3
  Uniprot ID: O14931
  ENSP ID: ENSP00000389396

SEQ ID NO: 55467 - protein, 190 aa, Homo sapiens; identical to SEQ ID NO: 55459
  Payload ID: 10937
  Gene Symbol: NCR3
  Gene Name: natural cytotoxicity triggering receptor 3
  Uniprot ID: O14931
  ENSP ID: ENSP00000389419

SEQ ID NO: 55468 - protein, 201 aa, Homo sapiens; identical to SEQ ID NO: 55457
  Payload ID: 10937
  Gene Symbol: NCR3
  Gene Name: natural cytotoxicity triggering receptor 3
  Uniprot ID: O14931
  ENSP ID: ENSP00000390131

SEQ ID NO: 55469 - protein, 177 aa, Homo sapiens; identical to SEQ ID NO: 55460
  Payload ID: 10937
  Gene Symbol: NCR3
  Gene Name: natural cytotoxicity triggering receptor 3
  Uniprot ID: O14931
  ENSP ID: ENSP00000391177

SEQ ID NO: 55470 - protein, 177 aa, Homo sapiens; identical to SEQ ID NO: 55460
  Payload ID: 10937
  Gene Symbol: NCR3
  Gene Name: natural cytotoxicity triggering receptor 3
  Uniprot ID: O14931
  ENSP ID: ENSP00000395238

SEQ ID NO: 55471 - protein, 201 aa, Homo sapiens; identical to SEQ ID NO: 55457
  Payload ID: 10937
  Gene Symbol: NCR3
  Gene Name: natural cytotoxicity triggering receptor 3
  Uniprot ID: O14931
  ENSP ID: ENSP00000398313

SEQ ID NO: 55472 - protein, 190 aa, Homo sapiens; identical to SEQ ID NO: 55459
  Payload ID: 10937
  Gene Symbol: NCR3
  Gene Name: natural cytotoxicity triggering receptor 3
  Uniprot ID: O14931
  ENSP ID: ENSP00000399128

SEQ ID NO: 55473 - protein, 190 aa, Homo sapiens; identical to SEQ ID NO: 55459
  Payload ID: 10937
  Gene Symbol: NCR3
  Gene Name: natural cytotoxicity triggering receptor 3
  Uniprot ID: O14931
  ENSP ID: ENSP00000402904

SEQ ID NO: 55474 - protein, 190 aa, Homo sapiens; identical to SEQ ID NO: 55459
  Payload ID: 10937
  Gene Symbol: NCR3
  Gene Name: natural cytotoxicity triggering receptor 3
  Uniprot ID: O14931
  ENSP ID: ENSP00000403978

SEQ ID NO: 55475 - protein, 190 aa, Homo sapiens; identical to SEQ ID NO: 55459
  Payload ID: 10937
  Gene Symbol: NCR3
  Gene Name: natural cytotoxicity triggering receptor 3
  Uniprot ID: O14931
  ENSP ID: ENSP00000404747

SEQ ID NO: 55476 - protein, 201 aa, Homo sapiens; identical to SEQ ID NO: 55457
  Payload ID: 10937
  Gene Symbol: NCR3
  Gene Name: natural cytotoxicity triggering receptor 3
  Uniprot ID: O14931
  ENSP ID: ENSP00000405306

SEQ ID NO: 55477 - protein, 165 aa, Homo sapiens; identical to SEQ ID NO: 55458
  Payload ID: 10937
  Gene Symbol: NCR3
  Gene Name: natural cytotoxicity triggering receptor 3
  Uniprot ID: O14931
  ENSP ID: ENSP00000406373

SEQ ID NO: 55478 - protein, 177 aa, Homo sapiens; identical to SEQ ID NO: 55460
  Payload ID: 10937
  Gene Symbol: NCR3
  Gene Name: natural cytotoxicity triggering receptor 3
  Uniprot ID: O14931
  ENSP ID: ENSP00000408960

SEQ ID NO: 55479 - protein, 165 aa, Homo sapiens; identical to SEQ ID NO: 55458
  Payload ID: 10937
  Gene Symbol: NCR3
  Gene Name: natural cytotoxicity triggering receptor 3
  Uniprot ID: O14931
  ENSP ID: ENSP00000409048

SEQ ID NO: 55480 - protein, 177 aa, Homo sapiens; identical to SEQ ID NO: 55460
  Payload ID: 10937
  Gene Symbol: NCR3
  Gene Name: natural cytotoxicity triggering receptor 3
  Uniprot ID: O14931
  ENSP ID: ENSP00000409874

SEQ ID NO: 55481 - protein, 177 aa, Homo sapiens; identical to SEQ ID NO: 55460
  Payload ID: 10937
  Gene Symbol: NCR3
  Gene Name: natural cytotoxicity triggering receptor 3
  Uniprot ID: O14931
  ENSP ID: ENSP00000411205

SEQ ID NO: 55482 - protein, 165 aa, Homo sapiens; identical to SEQ ID NO: 55458
  Payload ID: 10937
  Gene Symbol: NCR3
  Gene Name: natural cytotoxicity triggering receptor 3
  Uniprot ID: O14931
  ENSP ID: ENSP00000412474

SEQ ID NO: 55483 - protein, 190 aa, Homo sapiens; identical to SEQ ID NO: 55459
  Payload ID: 10937
  Gene Symbol: NCR3
  Gene Name: natural cytotoxicity triggering receptor 3
  Uniprot ID: O14931
  ENSP ID: ENSP00000412702

SEQ ID NO: 55484 - protein, 165 aa, Homo sapiens; identical to SEQ ID NO: 55458
  Payload ID: 10937
  Gene Symbol: NCR3
  Gene Name: natural cytotoxicity triggering receptor 3
  Uniprot ID: O14931
  ENSP ID: ENSP00000415456

SEQ ID NO: 55485 - protein, 165 aa, Homo sapiens; identical to SEQ ID NO: 55458
  Payload ID: 10937
  Gene Symbol: NCR3
  Gene Name: natural cytotoxicity triggering receptor 3
  Uniprot ID: O14931
  ENSP ID: ENSP00000415697

SEQ ID NO: 55486 - protein, 201 aa, Homo sapiens; identical to SEQ ID NO: 55457
  Payload ID: 10937
  Gene Symbol: NCR3
  Gene Name: natural cytotoxicity triggering receptor 3
  Uniprot ID: O14931
  ENSP ID: ENSP00000416035

SEQ ID NO: 55487 - protein, 165 aa, Homo sapiens; identical to SEQ ID NO: 55458
  Payload ID: 10937
  Gene Symbol: NCR3
  Gene Name: natural cytotoxicity triggering receptor 3
  Uniprot ID: O14931
  ENSP ID: ENSP00000416105

SEQ ID NO: 55488 - protein, 201 aa, Homo sapiens; identical to SEQ ID NO: 55457
  Payload ID: 10937
  Gene Symbol: NCR3
  Gene Name: natural cytotoxicity triggering receptor 3
  Uniprot ID: O14931
  ENSP ID: ENSP00000416944

SEQ ID NO: 55489 - protein, 115 aa, Homo sapiens
  Payload ID: 10937
  Gene Symbol: NCR3
  Gene Name: natural cytotoxicity triggering receptor 3
  ENSP ID: ENSP00000431193
MAWMLLLILIMVHPGSCALWVSQPPEIRTLEGSSAFLPCSFNASQGRLAIGSVTWFRDEVVPGKEVRNGTPEFRGRLAPLASSRFLHDHQAELHIRDVRGHDASIYVCRVENILS

SEQ ID NO: 55490 - protein, 115 aa, Homo sapiens; identical to SEQ ID NO: 55489
  Payload ID: 10937
  Gene Symbol: NCR3
  Gene Name: natural cytotoxicity triggering receptor 3
  ENSP ID: ENSP00000431646

SEQ ID NO: 55491 - protein, 115 aa, Homo sapiens; identical to SEQ ID NO: 55489
  Payload ID: 10937
  Gene Symbol: NCR3
  Gene Name: natural cytotoxicity triggering receptor 3
  ENSP ID: ENSP00000432120

SEQ ID NO: 55492 - protein, 115 aa, Homo sapiens; identical to SEQ ID NO: 55489
  Payload ID: 10937
  Gene Symbol: NCR3
  Gene Name: natural cytotoxicity triggering receptor 3
  ENSP ID: ENSP00000432357

SEQ ID NO: 55493 - protein, 115 aa, Homo sapiens; identical to SEQ ID NO: 55489
  Payload ID: 10937
  Gene Symbol: NCR3
  Gene Name: natural cytotoxicity triggering receptor 3
  ENSP ID: ENSP00000432961

SEQ ID NO: 55494 - protein, 115 aa, Homo sapiens; identical to SEQ ID NO: 55489
  Payload ID: 10937
  Gene Symbol: NCR3
  Gene Name: natural cytotoxicity triggering receptor 3
  ENSP ID: ENSP00000433448

SEQ ID NO: 55495 - protein, 115 aa, Homo sapiens; identical to SEQ ID NO: 55489
  Payload ID: 10937
  Gene Symbol: NCR3
  Gene Name: natural cytotoxicity triggering receptor 3
  ENSP ID: ENSP00000437322

SEQ ID NO: 55496 - protein, 454 aa, Homo sapiens
  Payload ID: 10938
  Gene Symbol: NCR3LG1
  Gene Name: natural killer cell cytotoxicity receptor 3 ligand 1
  Uniprot ID: Q68D85
  ENSP ID: ENSP00000341637
MTWRAAASTCAALLILLWALTTEGDLKVEMMAGGTQITPLNDNVTIFCNIFYSQPLNITSMGITWFWKSLTFDKEVKVFEFFGDHQEAFRPGAIVSPWRLKSGDASLRLPGIQLEEAGEYRCEVVVTPLKAQGTVQLEVVASPASRLLLDQVGMKENEDKYMCESSGFYPEAINITWEKQTQKFPHPIEISEDVITGPTIKNMDGTFNVTSCLKLNSSQEDPGTVYQCVVRHASLHTPLRSNFTLTAARHSLSETEKTDNFSIHWWPISFIGVGLVLLIVLIPWKKICNKSSSAYTPLKCILKHWNSFDTQTLKKEHLIFFCTRAWPSYQLQDGEAWPPEGSVNINTIQQLDVFCRQEGKWSEVPYVQAFFALRDNPDLCQCCRIDPALLTVTSGKSIDDNSTKSEKQTPREHSDAVPDAPILPVSPIWEPPPATTSTTPVLSSQPPTLLLPLQ

SEQ ID NO: 55497 - protein, 454 aa, Homo sapiens; identical to SEQ ID NO: 55496
  Payload ID: 10938
  Gene Symbol: NCR3LG1
  Gene Name: natural killer cell cytotoxicity receptor 3 ligand 1
  Uniprot ID: Q68D85
  ENSP ID: ENSP00000434394

SEQ ID NO: 55498 - protein, 165 aa, Homo sapiens
  Payload ID: 10939
  Gene Symbol: NKG7
  Gene Name: natural killer cell granule protein 7
  Uniprot ID: Q16617
  ENSP ID: ENSP00000221978
MELCRSLALLGGSLGLMFCLIALSTDFWFEAVGPTHSAHSGLWPTGHGDIISGYIHVTQTFSIMAVLWALVSVSFLVLSCFPSLFPPGHGPLVSTTAAFAAAISMVVAMAVYTSERWDQPPHPQIQTFFSWSFYLGWVSAILLLCTGALSLGAHCGGPRPGYETL

SEQ ID NO: 55499 - protein, 142 aa, Homo sapiens
  Payload ID: 10939
  Gene Symbol: NKG7
  Gene Name: natural killer cell granule protein 7
  ENSP ID: ENSP00000468910
MELCRSLALLGGSLGLMFCLIALSTDFWFEAVGPTHSAHSGLWPTGHGDIISGHGPLVSTTAAFAAGKDSGLDWGIASQRIPAEELSHLSCPCPQPSPWWWPWRCTPASGGTSLHTPRSRPSSPGPSTWAGSQLSSCSVQVP

SEQ ID NO: 55500 - protein, 85 aa, Homo sapiens
  Payload ID: 10939
  Gene Symbol: NKG7
  Gene Name: natural killer cell granule protein 7
  ENSP ID: ENSP00000469370
MELCRSLALLGGSLGLMFCLIALSTDFWFEAVGPTHSAHSGLWPTGHGDIISGHGPLVSTTAAFAAGALSLGAHCGGPRPGYETL

SEQ ID NO: 55501 - protein, 89 aa, Homo sapiens
  Payload ID: 10939
  Gene Symbol: NKG7
  Gene Name: natural killer cell granule protein 7
  ENSP ID: ENSP00000471163
  MOD_RES (1)..(1): Any amino acid
XWPTGHGDIISGHGPLVSTTAAFAAAISMVVAMAVYTSERWDQPPHPQIQTFFSWSFYLGWVSAILLLCTGALSLGAHCGGPRPGYETL

SEQ ID NO: 55502 - protein, 72 aa, Homo sapiens
  Payload ID: 10939
  Gene Symbol: NKG7
  Gene Name: natural killer cell granule protein 7
  ENSP ID: ENSP00000473204
TGHGDIISAISMVVAMAVYTSERWDQPPHPQIQTFFSWSFYLGWVSAILLLCTGALSLGAHCGGPRPGYETL

SEQ ID NO: 55503 - protein, 1462 aa, Homo sapiens
  Payload ID: 10940
  Gene Symbol: NKTR
  Gene Name: natural killer cell triggering receptor
  Uniprot ID: P30414
  ENSP ID: ENSP00000232978
MGAQDRPQCHFDIEINREPVGRIMFQLFSDICPKTCKNFLCLCSGEKGLGKTTGKKLCYKGSTFHRVVKNFMIQGGDFSEGNGKGGESIYGGYFKDENFILKHDRAFLLSMANRGKHTNGSQFFITTKPAPHLDGVHVVFGLVISGFEVIEQIENLKTDAASRPYADVRVIDCGVLATKSIKDVFEKKRKKPTHSEGSDSSSNSSSSSESSSESELEHERSRRRKHKRRPKVKRSKKRRKEASSSEEPRNKHAMNPKGHSERSDTNEKRSVDSSAKREKPVVRPEEIPPVPENRFLLRRDMPVVTAEPEPKIPDVAPIVSDQKPSVSKSGRKIKGRGTIRYHTPPRSRSCSESDDDDSSETPPHWKEEMQRLRAYRPPSGEKWSKGDKLSDPCSSRWDERSLSQRSRSWSYNGYYSDLSTARHSGHHKKRRKEKKVKHKKKGKKQKHCRRHKQTKKRRILIPSDIESSKSSTRRMKSSCDRERSSRSSSLSSHHSSKRDWSKSDKDVQSSLTHSSRDSYRSKSHSQSYSRGSSRSRTASKSSSHSRSRSKSRSSSKSGHRKRASKSPRKTASQLSENKPVKTEPLRATMAQNENVVVQPVVAENIPVIPLSDSPPPSRWKPGQKPWKPSYERIQEMKAKTTHLLPIQSTYSLANIKETGSSSSYHKREKNSESDQSTYSKYSDRSSESSPRSRSRSSRSRSYSRSYTRSRSLASSHSRSRSPSSRSHSRNKYSDHSQCSRSSSYTSISSDDGRRAKRRLRSSGKKNSVSHKKHSSSSEKTLHSKYVKGRDRSSCVRKYSESRSSLDYSSDSEQSSVQATQSAQEKEKQGQMERTHNKQEKNRGEEKSKSERECPHSKKRTLKENLSDHLRNGSKPKRKNYAGSKWDSESNSERDVTKNSKNDSHPSSDKEEGEATSDSESEVSEIHIKVKPTTKSSTNTSLPDDNGAWKSSKQRTSTSDSEGSCSNSENNRGKPQKHKHGSKENLKREHTKKVKEKLKGKKDKKHKAPKRKQAFHWQPPLEFGEEEEEEIDDKQVTQESKEKKVSENNETIKDNILKTEKSSEEDLSGKHDTVTVSSDLDQFTKDDSKLSISPTALNTEENVACLQNIQHVEESVPNGVEDVLQTDDNMEICTPDRSSPAKVEETSPLGNARLDTPDINIVLKQDMATEHPQAEVVKQESSMSESKVLGEVGKQDSSSASLASAGESTGKKEVAEKSQINLIDKKWKPLQGVGNLAAPNAATSSAVEVKVLTTVPEMKPQGLRIEIKSKNKVRPGSLFDEVRKTARLNRRPRNQESSSDEQTPSRDDDSQSRSPSRSRSKSETKSRHRTRSVSYSHSRSRSRSSTSSYRSRSYSRSRSRGWYSRGRTRSRSSSYRSYKSHRTSSRSRSRSSSYDPHSRSRSYTYDSYYSRSRSRSRSQRSDSYHRGRSYNRRSRSCRSYGSDSESDRSYSHHRSPSESSRYS

SEQ ID NO: 55504 - protein, 105 aa, Homo sapiens
  Payload ID: 10940
  Gene Symbol: NKTR
  Gene Name: natural killer cell triggering receptor
  ENSP ID: ENSP00000390259
MGAQDRPQCHFDIEINREPVGRIMFQLFSDICPKTCKNFLCLCSGEKGLGKTTGKKLCYKGSTFHRVVKNFMIQGGDFSEGNGKGGESIYGGYFKENVVFCKMKR

SEQ ID NO: 55505 - protein, 105 aa, Homo sapiens; identical to SEQ ID NO: 55504
  Payload ID: 10940
  Gene Symbol: NKTR
  Gene Name: natural killer cell triggering receptor
  ENSP ID: ENSP00000404802

SEQ ID NO: 55506 - protein, 104 aa, Homo sapiens
  Payload ID: 10940
  Gene Symbol: NKTR
  Gene Name: natural killer cell triggering receptor
  ENSP ID: ENSP00000408660
MGAQDRPQCHFDIEINREPVGRIMFQLFSDICPKTCKNFLCLCSGEKGLGKTTGKKLCYKGSTFHRVVKNFMIQGGDFSEGNGKGGESIYGGYFKENVVFCKMK

SEQ ID NO: 55507 - protein, 1162 aa, Homo sapiens [sequence omitted]

SEQ ID NO: 55508 - protein, 99 aa, Homo sapiens
  Payload ID: 10941
  Gene Symbol: NCBP2-AS2
  Gene Name: NCBP2 antisense RNA 2 (head to head)
  Uniprot ID: Q69YL0
  ENSP ID: ENSP00000488305
MVLRRLLAALLHSPQLVERLSESRPIRRAAQLTAFALLQAQLRGQDAARRLQDLAAGPVGSLCRRAERFRDAFTQELRRGLRGRSGPPPGSQRGPGANI

SEQ ID NO: 55509 - protein, 377 aa, Homo sapiens
  Payload ID: 10942
  Gene Symbol: NCK1
  Gene Name: NCK adaptor protein 1
  Uniprot ID: P16333
  ENSP ID: ENSP00000288986
MAEEVVVVAKFDYVAQQEQELDIKKNERLWLLDDSKSWWRVRNSMNKTGFVPSNYVERKNSARKASIVKNLKDTLGIGKVKRKPSVPDSASPADDSFVDPGERLYDLNMPAYVKFNYMAEREDELSLIKGTKVIVMEKCSDGWWRGSYNGQVGWFPSNYVTEEGDSPLGDHVGSLSEKLAAVVNNLNTGQVLHVVQALYPFSSSNDEELNFEKGDVMDVIEKPENDPEWWKCRKINGMVGLVPKNYVTVMQNNPLTSGLEPSPPQCDYIRPSLTGKFAGNPWYYGKVTRHQAEMALNERGHEGDFLIRDSESSPNDFSVSLKAQGKNKHFKVQLKETVYCIGQRKFSTMEELVEHYKKAPIFTSEQGEKLYLVKHLS

SEQ ID NO: 55510 - protein, 377 aa, Homo sapiens; identical to SEQ ID NO: 55509
  Payload ID: 10942
  Gene Symbol: NCK1
  Gene Name: NCK adaptor protein 1
  Uniprot ID: P16333
  ENSP ID: ENSP00000417273

SEQ ID NO: 55511 - protein, 162 aa, Homo sapiens
  Payload ID: 10942
  Gene Symbol: NCK1
  Gene Name: NCK adaptor protein 1
  ENSP ID: ENSP00000417729
MAEEVVVVAKFDYVAQQEQELDIKKNERLWLLDDSKSWWRVRNSMNKTGFVPSNYVERKNSARKASIVKNLKDTLGIGKVKRKPSVPDSASPADDSFVDPGERLYDLNMPAYVKFNYMAEREDELSLIKGTKVWNHHLHSVITLGLHSLESLLAILGIMAKS

SEQ ID NO: 55512 - protein, 174 aa, Homo sapiens
  Payload ID: 10942
  Gene Symbol: NCK1
  Gene Name: NCK adaptor protein 1
  ENSP ID: ENSP00000418060
MDWLNVFKDFFSIGKVKRKPSVPDSASPADDSFVDPGERLYDLNMPAYVKFNYMAEREDELSLIKGTKCDYIRPSLTGKFAGNPWYYGKVTRHQAEMALNERGHEGDFLIRDSESSPNDFSVSLKAQGKNKHFKVQLKETVYCIGQRKFSTMEELVEHYKKAPIFTSEQGEKLY

SEQ ID NO: 55513 - protein, 75 aa, Homo sapiens
  Payload ID: 10942
  Gene Symbol: NCK1
  Gene Name: NCK adaptor protein 1
  ENSP ID: ENSP00000418513
MAEEVVVVAKFDYVAQQEQELDIKKNERLWLLDDSKSWWRVRNSMNKTGFVPSNYVERKNSARKASIVKNLKDTL

SEQ ID NO: 55514 - protein, 129 aa, Homo sapiens
  Payload ID: 10942
  Gene Symbol: NCK1
  Gene Name: NCK adaptor protein 1
  ENSP ID: ENSP00000419302
MAEEVVVVAKFDYVAQQEQELDIKKNERLWLLDDSKSWWRVRNSMNKTGFVPSNYVERKNSARKASIVKNLKDTLGIGKVKRKPSVPDSASPADDSFVDPGERLYDLNMPAYVKFNYMAEREDELSLIK

SEQ ID NO: 55515 - protein, 141 aa, Homo sapiens
  Payload ID: 10942
  Gene Symbol: NCK1
  Gene Name: NCK adaptor protein 1
  ENSP ID: ENSP00000419544
  MOD_RES (1)..(1): Any amino acid
XVAQQEQELDIKKNERLWLLDDSKSWWRVRNSMNKTGFVPSNYVERKNSARKASIVKNLKDTLGIGKVKRKPSVPDSASPADDSFVDPGERLYDLNMPAYVKFNYMAEREDELSLIKGTKCDYIRPSLTGKFAGNPWYYGK

SEQ ID NO: 55516 - protein, 313 aa, Homo sapiens
  Payload ID: 10942
  Gene Symbol: NCK1
  Gene Name: NCK adaptor protein 1
  Uniprot ID: P16333
  ENSP ID: ENSP00000419631
MDWLNVFKDFFSIGKVKRKPSVPDSASPADDSFVDPGERLYDLNMPAYVKFNYMAEREDELSLIKGTKVIVMEKCSDGWWRGSYNGQVGWFPSNYVTEEGDSPLGDHVGSLSEKLAAVVNNLNTGQVLHVVQALYPFSSSNDEELNFEKGDVMDVIEKPENDPEWWKCRKINGMVGLVPKNYVTVMQNNPLTSGLEPSPPQCDYIRPSLTGKFAGNPWYYGKVTRHQAEMALNERGHEGDFLIRDSESSPNDFSVSLKAQGKNKHFKVQLKETVYCIGQRKFSTMEELVEHYKKAPIFTSEQGEKLYLVKHLS

SEQ ID NO: 55517 - protein, 115 aa, Homo sapiens
  Payload ID: 10942
  Gene Symbol: NCK1
  Gene Name: NCK adaptor protein 1
  ENSP ID: ENSP00000419677
MAEEVVVVAKFDYVAQQEQELDIKKNERLWLLDDSKSWWRVRNSMNKTGFVPSNYVERKNSARKASIVKNLKDTLGIGKVKRKPSVPDSASPADDSFVDPGERLYDLNMPAYVKF

SEQ ID NO: 55518 - protein, 380 aa, Homo sapiens
  Payload ID: 10943
  Gene Symbol: NCK2
  Gene Name: NCK adaptor protein 2
  Uniprot ID: O43639
  ENSP ID: ENSP00000233154
MTEEVIVIAKWDYTAQQDQELDIKKNERLWLLDDSKTWWRVRNAANRTGYVPSNYVERKNSLKKGSLVKNLKDTLGLGKTRRKTSARDASPTPSTDAEYPANGSGADRIYDLNIPAFVKFAYVAEREDELSLVKGSRVTVMEKCSDGWWRGSYNGQIGWFPSNYVLEEVDEAAAESPSFLSLRKGASLSNGQGSRVLHVVQTLYPFSSVTEEELNFEKGETMEVIEKPENDPEWWKCKNARGQVGLVPKNYVVVLSDGPALHPAHAPQISYTGPSSSGRFAGREWYYGNVTRHQAECALNERGVEGDFLIRDSESSPSDFSVSLKASGKNKHFKVQLVDNVYCIGQRRFHTMDELVEHYKKAPIFTSEHGEKLYLVRALQ

SEQ ID NO: 55519 - protein, 144 aa, Homo sapiens
  Payload ID: 10943
  Gene Symbol: NCK2
  Gene Name: NCK adaptor protein 2
  ENSP ID: ENSP00000377017
MTEEVIVIAKWDYTAQQDQELDIKKNERLWLLDDSKTWWRVRNAANRTGYVPSNYVERKNSLKKGSLVKNLKDTLGLGKTRRKTSARDASPTPSTDAEYPANGSGADRIYDLNIPAFVKFAYVAEREDELSLVKGSRVTVMEKC

SEQ ID NO: 55520 - protein, 380 aa, Homo sapiens; identical to SEQ ID NO: 55518
  Payload ID: 10943
  Gene Symbol: NCK2
  Gene Name: NCK adaptor protein 2
  Uniprot ID: O43639
  ENSP ID: ENSP00000377018

SEQ ID NO: 55521 - protein, 110 aa, Homo sapiens
  Payload ID: 10943
  Gene Symbol: NCK2
  Gene Name: NCK adaptor protein 2
  ENSP ID: ENSP00000408040
MTEEVIVIAKWDYTAQQDQELDIKKNERLWLLDDSKTWWRVRNAANRTGYVPSNYVERKNSLKKGSLVKNLKDTLGLGKTRRKTSARDASPTPSTDAEYPANGSGADRIY

SEQ ID NO: 55522 - protein, 83 aa, Homo sapiens
  Payload ID: 10943
  Gene Symbol: NCK2
  Gene Name: NCK adaptor protein 2
  ENSP ID: ENSP00000410428
MTEEVIVIAKWDYTAQQDQELDIKKNERLWLLDDSKTWWRVRNAANRTGYVPSNYVERKNSLKKGSLVKNLKDTLAQRLLRVP

SEQ ID NO: 55523 - protein, 83 aa, Homo sapiens; identical to SEQ ID NO: 55522
  Payload ID: 10943
  Gene Symbol: NCK2
  Gene Name: NCK adaptor protein 2
  ENSP ID: ENSP00000431109

SEQ ID NO: 55524 - protein, 722 aa, Homo sapiens
  Payload ID: 10944
  Gene Symbol: NCKIPSD
  Gene Name: NCK interacting protein with SH3 domain
  Uniprot ID: Q9NZQ3
  ENSP ID: ENSP00000294129
MYRALYAFRSAEPNALAFAAGETFLVLERSSAHWWLAARARSGETGYVPPAYLRRLQGLEQDVLQAIDRAIEAVHNTAMRDGGKYSLEQRGVLQKLIHHRKETLSRRGPSASSVAVMTSSTSDHHLDAAAARQPNGVCRAGFERQHSLPSSEHLGADGGLYQIPLPSSQIPPQPRRAAPTTPPPPVKRRDREALMASGSGGHNTMPSGGNSVSSGSSVSSTSLDTLYTSSSPSEPGSSCSPTPPPVPRRGTHTTVSQVQPPPSKASAPEPPAEEEVATGTTSASDDLEALGTLSLGTTEEKAAAEAAVPRTIGAELMELVRRNTGLSHELCRVAIGIIVGHIQASVPASSPVMEQVLLSLVEGKDLSMALPSGQVCHDQQRLEVIFADLARRKDDAQQRSWALYEDEGVIRCYLEELLHILTDADPEVCKKMCKRNEFESVLALVAYYQMEHRASLRLLLLKCFGAMCSLDAAIISTLVSSVLPVELARDMQTDTQDHQKLCYSALILAMVFSMGEAVPYAHYEHLGTPFAQFLLNIVEDGLPLDTTEQLPDLCVNLLLALNLHLPAADQNVIMAALSKHANVKIFSEKLLLLLNRGDDPVRIFKHEPQPPHSVLKFLQDVFGSPATAAIFYHTDMMALIDITVRHIADLSPGDKLRMEYLSLMHAIVRTTPYLQHRHRLPDLQAILRRILNEEETSPQCQMDRMIVREMCKEFLVLGEAPS

SEQ ID NO: 55525 - protein, 715 aa, Homo sapiens
  Payload ID: 10944
  Gene Symbol: NCKIPSD
  Gene Name: NCK interacting protein with SH3 domain
  Uniprot ID: Q9NZQ3
  ENSP ID: ENSP00000389059
MYRALYAFRSAEPNALAFAAGETFLVLERSSAHWWLAARARSGETGYVPPAYLRRLQGLEQDVLQAIDRAIEAVHNTAMRDGGKYSLEQRGVLQKLIHHRKETLSRRGPSASSVAVMTSSTSDHHLDAAAARQPNGVCRAGFERQHSLPSSEHLGADGGLYQIPPQPRRAAPTTPPPPVKRRDREALMASGSGGHNTMPSGGNSVSSGSSVSSTSLDTLYTSSSPSEPGSSCSPTPPPVPRRGTHTTVSQVQPPPSKASAPEPPAEEEVATGTTSASDDLEALGTLSLGTTEEKAAAEAAVPRTIGAELMELVRRNTGLSHELCRVAIGIIVGHIQASVPASSPVMEQVLLSLVEGKDLSMALPSGQVCHDQQRLEVIFADLARRKDDAQQRSWALYEDEGVIRCYLEELLHILTDADPEVCKKMCKRNEFESVLALVAYYQMEHRASLRLLLLKCFGAMCSLDAAIISTLVSSVLPVELARDMQTDTQDHQKLCYSALILAMVFSMGEAVPYAHYEHLGTPFAQFLLNIVEDGLPLDTTEQLPDLCVNLLLALNLHLPAADQNVIMAALSKHANVKIFSEKLLLLLNRGDDPVRIFKHEPQPPHSVLKFLQDVFGSPATAAIFYHTDMMALIDITVRHIADLSPGDKLRMEYLSLMHAIVRTTPYLQHRHRLPDLQAILRRILNEEETSPQCQMDRMIVREMCKEFLVLGEAPS

SEQ ID NO: 55526 - protein, 151 aa, Homo sapiens
  Payload ID: 10944
  Gene Symbol: NCKIPSD
  Gene Name: NCK interacting protein with SH3 domain
  ENSP ID: ENSP00000396683
DTTEQLPDLCVNLLLALNLHLPAADQNVIMAALSKHANVKIFSEKLLLLLNRGDDPVRIFKHEPQPPHSVLKFLQDVFGSPATAAIFYHTDMMALIDITVRHIADLSPGDKVPGAAHGVPLPDACYSPHHTLPAAPPPATRPAGHTATHPE

SEQ ID NO: 55527 - protein, 268 aa, Homo sapiens
  Payload ID: 10944
  Gene Symbol: NCKIPSD
  Gene Name: NCK interacting protein with SH3 domain
  ENSP ID: ENSP00000406442
  MOD_RES (1)..(1): Any amino acid
XSAPEPPAEEEVATGTTSASDDLEALGTLSLGTTEEKAAAEAAVPRTIGAELMELVRRNTGLSHELCRVAIGIIVGHIQASVPASSPVMEQVLLSLVEGKDLSMALPSGQVCHDQQRLEVIFADLARRKDDAQQRSWALYEDEGVIRCYLEELLHILTDADPEVCKKMCKRNEFESVLALVAYYQMEHRASLRLLLLKCFGAMCSLDAAIISTLVSSVLPVELARDMQTDTQEHLGTPFAQFLLNIVEDGLPLDTTEQLPDLCVNLLL

SEQ ID NO: 55528 - protein, 203 aa, Homo sapiens
  Payload ID: 10944
  Gene Symbol: NCKIPSD
  Gene Name: NCK interacting protein with SH3 domain
  ENSP ID: ENSP00000408588
MRDGGKYSLEQRGVLQKLIHHRKETLSRRGPSASSVAVMTSSTSDHHLDAAAARQPNGVCRAGFERQHSLPSSEHLGADGGLYQIPLPSSQIPPQPRRAAPTTPPPPVKRRDREALMASGSGGHNTMPSGGNSVSSGSSVSSTSLDTLYTSSSPSEPGSSCSPTPPPVPRRGTHTTVSQVQPPPSKASAPEPPAEEEVATGTT

SEQ ID NO: 55529 - protein, 395 aa, Homo sapiens
  Payload ID: 10944
  Gene Symbol: NCKIPSD
  Gene Name: NCK interacting protein with SH3 domain
  ENSP ID: ENSP00000409675
MYRALYAFRSAEPNALAFAAGETFLVLERSSAHWWLAARARSGETGYVPPAYLRRLQGLEQDVLQAIDRAIEAVHNTAMRDGGKYSLEQRGVLQKLIHHRKETLSRRGPSASSVAVMTSSTSDHHLDAAAARQPNGVCRAGFERQHSLPSSEHLGADGGLYQIPLPSSQIPPQPRRAAPTTPPPPVKRRDREALMASGSGGHNTMPSGGNSVSSGSSVSSTSLDTLYTSSSPSEPGSSCSPTPPPVPRRGTHTTVSQVQPPPSKASAPEPPAEEEVATGTTSASDDLEALGTLSLGTTEEKAAAEAAVPRTIGAELMELVRRNTGLSHELCRVAIGIIVGHIQASVPASSPVMEQVLLSLVEGKVRVGGTAGPPCYPPCSHRHTLVQPVHYRYFS

SEQ ID NO: 55530 - protein, 58 aa, Homo sapiens
  Payload ID: 10944
  Gene Symbol: NCKIPSD
  Gene Name: NCK interacting protein with SH3 domain
  ENSP ID: ENSP00000416144
MYRALYAFRSAEPNALAFAAGETFLVLERSSAHWWLAARARSGETGYVPPAYLRRLQV

SEQ ID NO: 55531 - protein, 165 aa, Homo sapiens
  Payload ID: 10944
  Gene Symbol: NCKIPSD
  Gene Name: NCK interacting protein with SH3 domain
  ENSP ID: ENSP00000416904
MTSSTSDHHLDAAAARQPNGVCRAGFERQHSLPSSEHLGADGGLYQIPLPSSQIPPQPRRAAPTTPPPPVKRRDREALMASGSGGHNTMPSGGNSVSSGSSVSSTSLDTLYTSSSPSEPGSSCSPTPPPVPRRGTHTTVSQVQPPPSKASAPEPPAEEEVATGTT

SEQ ID NO: 55532 - protein, 1134 aa, Homo sapiens
  Payload ID: 10945
  Gene Symbol: NCKAP1
  Gene Name: NCK-associated protein 1
  Uniprot ID: Q9Y2A7
  ENSP ID: ENSP00000354251
MSRSVLQPSQQKLAEKLTILNDRGVGMLTRLYNIKKQGQVWKACGDPKAKPSYLIDKNLESAVKFIVRKFPAVETRNNNQQLAQLQKEKSEILKNLALYYFTFVDVMEFKDHVCELLNTIDVCQVFFDITVNFDLTKNYLDLIITYTTLMILLSRIEERKAIIGLYNYAHEMTHGASDREYPRLGQMIVDYENPLKKMMEEFVPHSKSLSDALISLQMVYPRRNLSADQWRNAQLLSLISAPSTMLNPAQSDTMPCEYLSLDAMEKWIIFGFILCHGILNTDATALNLWKLALQSSSCLSLFRDEVFHIHKAAEDLFVNIRGYNKRINDIRECKEAAVSHAGSMHRERRKFLRSALKELATVLSDQPGLLGPKALFVFMALSFARDEIIWLLRHADNMPKKSADDFIDKHIAELIFYMEELRAHVRKYGPVMQRYYVQYLSGFDAVVLNELVQNLSVCPEDESIIMSSFVNTMTSLSVKQVEDGEVFDFRGMRLDWFRLQAYTSVSKASLGLADHRELGKMMNTIIFHTKMVDSLVEMLVETSDLSIFCFYSRAFEKMFQQCLELPSQSRYSIAFPLLCTHFMSCTHELCPEERHHIGDRSLSLCNMFLDEMAKQARNLITDICTEQCTLSDQLLPKHCAKTISQAVNKKSKKQTGKKGEPEREKPGVESMRKNRLVVTNLDKLHTALSELCFSINYVPNMVVWEHTFTPREYLTSHLEIRFTKSIVGMTMYNQATQEIAKPSELLTSVRAYMTVLQSIENYVQIDITRVFNNVLLQQTQHLDSHGEPTITSLYTNWYLETLLRQVSNGHIAYFPAMKAFVNLPTENELTFNAEEYSDISEMRSLSELLGPYGMKFLSESLMWHISSQVAELKKLVVENVDVLTQMRTSFDKPDQMAALFKRLSSVDSVLKRMTIIGVILSFRSLAQEALRDVLSYHIPFLVSSIEDFKDHIPRETDMKVAMNVYELSSAAGLPCEIDPALVVALSSQKSENISPEEEYKIACLLMVFVAVSLPTLASNVMSQYSPAIEGHCNNIHCLAKAINQIAAALFTIHKGSIEDRLKEFLALASSSLLKIGQETDKTTTRNRESVYLLLDMIVQESPFLTMDLLESCFPYVLLRNAYHAVYKQSVTSSA

SEQ ID NO: 55533 - protein, 1128 aa, Homo sapiens
  Payload ID: 10945
  Gene Symbol: NCKAP1
  Gene Name: NCK-associated protein 1
  Uniprot ID: Q9Y2A7
  ENSP ID: ENSP00000355348
MSRSVLQPSQQKLAEKLTILNDRGVGMLTRLYNIKKACGDPKAKPSYLIDKNLESAVKFIVRKFPAVETRNNNQQLAQLQKEKSEILKNLALYYFTFVDVMEFKDHVCELLNTIDVCQVFFDITVNFDLTKNYLDLIITYTTLMILLSRIEERKAIIGLYNYAHEMTHGASDREYPRLGQMIVDYENPLKKMMEEFVPHSKSLSDALISLQMVYPRRNLSADQWRNAQLLSLISAPSTMLNPAQSDTMPCEYLSLDAMEKWIIFGFILCHGILNTDATALNLWKLALQSSSCLSLFRDEVFHIHKAAEDLFVNIRGYNKRINDIRECKEAAVSHAGSMHRERRKFLRSALKELATVLSDQPGLLGPKALFVFMALSFARDEIIWLLRHADNMPKKSADDFIDKHIAELIFYMEELRAHVRKYGPVMQRYYVQYLSGFDAVVLNELVQNLSVCPEDESIIMSSFVNTMTSLSVKQVEDGEVFDFRGMRLDWFRLQAYTSVSKASLGLADHRELGKMMNTIIFHTKMVDSLVEMLVETSDLSIFCFYSRAFEKMFQQCLELPSQSRYSIAFPLLCTHFMSCTHELCPEERHHIGDRSLSLCNMFLDEMAKQARNLITDICTEQCTLSDQLLPKHCAKTISQAVNKKSKKQTGKKGEPEREKPGVESMRKNRLVVTNLDKLHTALSELCFSINYVPNMVVWEHTFTPREYLTSHLEIRFTKSIVGMTMYNQATQEIAKPSELLTSVRAYMTVLQSIENYVQIDITRVFNNVLLQQTQHLDSHGEPTITSLYTNWYLETLLRQVSNGHIAYFPAMKAFVNLPTENELTFNAEEYSDISEMRSLSELLGPYGMKFLSESLMWHISSQVAELKKLVVENVDVLTQMRTSFDKPDQMAALFKRLSSVDSVLKRMTIIGVILSFRSLAQEALRDVLSYHIPFLVSSIEDFKDHIPRETDMKVAMNVYELSSAAGLPCEIDPALVVALSSQKSENISPEEEYKIACLLMVFVAVSLPTLASNVMSQYSPAIEGHCNNIHCLAKAINQIAAALFTIHKGSIEDRLKEFLALASSSLLKIGQETDKTTTRNRESVYLLLDMIVQESPFLTMDLLESCFPYVLLRNAYHAVYKQSVTSSA

SEQ ID NO: 55534 - protein, 1127 aa, Homo sapiens
  Payload ID: 10946
  Gene Symbol: NCKAP1L
  Gene Name: NCK-associated protein 1-like
  Uniprot ID: P55160
  ENSP ID: ENSP00000293373
MSLTSAYQHKLAEKLTILNDRGQGVLIRMYNIKKTCSDPKSKPPFLLEKSMEPSLKYINKKFPNIDVRNSTQHLGPVHREKAEIIRFLTNYYQSFVDVMEFRDHVYELLNTIDACQCHFDINLNFDFTRSYLDLIVTYTSVILLLSRIEDRRILIGMYNCAHEMLHGHGDPSFARLGQMVLEYDHPLKKLTEEFGPHTKAVSGALLSLHFLFVRRNQGAEQWRSAQLLSLISNPPAMINPANSDTMACEYLSVEVMERWIIIGFLLCHGCLNSNSQCQKLWKLCLQGSLYITLIREDVLQVHKVTEDLFSSLKGYGKRVADIKESKEHVIANSGQFHCQRRQFLRMAVKELETVLADEPGLLGPKALFAFMALSFIRDEVTWLVRHTENVTKTKTPEDYADSSIAELLFLLEGIRSLVRRHIKVIQQYHLQYLARFDALVLSDIIQNLSVCPEEESIIMSSFVSILSSLNLKQVDNGEKFEFSGLRLDWFRLQAYTSVAKAPLHLHENPDLAKVMNLIVFHSRMLDSVEKLLVETSDLSTFCFHLRIFEKMFAMTLEESAMLRYAIAFPLICAHFVHCTHEMCPEEYPHLKNHGLHHCNSFLEELAKQTSNCVLEICAEQRNLSEQLLPKHCATTISKAKNKKTRKQRQTPRKGEPERDKPGAESHRKNRSIVTNMDKLHLNLTELALTMNHVYSFSVFEHTIFPSEYLSSHLEARLNRAIVWLAGYNATTQEIVRPSELLAGVKAYIGFIQSLAQFLGADASRVIRNALLQQTQPLDSCGEQTITTLYTNWYLESLLRQASSGTIILSPAMQAFVSLPREGEQNFSAEEFSDISEMRALAELLGPYGMKFLSENLMWHVTSQIVELKKLVVENMDILVQIRSNFSKPDLMASLLPQLTGAENVLKRMTIIGVILSFRAMAQEGLREVFSSHCPFLMGPIECLKEFVTPDTDIKVTLSIFELASAAGVGCDIDPALVAAIANLKADTSSPEEEYKVACLLLIFLAVSLPLLATDPSSFYSIEKDGYNNNIHCLTKAIIQVSAALFTLYNKNIETHLKEFLVVASVSLLQLGQETDKLKTRNRESISLLMRLVVEESSFLTLDMLESCFPYVLLRNAYREVSRAFHLN

SEQ ID NO: 55535 - protein, 1077 aa, Homo sapiens
  Payload ID: 10946
  Gene Symbol: NCKAP1L
  Gene Name: NCK-associated protein 1-like
  Uniprot ID: P55160
  ENSP ID: ENSP00000445596
MEPSLKYINKKFPNIDVRNSTQHLGPVHREKAEIIRFLTNYYQSFVDVMEFRDHVYELLNTIDACQCHFDINLNFDFTRSYLDLIVTYTSVILLLSRIEDRRILIGMYNCAHEMLHGHGDPSFARLGQMVLEYDHPLKKLTEEFGPHTKAVSGALLSLHFLFVRRNQGAEQWRSAQLLSLISNPPAMINPANSDTMACEYLSVEVMERWIIIGFLLCHGCLNSNSQCQKLWKLCLQGSLYITLIREDVLQVHKVTEDLFSSLKGYGKRVADIKESKEHVIANSGQFHCQRRQFLRMAVKELETVLADEPGLLGPKALFAFMALSFIRDEVTWLVRHTENVTKTKTPEDYADSSIAELLFLLEGIRSLVRRHIKVIQQYHLQYLARFDALVLSDIIQNLSVCPEEESIIMSSFVSILSSLNLKQVDNGEKFEFSGLRLDWFRLQAYTSVAKAPLHLHENPDLAKVMNLIVFHSRMLDSVEKLLVETSDLSTFCFHLRIFEKMFAMTLEESAMLRYAIAFPLICAHFVHCTHEMCPEEYPHLKNHGLHHCNSFLEELAKQTSNCVLEICAEQRNLSEQLLPKHCATTISKAKNKKTRKQRQTPRKGEPERDKPGAESHRKNRSIVTNMDKLHLNLTELALTMNHVYSFSVFEHTIFPSEYLSSHLEARLNRAIVWLAGYNATTQEIVRPSELLAGVKAYIGFIQSLAQFLGADASRVIRNALLQQTQPLDSCGEQTITTLYTNWYLESLLRQASSGTIILSPAMQAFVSLPREGEQNFSAEEFSDISEMRALAELLGPYGMKFLSENLMWHVTSQIVELKKLVVENMDILVQIRSNFSKPDLMASLLPQLTGAENVLKRMTIIGVILSFRAMAQEGLREVFSSHCPFLMGPIECLKEFVTPDTDIKVTLSIFELASAAGVGCDIDPALVAAIANLKADTSSPEEEYKVACLLLIFLAVSLPLLATDPSSFYSIEKDGYNNNIHCLTKAIIQVSAALFTLYNKNIETHLKEFLVVASVSLLQLGQETDKLKTRNRESISLLMRLVVEESSFLTLDMLESCFPYVLLRNAYREVSRAFHLN

SEQ ID NO: 55536 - protein, 449 aa, Homo sapiens
  Payload ID: 10946
  Gene Symbol: NCKAP1L
  Gene Name: NCK-associated protein 1-like
  ENSP ID: ENSP00000447246
MSLTSAYQHKLAEKLTILNDRGQGVLIRMYNIKKTCSDPKSKPPFLLEKSMEPSLKYINKKFPNIDVRNSTQHLGPVHREKAEIIRFLTNYYQSFVDVMEFRDHVYELLNTIDACQCHFDINLNFDFTRSYLDLIVTYTSVILLLSRIEDRRILIGMYNCAHEMLHGHGDPSFARLGQMVLEYDHPLKKLTEEFGPHTKAVSGALLSLHFLFVRRNQGAEQWRSAQLLSLISNPPAMINPANSDTMACEYLSVEVMERWIIIGFLLCHGCLNSNSQCQKLWKLCLQGSLYITLIREDVLQVHKVTEDLFSSLKGYGKRVADIKESKEHVIANSGQFHCQRRQFLRMAVKELETVLADEPGLLGPKALFAFMALSFIRDEVTWLVRHTENVTKTKTPEDYADSSIAELLFLLEGIRSLVRRHIKVIQQYHLQYLARFDALVLSDIIQFLS

SEQ ID NO: 55537 - protein, 69 aa, Homo sapiens
  Payload ID: 10947
  Gene Symbol: NCKAP5
  Gene Name: NCK-associated protein 5
  ENSP ID: ENSP00000351882
MEGKRQLEKRDFGKRLSLDSSLVEYMDSNKYIEHLLTQLEEQHRSLWREKLAVARLQREVAQRTSEGAM

SEQ ID NO: 55538 - protein, 1909 aa, Homo sapiens [sequence omitted]

SEQ ID NO: 55539 - protein, 590 aa, Homo sapiens [sequence omitted]

SEQ ID NO: 55540 - protein, 590 aa, Homo sapiens
  Payload ID: 10947
  Gene Symbol: NCKAP5
  Gene Name: NCK-associated protein 5
  Uniprot ID: O14513
  ENSP ID: ENSP00000386952
MEGKRQLEKRDFGKRLSLDSSLVEYMDSNKYIEHLLTQLEEQHRSLWREKLAVARLQREVAQRTSEGAMHEKLIHELEEERHLRLQSEKRLQEVTLESERNRIQMRSLQQQFSRMEETVRNLLQSQGSPEQKKEETVNIMVYQEKLSEEERKHKEALEDLHMVVDEDSRSESSSTDEGKEKTKLLLERLKALEAENSALALENENQREQYERCLDEVANQVVQALLTQKDLREECVKLKTRVFDLEQQNRTLSILFQQRVRPTSDLLLQKLHSRLLDLSSGDLLSEVERNRSLTQSRTDAEVHEHQLNTKSALKCPGLGAVIPGHLCPRNSYSSSSELSLSSTCSEYSSGSSYTWHDGKNLRKRVKEANENLQEDEDDAVADSVFQSHIIESNCQMRTLDSGIGTFPLPDSGNRSTGRYLCQPDSPEDAEPLLPLQSALSAVSSMRAQTLEREVPSSTDGQRPADSAIVHSTSDPIMTARGMRPLQSRLPKPASSGKVSSQKQNEAEPRPQTCSSFGYAEDPMASQPLPDWGSEVAATGTQDKAPRMCTYSASGGSNSDSDLDYGDNGFGAGRGQLVKALKSAAPEIETT

SEQ ID NO: 55541 - protein, 1909 aa, Homo sapiens
  Payload ID: 10947
  Gene Symbol: NCKAP5
  Gene Name: NCK-associated protein 5
  Uniprot ID: O14513
  ENSP ID: ENSP00000387128
MEGKRQLEKRDFGKRLSLDSSLVEYMDSNKYIEHLLTQLEEQHRSLWREKLAVARLQREVAQRTSEGAMHEKLIHELEEERHLRLQSEKRLQEVTLESERNRIQMRSLQQQFSRMEETVRNLLQSQGSPEQKKEETVNIMVYQEKLSEEERKHKEALEDLHMVVDEDSRSESSSTDEGKEKTKLLLERLKALEAENSALALENENQREQYERCLDEVANQVVQALLTQKDLREECVKLKTRVFDLEQQNRTLSILFQQRVRPTSDLLLQKLHSRLLDLSSGDLLSEVERNRSLTQSRTDAEVHEHQLNTKSALKCPGLGAVIPGHLCPRNSYSSSSELSLSSTCSEYSSGSSYTWHDGKNLRKRQSSQNWDKRLSIDSSLPSGFASPTNELPPTRIKESHILEGLRKLQKRKVLLEPPSVITKWGYKDCMNSNEGIYSPGIKSSSLKEYPPCKTADLGSPCKEPHKTFVYDLDSHVDADDDPSTLALLQAVPNQSCRPHGSKLTHSVSDSLFGWETNRKHFLEGTSSVYPKERPEKLTSCASSCPLEMKLCPSVQTPQVQRERGPQGQGHGRMALNLQLSDTDDNETFDELHIESSDEKSPSDVSLAADTDKSVENLDVLVGFGKSLCGSPEEEEKQVPIPSETRPKTFSFIKQQRVVKRTSSEECVTVIFDAEDGEPIEFSSHQTGVVTVTRNEISINSTPAGPKAEHTELLPQGIACLQPRAAARDYTFFKRSEEDTEKNIPKDNVDNVPRVSTESFSSRTVTQNPQQQKLVKPTHNISCQSNSRSSAPMGIYQKQNLTKIPPRGKSSPQKSKLMEPEATTLLPSSGLVTLEKSPALAPGKLSRFMKTESSGPLFELRSDPHIPKHSAQLPHSSRMPSRRDWVQCPKSQTPGSRSRPAIESSDSGEPPTRDEHCGSGPEAGVKSPSPPPPPGRSVSLLARPSYDYSPAPSSTKSETRVPSETARTPFKSPLLKGISAPVISSNPATTEVQRKKPSVAFKKPIFTHPMPSPEAVIQTRCPAHAPSSSFTVMALGPPKVSPKRGVPKTSPRQTLGTPQRDIGLQTPRISPSTHEPLEMTSSKSVSPGRKGQLNDSASTPPKPSFLGVNESPSSQVSSSSSSSSPAKSHNSPHGCQSAHEKGLKTRLPVGLKVLMKSPQLLRKSSTVPGKHEKDSLNEASKSSVAVNKSKPEDSKNPASMEITAGERNVTLPDSQAQGSLADGLPLETALQEPLESSIPGSDGRDGVDNRSMRRSLSSSKPHLKPALGMNGAKARSHSFSTHSGDKPSTPPIEGSGKVRTQIITNTAERGNSLTRQNSSTESSPNKAPSAPMLESLPSVGRPSGHPSSGKGSLGSSGSFSSQHGSPSKLPLRIPPKSEGLLIPPGKEDQQAFTQGECPSANVAVLGEPGSDRRSCPPTPTDCPEALQSPGRTQHPSTFETSSTSKLETSGRHPDASATATDAVSSEAPLSPTIEEKVMLCIQENVEKGQVQTKPTSVEAKQKPGPSFASWFGFRKSRLPALSSRKMDISKTKVEKKDAKVLGFGNRQLKSERKKEKKKPELQCETENELIKDTKSADNPDGGLQSKNNRRTPQDIYNQLKIEPRNRHSPVACSTKDTFMTELLNRVDKKAAPQTESGSSNASCRNVLKGSSQGSCLIGSSISTQGNHKKNMKIKADMEVPKDSLVKEANENLQEDEDDAVADSVFQSHIIESNCQMRTLDSGIGTFPLPDSGNRSTGRYLCQPDSPEDAEPLLPLQSALSAVSSMRAQTLEREVPSSTDGQRPADSAIVHSTSDPIMTARGMRPLQSRLPKPASSGKVSSQKQNEAEPRPQTCSSFGYAEDPMASQPLPDWGSEVAATGTQDKAPRMCTYSASGGSNSDSDLDYGDNGFGAGRGQLVKALKSAAPEIETT

SEQ ID NO: 55542 - protein, 114 aa, Homo sapiens
  Payload ID: 10947
  Gene Symbol: NCKAP5
  Gene Name: NCK-associated protein 5
  ENSP ID: ENSP00000399070
  MOD_RES (1)..(1): Any amino acid
XQLEKRDFGKRLSLDSSLVEYMDSNKYIEHLLTQLEEQHRSLWREKLAVARLQREVAQRTSEGAMHEKLIHELEEERHLRLQSEKRLQEVTLESERNRIQMRSLQQQFSRRRKM

SEQ ID NO: 55543 - protein, 1334 aa, Homo sapiens
  Payload ID: 10948
  Gene Symbol: NCKAP5L
  Gene Name: NCK-associated protein 5-like
  Uniprot ID: Q9HCH0
  ENSP ID: ENSP00000337998
MSEAMDQPAGGPGNPRPGEGDDGSMEPGTCQELLHRLRELEAENSALAQANENQRETYERCLDEVANHVVQALLNQKDLREECIKLKKRVFDLERQNQMLSALFQQKLQLTTGSLPQIPLTPLQPPSEPPASPSLSSTEGPAAPLPLGHCAGQREVCWEQQLRPGGPGPPAAPPPALDALSPFLRKKAQILEVLRALEETDPLLLCSPATPWRPPGQGPGSPEPINGELCGPPQPEPSPWAPCLLLGPGNLGGLLHWERLLGGLGGEEDTGRPWGPSRGPPQAQGTSSGPNCAPGSSSSSSSDEAGDPNEAPSPDTLLGALARRQLNLGQLLEDTESYLQAFLAGAAGPLNGDHPGPGQSSSPDQAPPQLSKSKGLPKSAWGGGTPEAHRPGFGATSEGQGPLPFLSMFMGAGDAPLGSRPGHPHSSSQVKSKLQIGPPSPGEAQGPLLPSPARGLKFLKLPPTSEKSPSPGGPQLSPQLPRNSRIPCRNSGSDGSPSPLLARRGLGGGELSPEGAQGLPTSPSPCYTTPDSTQLRPPQSALSTTLSPGPVVSPCYENILDLSRSTFRGPSPEPPPSPLQVPTYPQLTLEVPQAPEVLRSPGVPPSPCLPESYPYGSPQEKSLDKAGSESPHPGRRTPGNSSKKPSQGSGRRPGDPGSTPLRDRLAALGKLKTGPEGALGSEKNGVPARPGTEKTRGPGKSGESAGDMVPSIHRPLEQLEAKGGIRGAVALGTNSLKQQEPGLMGDPGARVYSSHSMGARVDLEPVSPRSCLTKVELAKSRLAGALCPQVPRTPAKVPTSAPSLGKPNKSPHSSPTKLPSKSPTKVVPRPGAPLVTKESPKPDKGKGPPWADCGSTTAQSTPLVPGPTDPSQGPEGLAPHSAIEEKVMKGIEENVLRLQGQERAPGAEVKHRNTSSIASWFGLKKSKLPALNRRTEATKNKEGAGGGSPLRREVKMEARKLEAESLNISKLMAKAEDLRRALEEEKAYLSSRARPRPGGPAPGPNTGLGQVQGQLAGMYQGADTFMQQLLNRVDGKELPSKSWREPKPEYGDFQPVSSDPKSPWPACGPRNGLVGPLQGCGKPPGKPSSEPGRREEMPSEDSLAEPVPTSHFTACGSLTRTLDSGIGTFPPPDHGSSGTPSKNLPKTKPPRLDPPPGVPPARPPPLTKVPRRAHTLEREVPGIEELLVSGRHPSMPAFPALLPAAPGHRGHETCPDDPCEDPGPTPPVQLAKNWTFPNTRAAGSSSDPLMCPPRQLEGLPRTPMALPVDRKRSQEPSRPSPTPQGPPFGGSRTPSTSDMAEEGRVASGGPPGLETSESLSDSLYDSLSSCGSQG

SEQ ID NO: 55544 - protein, 1004 aa, Homo sapiens
  Payload ID: 10948
  Gene Symbol: NCKAP5L
  Gene Name: NCK-associated protein 5-like
  ENSP ID: ENSP00000402619
  MOD_RES (1)..(1): Any amino acid
XSSGPNCAPGSSSSSSSDEAGDPNEAPSPDTLLGALARRQLNLGQLLEDTESYLQAFLAGAAGPLNGDHPGPGQSSSPDQAPPQLSKSKGLPKSAWGGGTPEAHRPGFGATSEGQGPLPFLSMFMGAGDAPLGSRPGHPHSSSQVKSKLQIGPPSPGEAQGPLLPSPARGLKFLKLPPTSEKSPSPGGPQLSPQLPRNSRIPCRNSGSDGSPSPLLARRGLGGGELSPEGAQGLPTSPSPCYTTPDSTQLRPPQSALSTTLSPGPVVSPCYENILDLSRSTFRGPSPEPPPSPLQVPTYPQLTLEVPQAPEVLRSPGVPPSPCLPESYPYGSPQEKSLDKAGSESPHPGRRTPGNSSKKPSQGSGRRPGDPGSTPLRDRLAALGKLKTGPEGALGSEKNGVPARPGTEKTRGPGKSGESAGDMVPSIHRPLEQLEAKGGIRGAVALGTNSLKQQEPGLMGDPGARVYSSHSMGARVDLEPVSPRSCLTKVELAKSRLAGALCPQVPRTPAKVPTSAPSLGKPNKSPHSSPTKLPSKSPTKVVPRPGAPLVTKESPKPDKGKGPPWADCGSTTAQSTPLVPGPTDPSQGPEGLAPHSAIEEKVMKGIEENVLRLQGQERAPGAEVKHRNTSSIASWFGLKKSKLPALNRRTEATKNKEGAGGGSPLRREVKMEARKLEAESLNISKLMAKAEDLRRALEEEKAYLSSRARPRPGGPAPGPNTGLGQVQGQLAGMYQGADTFMQQLLNRVDGKELPSKSWREPKPEYGDFQPVSSDPKSPWPACGPRNGLVGPLQGCGKPPGKPSSEPGRREEMPSEDSLAEPVPTSHFTACGSLTRTLDSGIGTFPPPDHGSSGTPSKNLPKTKPPRLDPPPGVPPARPPPLTKVPRRAHTLEREVPGIEELLVSGRHPSMPAFPALLPAAPGHRGHETCPDDPCEDPGPTPPVQLAKNWTFPNTRAAGSSSDPLMCPPRQLEGLPRTPMVRIAAEERERTREQEGVMWGDQFLQ

SEQ ID NO: 55545 - protein, 674 aa, Homo sapiens
  Payload ID: 10949
  Gene Symbol: NDC1
  Gene Name: NDC1 transmembrane nucleoporin
  Uniprot ID: Q9BTX1
  ENSP ID: ENSP00000360483
MATAVSRPCAGRSRDILWRVLGWRIVASIVWSVLFLPICTTVFIIFSRIDLFHPIQWLSDSFSDLYSSYVIFYFLLLSVVIIIISIFNVEFYAVVPSIPCSRLALIGKIIHPQQLMHSFIHAAMGMVMAWCAAVITQGQYSFLVVPCTGTNSFGSPAAQTCLNEYHLFFLLTGAFMGYSYSLLYFVNNMNYLPFPIIQQYKFLRFRRSLLLLVKHSCVESLFLVRNFCILYYFLGYIPKAWISTAMNLHIDEQVHRPLDTVSGLLNLSLLYHVWLCGVFLLTTWYVSWILFKIYATEAHVFPVQPPFAEGSDECLPKVLNSNPPPIIKYLALQDLMLLSQYSPSRRQEVFSLSQPGGHPHNWTAISRECLNLLNGMTQKLILYQEAAATNGRVSSSYPVEPKKLNSPEETAFQTPKSSQMPRPSVPPLVKTSLFSSKLSTPDVVSPFGTPFGSSVMNRMAGIFDVNTCYGSPQSPQLIRRGPRLWTSASDQQMTEFSNPSPSTSISAEGKTMRQPSVIYSWIQNKREQIKNFLSKRVLIMYFFSKHPEASIQAVFSDAQMHIWALEGLSHLVAASFTEDRFGVVQTTLPAILNTLLTLQEAVDKYFKLPHASSKPPRISGSLVDTSYKTLRFAFRASLKTAIYRITTTFGEHLNAVQASAEHQKRLQQFLEFKE

SEQ ID NO: 55546 - protein, 642 aa, Homo sapiens
  Payload ID: 10950
  Gene Symbol: NDC80
  Gene Name: NDC80 kinetochore complex component
  Uniprot ID: O14777
  ENSP ID: ENSP00000261597
MKRSSVSSGGAGRLSMQELRSQDVNKQGLYTPQTKEKPTFGKLSINKPTSERKVSLFGKRTSGHGSRNSQLGIFSSSEKIKDPRPLNDKAFIQQCIRQLCEFLTENGYAHNVSMKSLQAPSVKDFLKIFTFLYGFLCPSYELPDTKFEEEVPRIFKDLGYPFALSKSSMYTVGAPHTWPHIVAALVWLIDCIKIHTAMKESSPLFDDGQPWGEETEDGIMHNKLFLDYTIKCYESFMSGADSFDEMNAELQSKLKDLFNVDAFKLESLEAKNRALNEQIARLEQEREKEPNRLESLRKLKASLQGDVQKYQAYMSNLESHSAILDQKLNGLNEEIARVELECETIKQENTRLQNIIDNQKYSVADIERINHERNELQQTINKLTKDLEAEQQKLWNEELKYARGKEAIETQLAEYHKLARKLKLIPKGAENSKGYDFEIKFNPEAGANCLVKYRAQVYVPLKELLNETEEEINKALNKKMGLEDTLEQLNAMITESKRSVRTLKEEVQKLDDLYQQKIKEAEEEDEKCASELESLEKHKHLLESTVNQGLSEAMNELDAVQREYQLVVQTTTEERRKVGNNLQRLLEMVATHVGSVEKHLEEQIAKVDREYEECMSEDLSENIKEIRDKYEKKATLIKSSEE

SEQ ID NO: 55547 - protein, 32 aa, Homo sapiens
  Payload ID: 10950
  Gene Symbol: NDC80
  Gene Name: NDC80 kinetochore complex component
  ENSP ID: ENSP00000458236
TTEERRKVGNNLQRLLEMVATHVGSVERRMLG

SEQ ID NO: 55548 - protein, 141 aa, Homo sapiens
  Payload ID: 10950
  Gene Symbol: NDC80
  Gene Name: NDC80 kinetochore complex component
  ENSP ID: ENSP00000461227
MKRSSVSSGGAGRLSMQELRSQDVNKQGLYTPQTKEKPTFGKLSINKPTSERKVSLFGKRWSLALSPRLECSGAISAHCNLCLASSSNSPASASRVAGITELVDMDPGIVNLVYFPVLRKSRTRDHLMTKHSFSSVFDNSV

SEQ ID NO: 55549 - protein, 168 aa, Homo sapiens
  Payload ID: 10950
  Gene Symbol: NDC80
  Gene Name: NDC80 kinetochore complex component
  ENSP ID: ENSP00000476919
CIRQLCEFLTENGYAHNVSMKSLQAPSVKDFLKIFTFLYGFLCPSYELPDTKFEEEVPRIFKDLGYPFALSKSSMYTVGAPHTWPHIVAALVWLIDCIKSLALLPRLECSGMISAHYNLHLPGSSNSHASASQVARITGAHHHAQLIFVFSVETACHHVGQADLELLT

SEQ ID NO: 55550 - protein, 882 aa, Homo sapiens
  Payload ID: 10951
  Gene Symbol: NDST1
  Gene Name: N-deacetylase/N-sulfotransferase (heparan glucosaminyl) 1
  Uniprot ID: P52848
  ENSP ID: ENSP00000261797
MPALACLRRLCRHVSPQAVLFLLFIFCLFSVFISAYYLYGWKRGLEPSADAPEPDCGDPPPVAPSRLLPLKPVQAATPSRTDPLVLVFVESLYSQLGQEVVAILESSRFKYRTEIAPGKGDMPTLTDKGRGRFALIIYENILKYVNLDAWNRELLDKYCVAYGVGIIGFFKANENSLLSAQLKGFPLFLHSNLGLKDCSINPKSPLLYVTRPSEVEKGVLPGEDWTVFQSNHSTYEPVLLAKTRSSESIPHLGADAGLHAALHATVVQDLGLHDGIQRVLFGNNLNFWLHKLVFVDAVAFLTGKRLSLPLDRYILVDIDDIFVGKEGTRMKVEDVKALFDTQNELRAHIPNFTFNLGYSGKFFHTGTNAEDAGDDLLLSYVKEFWWFPHMWSHMQPHLFHNQSVLAEQMALNKKFAVEHGIPTDMGYAVAPHHSGVYPVHVQLYEAWKQVWSIRVTSTEEYPHLKPARYRRGFIHNGIMVLPRQTCGLFTHTIFYNEYPGGSSELDKIINGGELFLTVLLNPISIFMTHLSNYGNDRLGLYTFKHLVRFLHSWTNLRLQTLPPVQLAQKYFQIFSEEKDPLWQDPCEDKRHKDIWSKEKTCDRFPKLLIIGPQKTGTTALYLFLGMHPDLSSNYPSSETFEEIQFFNGHNYHKGIDWYMEFFPIPSNTTSDFYFEKSANYFDSEVAPRRAAALLPKAKVLTILINPADRAYSWYQHQRAHDDPVALKYTFHEVITAGSDASSKLRALQNRCLVPGWYATHIERWLSAYHANQILVLDGKLLRTEPAKVMDMVQKFLGVTNTIDYHKTLAFDPKKGFWCQLLEGGKTKCLGKSKGRKYPEMDLDSRAFLKDYYRDHNIELSKLLYKMGQTLPTWLREDLQNTR

SEQ ID NO: 55551 - protein, 159 aa, Homo sapiens
  Payload ID: 10951
  Gene Symbol: NDST1
  Gene Name: N-deacetylase/N-sulfotransferase (heparan glucosaminyl) 1
  ENSP ID: ENSP00000427813
MPALACLRRLCRHVSPQAVLFLLFIFCLFSVFISAYYLYGWKRGLEPSADAPEPDCGDPPPVAPSRLLPLKPVQAATPSRTDPLVLVFVESLYSQLGQEVVAILESSRFKYRTEIAPGKGDMPTLTDKGRGRFALIIYENILKYVNLDAWNRELLDKYC

SEQ ID NO: 55552 - protein, 825 aa, Homo sapiens
  Payload ID: 10951
  Gene Symbol: NDST1
  Gene Name: N-deacetylase/N-sulfotransferase (heparan glucosaminyl) 1
  ENSP ID: ENSP00000428604
MPALACLRRLCRHVSPQAVLFLLFIFCLFSVFISAYYLYGWKRGLEPSADAPEPDCGDPPPVAPSRLLPLKPVQAATPSRTDPLVLVFVESLYSQLGQEVVAILESSRFKYRTEIAPGKGDMPTLTDKGRGRFALIIYENILKYVNLDAWNRELLDKYCVAYGVGIIGFFKANENSLLSAQLKGFPLFLHSNLGLKDCSINPKSPLLYVTRPSEVEKGVLPGEDWTVFQSNHSTYEPVLLAKTRSSESIPHLGADAGLHAALHATVVQDLGLHDGIQRVLFGNNLNFWLHKLVFVDAVAFLTGKRLSLPLDRYILVDIDDIFVGKEGTRMKVEDVKALFDTQNELRAHIPNFTFNLGYSGKFFHTGTNAEDAGDDLLLSYVKEFWWFPHMWSHMQPHLFHNQSVLAEQMALNKKFAVEHGIPTDMGYAVAPHHSGVYPVHVQLYEAWKQVWSIRVTSTEEYPHLKPARYRRGFIHNGIMVLPRQTCGLFTHTIFYNEYPGGSSELDKIINGGELFLTVLLNPISIFMTHLSNYGNDRLGLYTFKHLVRFLHSWTNLRLQTLPPVQLAQKYFQIFSEEKDPLWQDPCEDKRHKDIWSKEKTCDRFPKLLIIGPQKTGTTALYLFLGMHPDLSSNYPSSETFEEIQFFNGHNYHKGIDWYMEFFPIPSNTTSDFYFEKSANYFDSEVAPRRAAALLPKAKVLTILINPADRAYSWYQILVLDGKLLRTEPAKVMDMVQKFLGVTNTIDYHKTLAFDPKKGFWCQLLEGGKTKCLGKSKGRKYPEMDLDSRAFLKDYYRDHNIELSKLLYKMGQTLPTWLREDLQNTR

SEQ ID NO: 55553 - protein, 68 aa, Homo sapiens
  Payload ID: 10951
  Gene Symbol: NDST1
  Gene Name: N-deacetylase/N-sulfotransferase (heparan glucosaminyl) 1
  ENSP ID: ENSP00000429966
MPALACLRRLCRHVSPQAVLFLLFIFCLFSVFISAYYLYGWKRGLEPSADAPEPDCGDPPPVAPSRLL

SEQ ID NO: 55554 - protein, 23 aa, Homo sapiens
  Payload ID: 10951
  Gene Symbol: NDST1
  Gene Name: N-deacetylase/N-sulfotransferase (heparan glucosaminyl) 1
  ENSP ID: ENSP00000430258
MPALACLRRLCRHVSPQAVLFLL

SEQ ID NO: 55555 - protein, 883 aa, Homo sapiens
  Payload ID: 10952
  Gene Symbol: NDST2
  Gene Name: N-deacetylase/N-sulfotransferase (heparan glucosaminyl) 2
  Uniprot ID: P52849
  ENSP ID: ENSP00000299641
MLQLWKVVRPARQLELHRLILLLIAFSLGSMGFLAYYVSTSPKAKEPLPLPLGDCSSGGAAGPGPARPPVPPRPPRPPETARTEPVVLVFVESAYSQLGQEIVAILESSRFRYSTELAPGRGDMPTLTDNTHGRYVLVIYENLLKYVNLDAWSRELLDRYCVEYGVGIIGFFRAHEHSLLSAQLKGFPLFLHSNLGLRDYQVNPSAPLLHLTRPSRLEPGPLPGDDWTIFQSNHSTYEPVLLASLRPAEPAVPGPVLRRARLPTVVQDLGLHDGIQRVLFGHGLSFWLHKLIFVDAVAYLTGKRLCLDLDRYILVDIDDIFVGKEGTRMKVADVEALLTTQNKLRTLVPNFTFNLGFSGKFYHTGTEEEDAGDDMLLKHRKEFWWFPHMWSHMQPHLFHNRSVLADQMRLNKQFALEHGIPTDLGYAVAPHHSGVYPIHTQLYEAWKSVWGIQVTSTEEYPHLRPARYRRGFIHNGIMVLPRQTCGLFTHTIFYNEYPGGSRELDRSIRGGELFLTVLLNPISIFMTHLSNYGNDRLGLYTFESLVRFLQCWTRLRLQTLPPVPLAQKYFELFPQERSPLWQNPCDDKRHKDIWSKEKTCDRLPKFLIVGPQKTGTTAIHFFLSLHPAVTSSFPSPSTFEEIQFFNSPNYHKGIDWYMDFFPVPSNASTDFLFEKSATYFDSEVVPRRGAALLPRAKIITVLTNPADRAYSWYQHQRAHGDPVALNYTFYQVISASSQTPLALRSLQNRCLVPGYYSTHLQRWLTYYPSGQLLIVDGQELRTNPAASMESIQKFLGITPFLNYTRTLRFDDDKGFWCQGLEGGKTRCLGRSKGRRYPDMDTESRLFLTDFFRNHNLELSKLLSRLGQPVPSWLREELQHSSLG

SEQ ID NO: 55556 - protein, 883 aa, Homo sapiens; identical to SEQ ID NO: 55555
  Payload ID: 10952
  Gene Symbol: NDST2
  Gene Name: N-deacetylase/N-sulfotransferase (heparan glucosaminyl) 2
  Uniprot ID: P52849
  ENSP ID: ENSP00000310657

SEQ ID NO: 55557 - protein, 149 aa, Homo sapiens
  Payload ID: 10952
  Gene Symbol: NDST2
  Gene Name: N-deacetylase/N-sulfotransferase (heparan glucosaminyl) 2
  ENSP ID: ENSP00000392733
GDPVALNYTFYQVISASSQTPLALRSLQNRCLVPGYYSTHLQRWLTYYPSGQLLIVDGQELRTNPAASMESIQKFLGITPFLNYTRTLRFDDDKGFWCQGLEGGKTRCLGRSKGRRYPDMDTEVSKARGRGIPLHFQDLILCPTSYHFC

SEQ ID NO: 55558 - protein, 873 aa, Homo sapiens
  Payload ID: 10953
  Gene Symbol: NDST3
  Gene Name: N-deacetylase/N-sulfotransferase (heparan glucosaminyl) 3
  Uniprot ID: O95803
  ENSP ID: ENSP00000296499
MSFIMKLHRHFQRTVILLATFCMVSIIISAYYLYSGYKQENELSETASEVDCGDLQHLPYQLMEVKAMKLFDASRTDPTVLVFVESQYSSLGQDIIMILESSRFQYHIEIAPGKGDLPVLIDKMKGKYILIIYENILKYINMDSWNRSLLDKYCVEYGVGVIGFHKTSEKSVQSFQLKGFPFSIYGNLAVKDCCINPHSPLIRVTKSSKLEKGSLPGTDWTVFQINHSAYQPVIFAKVKTPENLSPSISKGAFYATIIHDLGLHDGIQRVLFGNNLNFWLHKLIFIDAISFLSGKRLTLSLDRYILVDIDDIFVGKEGTRMNTNDVKALLDTQNLLRAQITNFTFNLGFSGKFYHTGTEEEDEGDDCLLGSVDEFWWFPHMWSHMQPHLFHNESSLVEQMILNKKFALEHGIPTDMGYAVAPHHSGVYPVHVQLYEAWKKVWNIKITSTEEYPHLKPARYRRGFIHKNIMVLPRQTCGLFTHTIFYKEYPGGPKELDKSIQGGELFFTVVLNPISIFMTHLSNYGNDRLGLYTFVNLANFVKSWTNLRLQTLPPVQLAHKYFELFPDQKDPLWQNPCDDKRHRDIWSKEKTCDRLPKFLVIGPQKTGTTALYLFLVMHPSILSNSPSPKTFEEVQFFNRNNYHRGIDWYMDFFPVPSNVTTDFLFEKSANYFHSEEAPKRAASLVPKAKIITILIDPSDRAYSWYQHQRSHEDPAALKFSFYEVISAGPRAPSELRALQKRCLVPGWYASHIERWLVYFPPFQLLIIDGQQLRTDPATVMDEVQKFLGVLPHYNYSEALTFDSHKGFWCQLLEEGKTKCLGKSKGRKYPPMDSDSRTFLSSYYRDHNVELSKLLHKLGQPLPSWLRQELQKVR

SEQ ID NO: 55559 - protein, 872 aa, Homo sapiens
  Payload ID: 10954
  Gene Symbol: NDST4
  Gene Name: N-deacetylase/N-sulfotransferase (heparan glucosaminyl) 4
  Uniprot ID: Q9H3R1
  ENSP ID: ENSP00000264363
MNLIVKLRRSFRTLIVLLATFCLVSIVISAYFLYSGYKQEMTLIETTAEAECTDIKILPYRSMELKTVKPIDTSKTDPTVLLFVESQYSQLGQDIIAILESSRFQYHMVIAPGKGDIPPLTDNGKGKYTLVIYENILKYVSMDSWNRELLEKYCVEYSVSIIGFHKANENSLPSTQLKGFPLNLFNNLALKDCFVNPQSPLLHITKAPKVEKGPLPGEDWTIFQYNHSTYQPVLLTELQTEKSLSSLSSKTLFATVIQDLGLHDGIQRVLFGNNLNFWLHKLIFIDAISFLSGKRLTLSLDRYILVDIDDIFVGKEGTRMNVKDVKALLETQNLLRTQVANFTFNLGFSGKFYHTGTEEEDEGDDLLLRSVDEFWWFPHMWSHMQPHLFHNESSLVEQMILNKEFALEHGIPINMGYAVAPHHSGVYPVHIQLYAAWKKVWGIQVTSTEEYPHLKPARYRKGFIHNSIMVLPRQTCGLFTHTIFYKEYPGGPQELDKSIRGGELFLTILLNPISIFMTHLSNYGNDRLGLYTFVNLVNFVQSWTNLKLQTLPPVQLAHQYFELFPEQKDPLWQNPCDDKRHKDIWSREKTCDHLPKFLVIGPQKTGTTALYLFLLMHPSIISNLPSPKTFEEVQFFNGNNYHKGIDWYMDFFPTPSNTTSDFLFEKSANYFHSEEAPRRAASLVPKAKIITILIDPSDRAYSWYQHQRSHEDPAALRFNFYEVISTGHWAPSDLKTLQRRCLVPGWYAVHIERWLTYFATSQLLIIDGQQLRSDPATVMDEVQKFLGVTPRYNYSEALTFDPQKGFWCQLLEGGKTKCLGKSKGRKYPPMDPESRTFLSNYYRDHNVELSKLLHRLGQPLPSWLRQELQKVR

SEQ ID NO: 55560 - protein, 369 aa, Homo sapiens
  Payload ID: 10954
  Gene Symbol: NDST4
  Gene Name: N-deacetylase/N-sulfotransferase (heparan glucosaminyl) 4
  Uniprot ID: Q9H3R1
  ENSP ID: ENSP00000423218
MWSHMQPHLFHNESSLVEQMILNKEFALEHGIPINMGYAVAPHHSGVYPVHIQLYAAWKKVWGIQVTSTEEYPHLKPARYRKGFIHNSIMVLPRQTCGLFTHTIFYKEYPGGPQELDKSIRGGELFLTILLNPISIFMTHLSNYGNDRLGLYTFVNLVNFVQSWTNLKLQTLPPVQLAHQYFELFPEQKDPLWQNPCDDKRHKDIWSREKTCDHLPKFLVIGPQKTGTTALYLFLLMHPSIISNLPSPKTFEEVQFFNGNNYHKGIDWYMDFFPTPSNTTSDFLFEKSANYFHSEEAPRRAASLVPKAKIITILIDPSDRAYSWYQVGVQWRDLGSLQPSPPRFMPFSCLSLLSSWDYSTNDHMKIQLL

SEQ ID NO: 55561 - protein, 369 aa, Homo sapiens; identical to SEQ ID NO: 55560
  Payload ID: 10954
  Gene Symbol: NDST4
  Gene Name: N-deacetylase/N-sulfotransferase (heparan glucosaminyl) 4
  Uniprot ID: Q9H3R1
  ENSP ID: ENSP00000483949

SEQ ID NO: 55562 - protein, 328 aa, Homo sapiens
  Payload ID: 10955
  Gene Symbol: NDRG2
  Gene Name: NDRG family member 2
  Uniprot ID: Q9UN36
  ENSP ID: ENSP00000298684
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 55563 - protein, 371 aa, Homo sapiens
  Payload ID: 10955
  Gene Symbol: NDRG2
  Gene Name: NDRG family member 2
  Uniprot ID: Q9UN36
  ENSP ID: ENSP00000298687
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 55564 - protein, 357 aa, Homo sapiens
  Payload ID: 10955
  Gene Symbol: NDRG2
  Gene Name: NDRG family member 2
  Uniprot ID: Q9UN36
  ENSP ID: ENSP00000344620
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 55565 - protein, 357 aa, Homo sapiens; identical to SEQ ID NO: 55564
  Payload ID: 10955
  Gene Symbol: NDRG2
  Gene Name: NDRG family member 2
  Uniprot ID: Q9UN36
  ENSP ID: ENSP00000353649

SEQ ID NO: 55566 - protein, 341 aa, Homo sapiens
  Payload ID: 10955
  Gene Symbol: NDRG2
  Gene Name: NDRG family member 2
  Uniprot ID: Q9UN36
  ENSP ID: ENSP00000380943
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 55567 - protein, 360 aa, Homo sapiens
  Payload ID: 10955
  Gene Symbol: NDRG2
  Gene Name: NDRG family member 2
  Uniprot ID: Q9UN36
  ENSP ID: ENSP00000380945
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 55568 - protein, 371 aa, Homo sapiens; identical to SEQ ID NO: 55563
  Payload ID: 10955
  Gene Symbol: NDRG2
  Gene Name: NDRG family member 2
  Uniprot ID: Q9UN36
  ENSP ID: ENSP00000380949

SEQ ID NO: 55569 - protein, 371 aa, Homo sapiens; identical to SEQ ID NO: 55563
  Payload ID: 10955
  Gene Symbol: NDRG2
  Gene Name: NDRG family member 2
  Uniprot ID: Q9UN36
  ENSP ID: ENSP00000380951

SEQ ID NO: 55570 - protein, 356 aa, Homo sapiens [sequence omitted]

SEQ ID NO: 55571 - protein, 371 aa, Homo sapiens; identical to SEQ ID NO: 55563
  Payload ID: 10955
  Gene Symbol: NDRG2
  Gene Name: NDRG family member 2
  Uniprot ID: Q9UN36
  ENSP ID: ENSP00000380956

SEQ ID NO: 55572 - protein, 367 aa, Homo sapiens
  Payload ID: 10955
  Gene Symbol: NDRG2
  Gene Name: NDRG family member 2
  Uniprot ID: Q9UN36
  ENSP ID: ENSP00000385889
MENGGSMQATMAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 55573 - protein, 181 aa, Homo sapiens
  Payload ID: 10955
  Gene Symbol: NDRG2
  Gene Name: NDRG family member 2
  ENSP ID: ENSP00000397250
THSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLTSSIPEMILGHLFSQEELSGNSELIQKYRNIITHAPNLDNIELYWNSYNNRRDL

SEQ ID NO: 55574 - protein, 137 aa, Homo sapiens
  Payload ID: 10955
  Gene Symbol: NDRG2
  Gene Name: NDRG family member 2
  ENSP ID: ENSP00000450446
MAELQEVQITEEKPLLPGQTPEAAKTHSVETPYGSVTFTVYGTPKPKRPAILTYHDVGLNSTVSVRGHAGNHSELCAGSCGCPWNGRGSPCVPFGISVPISGPACRHDPLRPAVPKFLYNNWSWCWSWSLHPGEICS

SEQ ID NO: 55575 - protein, 92 aa, Homo sapiens
  Payload ID: 10955
  Gene Symbol: NDRG2
  Gene Name: NDRG family member 2
  ENSP ID: ENSP00000450450
MAELQEVQITEEKPLLPGQTPEAAKTHSVETPYGSVTFTVYGTPKPKRPAILTYHDVGLNYKSCFQPLFQFEDMQEIIQNFVRVHVDAPGME

SEQ ID NO: 55576 - protein, 167 aa, Homo sapiens
  Payload ID: 10955
  Gene Symbol: NDRG2
  Gene Name: NDRG family member 2
  ENSP ID: ENSP00000450493
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDW

SEQ ID NO: 55577 - protein, 144 aa, Homo sapiens
  Payload ID: 10955
  Gene Symbol: NDRG2
  Gene Name: NDRG family member 2
  ENSP ID: ENSP00000450504
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALN

SEQ ID NO: 55578 - protein, 153 aa, Homo sapiens
  Payload ID: 10955
  Gene Symbol: NDRG2
  Gene Name: NDRG family member 2
  ENSP ID: ENSP00000450513
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLV

SEQ ID NO: 55579 - protein, 173 aa, Homo sapiens
  Payload ID: 10955
  Gene Symbol: NDRG2
  Gene Name: NDRG family member 2
  ENSP ID: ENSP00000450545
MAELQEVQITEEKPLLPGQTPEAAKPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLD

SEQ ID NO: 55580 - protein, 252 aa, Homo sapiens
  Payload ID: 10955
  Gene Symbol: NDRG2
  Gene Name: NDRG family member 2
  ENSP ID: ENSP00000450691
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDIT

SEQ ID NO: 55581 - protein, 118 aa, Homo sapiens
  Payload ID: 10955
  Gene Symbol: NDRG2
  Gene Name: NDRG family member 2
  ENSP ID: ENSP00000450825
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQY

SEQ ID NO: 55582 - protein, 139 aa, Homo sapiens
  Payload ID: 10955
  Gene Symbol: NDRG2
  Gene Name: NDRG family member 2
  ENSP ID: ENSP00000450835
PKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLSLGWAAWGLA

SEQ ID NO: 55583 - protein, 141 aa, Homo sapiens
  Payload ID: 10955
  Gene Symbol: NDRG2
  Gene Name: NDRG family member 2
  ENSP ID: ENSP00000450852
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTII

SEQ ID NO: 55584 - protein, 122 aa, Homo sapiens
  Payload ID: 10955
  Gene Symbol: NDRG2
  Gene Name: NDRG family member 2
  ENSP ID: ENSP00000450929
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLK

SEQ ID NO: 55585 - protein, 172 aa, Homo sapiens
  Payload ID: 10955
  Gene Symbol: NDRG2
  Gene Name: NDRG family member 2
  ENSP ID: ENSP00000451059
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINID

SEQ ID NO: 55586 - protein, 194 aa, Homo sapiens
  Payload ID: 10955
  Gene Symbol: NDRG2
  Gene Name: NDRG family member 2
  ENSP ID: ENSP00000451094
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIP

SEQ ID NO: 55587 - protein, 221 aa, Homo sapiens
  Payload ID: 10955
  Gene Symbol: NDRG2
  Gene Name: NDRG family member 2
  ENSP ID: ENSP00000451105
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWN

SEQ ID NO: 55588 - protein, 120 aa, Homo sapiens
  Payload ID: 10955
  Gene Symbol: NDRG2
  Gene Name: NDRG family member 2
  ENSP ID: ENSP00000451163
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQY

SEQ ID NO: 55589 - protein, 149 aa, Homo sapiens
  Payload ID: 10955
  Gene Symbol: NDRG2
  Gene Name: NDRG family member 2
  ENSP ID: ENSP00000451185
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGA

SEQ ID NO: 55590 - protein, 273 aa, Homo sapiens
  Payload ID: 10955
  Gene Symbol: NDRG2
  Gene Name: NDRG family member 2
  ENSP ID: ENSP00000451274
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLK

SEQ ID NO: 55591 - protein, 154 aa, Homo sapiens
  Payload ID: 10955
  Gene Symbol: NDRG2
  Gene Name: NDRG family member 2
  ENSP ID: ENSP00000451302
MVMCFCVNPCVSLQEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEG

SEQ ID NO: 55592 - protein, 148 aa, Homo sapiens
  Payload ID: 10955
  Gene Symbol: NDRG2
  Gene Name: NDRG family member 2
  ENSP ID: ENSP00000451348
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAG

SEQ ID NO: 55593 - protein, 136 aa, Homo sapiens
  Payload ID: 10955
  Gene Symbol: NDRG2
  Gene Name: NDRG family member 2
  ENSP ID: ENSP00000451353
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLK

SEQ ID NO: 55594 - protein, 122 aa, Homo sapiens; identical to SEQ ID NO: 55584
  Payload ID: 10955
  Gene Symbol: NDRG2
  Gene Name: NDRG family member 2
  ENSP ID: ENSP00000451414

SEQ ID NO: 55595 - protein, 150 aa, Homo sapiens
  Payload ID: 10955
  Gene Symbol: NDRG2
  Gene Name: NDRG family member 2
  ENSP ID: ENSP00000451471
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVE

SEQ ID NO: 55596 - protein, 133 aa, Homo sapiens
  Payload ID: 10955
  Gene Symbol: NDRG2
  Gene Name: NDRG family member 2
  ENSP ID: ENSP00000451472
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGA

SEQ ID NO: 55597 - protein, 108 aa, Homo sapiens
  Payload ID: 10955
  Gene Symbol: NDRG2
  Gene Name: NDRG family member 2
  ENSP ID: ENSP00000451541
MAELQEVQITEEKPLLPGQTPEAAKTHSVETPYGSVTFTVYGTPKPKRPAILTYHDVGLNSTVSVRGHAGNHSELCAGSCGCPWNGRGSPCVPFGISVPISGPACRHD

SEQ ID NO: 55598 - protein, 371 aa, Homo sapiens; identical to SEQ ID NO: 55563
  Payload ID: 10955
  Gene Symbol: NDRG2
  Gene Name: NDRG family member 2
  Uniprot ID: Q9UN36
  ENSP ID: ENSP00000451712

SEQ ID NO: 55599 - protein, 160 aa, Homo sapiens
  Payload ID: 10955
  Gene Symbol: NDRG2
  Gene Name: NDRG family member 2
  ENSP ID: ENSP00000451951
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPN

SEQ ID NO: 55600 - protein, 300 aa, Homo sapiens
  Payload ID: 10955
  Gene Symbol: NDRG2
  Gene Name: NDRG family member 2
  ENSP ID: ENSP00000451966
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGM

SEQ ID NO: 55601 - protein, 140 aa, Homo sapiens
  Payload ID: 10955
  Gene Symbol: NDRG2
  Gene Name: NDRG family member 2
  ENSP ID: ENSP00000451981
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTI

SEQ ID NO: 55602 - protein, 357 aa, Homo sapiens; identical to SEQ ID NO: 55564
  Payload ID: 10955
  Gene Symbol: NDRG2
  Gene Name: NDRG family member 2
  Uniprot ID: Q9UN36
  ENSP ID: ENSP00000452006

SEQ ID NO: 55603 - protein, 357 aa, Homo sapiens; identical to SEQ ID NO: 55564
  Payload ID: 10955
  Gene Symbol: NDRG2
  Gene Name: NDRG family member 2
  Uniprot ID: Q9UN36
  ENSP ID: ENSP00000452038

SEQ ID NO: 55604 - protein, 77 aa, Homo sapiens
  Payload ID: 10955
  Gene Symbol: NDRG2
  Gene Name: NDRG family member 2
  ENSP ID: ENSP00000452053
MAELQEVQITEEKPLLPGQTPEAAKINLASSHCFSSRTCRKSFRTLCGFMWMPLEWKREPLCSLWDISTHLWTSLQT

SEQ ID NO: 55605 - protein, 287 aa, Homo sapiens
  Payload ID: 10955
  Gene Symbol: NDRG2
  Gene Name: NDRG family member 2
  ENSP ID: ENSP00000452117
  MOD_RES (1)..(1): Any amino acid
XTVCWLAGGWVFVFKTLALQQKAGDRLQVSTLTTRANLWLLGPFFFASSKESFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 55606 - protein, 129 aa, Homo sapiens
  Payload ID: 10955
  Gene Symbol: NDRG2
  Gene Name: NDRG family member 2
  ENSP ID: ENSP00000452179
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIP

SEQ ID NO: 55607 - protein, 284 aa, Homo sapiens
  Payload ID: 10955
  Gene Symbol: NDRG2
  Gene Name: NDRG family member 2
  ENSP ID: ENSP00000452216
MQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 55608 - protein, 127 aa, Homo sapiens
  Payload ID: 10955
  Gene Symbol: NDRG2
  Gene Name: NDRG family member 2
  ENSP ID: ENSP00000452247
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTII

SEQ ID NO: 55609 - protein, 142 aa, Homo sapiens
  Payload ID: 10955
  Gene Symbol: NDRG2
  Gene Name: NDRG family member 2
  ENSP ID: ENSP00000452262
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYA

SEQ ID NO: 55610 - protein, 86 aa, Homo sapiens
  Payload ID: 10955
  Gene Symbol: NDRG2
  Gene Name: NDRG family member 2
  ENSP ID: ENSP00000452274
MAELQEVQITEEKPLLPGQTPEAAKEAELAARILLDQGQTHSVETPYGSVTFTVYGTPKPKRPAILTYHDVGLNYKSCFQPLFQFE

SEQ ID NO: 55611 - protein, 174 aa, Homo sapiens
  Payload ID: 10955
  Gene Symbol: NDRG2
  Gene Name: NDRG family member 2
  ENSP ID: ENSP00000452278
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTG

SEQ ID NO: 55612 - protein, 108 aa, Homo sapiens
  Payload ID: 10955
  Gene Symbol: NDRG2
  Gene Name: NDRG family member 2
  ENSP ID: ENSP00000452302
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLD

SEQ ID NO: 55613 - protein, 357 aa, Homo sapiens; identical to SEQ ID NO: 55564
  Payload ID: 10955
  Gene Symbol: NDRG2
  Gene Name: NDRG family member 2
  Uniprot ID: Q9UN36
  ENSP ID: ENSP00000452306

SEQ ID NO: 55614 - protein, 224 aa, Homo sapiens
  Payload ID: 10955
  Gene Symbol: NDRG2
  Gene Name: NDRG family member 2
  ENSP ID: ENSP00000452334
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYN

SEQ ID NO: 55615 - protein, 127 aa, Homo sapiens; identical to SEQ ID NO: 55608
  Payload ID: 10955
  Gene Symbol: NDRG2
  Gene Name: NDRG family member 2
  ENSP ID: ENSP00000452344

SEQ ID NO: 55616 - protein, 273 aa, Homo sapiens; identical to SEQ ID NO: 55590
  Payload ID: 10955
  Gene Symbol: NDRG2
  Gene Name: NDRG family member 2
  ENSP ID: ENSP00000452362

SEQ ID NO: 55617 - protein, 218 aa, Homo sapiens
  Payload ID: 10955
  Gene Symbol: NDRG2
  Gene Name: NDRG family member 2
  ENSP ID: ENSP00000452413
MQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTE

SEQ ID NO: 55618 - protein, 99 aa, Homo sapiens
  Payload ID: 10955
  Gene Symbol: NDRG2
  Gene Name: NDRG family member 2
  ENSP ID: ENSP00000452458
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVH

SEQ ID NO: 55619 - protein, 219 aa, Homo sapiens
  Payload ID: 10955
  Gene Symbol: NDRG2
  Gene Name: NDRG family member 2
  ENSP ID: ENSP00000452482
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRN

SEQ ID NO: 55620 - protein, 149 aa, Homo sapiens
  Payload ID: 10955
  Gene Symbol: NDRG2
  Gene Name: NDRG family member 2
  ENSP ID: ENSP00000452548
MAELQEVQITEEKPLLPGQTPEAAKTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTV

SEQ ID NO: 55621 - protein, 153 aa, Homo sapiens; identical to SEQ ID NO: 55578
  Payload ID: 10955
  Gene Symbol: NDRG2
  Gene Name: NDRG family member 2
  ENSP ID: ENSP00000452592

SEQ ID NO: 55622 - protein, 224 aa, Homo sapiens
  Payload ID: 10955
  Gene Symbol: NDRG2
  Gene Name: NDRG family member 2
  ENSP ID: ENSP00000489341
  MOD_RES (1)..(1): Any amino acid
XKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVTSFLKMADSGGQPQLTQPGKLTEAFKY

SEQ ID NO: 55623 - protein, 375 aa, Homo sapiens
  Payload ID: 10956
  Gene Symbol: NDRG3
  Gene Name: NDRG family member 3
  Uniprot ID: Q9UGV2
  ENSP ID: ENSP00000345292
MDELQDVQLTEIKPLLNDKNGTRNFQDFDCQEHDIETTHGVVHVTIRGLPKGNRPVILTYHDIGLNHKSCFNAFFNFEDMQEITQHFAVCHVDAPGQQEGAPSFPTGYQYPTMDELAEMLPPVLTHLSLKSIIGIGVGAGAYILSRFALNHPELVEGLVLINVDPCAKGWIDWAASKLSGLTTNVVDIILAHHFGQEELQANLDLIQTYRMHIAQDINQDNLQLFLNSYNGRRDLEIERPILGQNDNKSKTLKCSTLLVVGDNSPAVEAVVECNSRLNPINTTLLKMADCGGLPQVVQPGKLTEAFKYFLQGMGYIPSASMTRLARSRTHSTSSSLGSGESPFSRSVTSNQSDGTQESCESPDVLDRHQTMEVSC

SEQ ID NO: 55624 - protein, 363 aa, Homo sapiens
  Payload ID: 10956
  Gene Symbol: NDRG3
  Gene Name: NDRG family member 3
  Uniprot ID: Q9UGV2
  ENSP ID: ENSP00000352703
MDELQDVQLTEIKPLLNDKEHDIETTHGVVHVTIRGLPKGNRPVILTYHDIGLNHKSCFNAFFNFEDMQEITQHFAVCHVDAPGQQEGAPSFPTGYQYPTMDELAEMLPPVLTHLSLKSIIGIGVGAGAYILSRFALNHPELVEGLVLINVDPCAKGWIDWAASKLSGLTTNVVDIILAHHFGQEELQANLDLIQTYRMHIAQDINQDNLQLFLNSYNGRRDLEIERPILGQNDNKSKTLKCSTLLVVGDNSPAVEAVVECNSRLNPINTTLLKMADCGGLPQVVQPGKLTEAFKYFLQGMGYIPSASMTRLARSRTHSTSSSLGSGESPFSRSVTSNQSDGTQESCESPDVLDRHQTMEVSC

SEQ ID NO: 55625 - protein, 280 aa, Homo sapiens
  Payload ID: 10956
  Gene Symbol: NDRG3
  Gene Name: NDRG family member 3
  ENSP ID: ENSP00000362878
MVQETSRTLTVRYQYPTMDELAEMLPPVLTHLSLKSIIGIGVGAGAYILSRFALNHPELVEGLVLINVDPCAKGWIDWAASKLSGLTTNVVDIILAHHFGQEELQANLDLIQTYRMHIAQDINQDNLQLFLNSYNGRRDLEIERPILGQNDNKSKTLKCSTLLVVGDNSPAVEAVVECNSRLNPINTTLLKMADCGGLPQVVQPGKLTEAFKYFLQGMGYIPSASMTRLARSRTHSTSSSLGSGESPFSRSVTSNQSDGTQESCESPDVLDRHQTMEVSC

SEQ ID NO: 55626 - protein, 388 aa, Homo sapiens
  Payload ID: 10956
  Gene Symbol: NDRG3
  Gene Name: NDRG family member 3
  ENSP ID: ENSP00000362909
MDELQDVQLTEIKPLLNDKNGTRNFQDFDCQEHDIETTHGVVHVTIRGLPKGNRPVILTYHDIGLNHKSCFNAFFNFEDMQEITQHFAVCHVDAPGQQEGAPSFPTGYQYPTMDELAEMLPPVLTHLSLKSIIGIGVGAGAYILSRFALNHPELVEGLVLINVDPCAKGWIDWAASKLSGLTTNVVDIILAHHFGQEELQANLDLIQTYRMHIAQDINQDNLQLFLNSYNGRRDLEIERPILGQNDNKSKTLKCSTLLVVGDNSPAVEAVVECNSRLNPINTTLLKMADCGGLPQVVQPGKLTEAFKYFLQGMGYIPYVQLSHLSTESVPSASMTRLARSRTHSTSSSLGSGESPFSRSVTSNQSDGTQESCESPDVLDRHQTMEVSC

SEQ ID NO: 55627 - protein, 187 aa, Homo sapiens
  Payload ID: 10956
  Gene Symbol: NDRG3
  Gene Name: NDRG family member 3
  ENSP ID: ENSP00000416636
MEFFSSCSFTRSRKICMPITMEEHDIETTHGVVHVTIRGLPKGNRPVILTYHDIGLNHKSCFNAFFNFEDMQEITQHFAVCHVDAPGQQEGAPSFPTGYQYPTMDELAEMLPPVLTHLSLKSIIGIGVGAGAYILSRFALNHPELVEGLVLINVDPCAKGWIDWAASKLSGLTTNVVDIILAHHFGQ

SEQ ID NO: 55628 - protein, 371 aa, Homo sapiens
  Payload ID: 10957
  Gene Symbol: NDRG4
  Gene Name: NDRG family member 4
  Uniprot ID: Q9ULP0
  ENSP ID: ENSP00000258187
MAGLQELRFPEEKPLLRGQDATELESSDAFLLAADTDWKEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 55629 - protein, 369 aa, Homo sapiens
  Payload ID: 10957
  Gene Symbol: NDRG4
  Gene Name: NDRG family member 4
  Uniprot ID: Q9ULP0
  ENSP ID: ENSP00000349193
MPECWDGVGEGNAGAVKLAGLGDPRWSPGHLLSPGHQEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 55630 - protein, 371 aa, Homo sapiens; identical to SEQ ID NO: 55628
  Payload ID: 10957
  Gene Symbol: NDRG4
  Gene Name: NDRG family member 4
  Uniprot ID: Q9ULP0
  ENSP ID: ENSP00000377820

SEQ ID NO: 55631 - protein, 391 aa, Homo sapiens
  Payload ID: 10957
  Gene Symbol: NDRG4
  Gene Name: NDRG family member 4
  Uniprot ID: Q9ULP0
  ENSP ID: ENSP00000377823
MKVLGHRLELLTGLLLHDVTMAGLQELRFPEEKPLLRGQDATELESSDAFLLAADTDWKEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 55632 - protein, 199 aa, Homo sapiens
  Payload ID: 10957
  Gene Symbol: NDRG4
  Gene Name: NDRG family member 4
  ENSP ID: ENSP00000454216
MAGLQELRFPEEKPLLRGQDATELESSDAFLLAADTDWKRSQERRLPRVSSTVSPLQEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDW

SEQ ID NO: 55633 - protein, 81 aa, Homo sapiens
  Payload ID: 10957
  Gene Symbol: NDRG4
  Gene Name: NDRG family member 4
  ENSP ID: ENSP00000454221
  MOD_RES (1)..(1): Any amino acid
XANLQLFWNMYNRPAPTQRAARGWARSTTPWRCPVEALDPADDAHVEAPPPSLRRLMFPLVYFCEGKGEEMGFCLKKMRGS

SEQ ID NO: 55634 - protein, 84 aa, Homo sapiens
  Payload ID: 10957
  Gene Symbol: NDRG4
  Gene Name: NDRG family member 4
  ENSP ID: ENSP00000454274
MQEITKHFVVCHVDAPGQQVGASQFPQGYQFPSMEQLAAMLPSVVQHFGFKYVIGIGVGAGAYVLAKFALIFPDLVEGLVLVNI

SEQ ID NO: 55635 - protein, 63 aa, Homo sapiens
  Payload ID: 10957
  Gene Symbol: NDRG4
  Gene Name: NDRG family member 4
  ENSP ID: ENSP00000454372
MPECWDGVGEGNAGAVKLAGLGDPRWSPGHLLSPGHQPHPPELRELTGGCERAAWSGAPSGGT

SEQ ID NO: 55636 - protein, 339 aa, Homo sapiens
  Payload ID: 10957
  Gene Symbol: NDRG4
  Gene Name: NDRG family member 4
  Uniprot ID: Q9ULP0
  ENSP ID: ENSP00000454410
MPECWDGEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 55637 - protein, 149 aa, Homo sapiens
  Payload ID: 10957
  Gene Symbol: NDRG4
  Gene Name: NDRG family member 4
  ENSP ID: ENSP00000454509
MAGLQELRFPEEKPLLRGQDATELESSDAFLLAADTDWKEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGA

SEQ ID NO: 55638 - protein, 145 aa, Homo sapiens
  Payload ID: 10957
  Gene Symbol: NDRG4
  Gene Name: NDRG family member 4
  ENSP ID: ENSP00000454693
MAGLQELRFPEEKPLLRGQDATELEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFAVSLP

SEQ ID NO: 55639 - protein, 156 aa, Homo sapiens
  Payload ID: 10957
  Gene Symbol: NDRG4
  Gene Name: NDRG family member 4
  ENSP ID: ENSP00000454745
MAGLQELRFPEEKPLLRGQDATELESSDAFLLAADTDWKEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFA

SEQ ID NO: 55640 - protein, 39 aa, Homo sapiens
  Payload ID: 10957
  Gene Symbol: NDRG4
  Gene Name: NDRG family member 4
  ENSP ID: ENSP00000454767
MAGLQELRFPEEKPLLRGQDATELESSDAFLLAADTDWK

SEQ ID NO: 55641 - protein, 191 aa, Homo sapiens
  Payload ID: 10957
  Gene Symbol: NDRG4
  Gene Name: NDRG family member 4
  ENSP ID: ENSP00000454811
  MOD_RES (1)..(1): Any amino acid
XVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQELVNNTELVQSYRQQIGNVVNQANLQLFWNMYNSRRD

SEQ ID NO: 55642 - protein, 157 aa, Homo sapiens
  Payload ID: 10957
  Gene Symbol: NDRG4
  Gene Name: NDRG family member 4
  ENSP ID: ENSP00000454893
MAGLQELRFPEEKPLLRGQDATELESSDAFLLAADTDWKVGEGNAGAVKLAGLGDPRWSPGHLLSPGHQEHDIETPYGLLHVVIRGSPKGNRPAILTYHDVGLNHKLCFNTFFNFEDMQEITKHFVVCHVDAPGQQVGASQFPQGYQFPSMEQLAAM

SEQ ID NO: 55643 - protein, 153 aa, Homo sapiens
  Payload ID: 10957
  Gene Symbol: NDRG4
  Gene Name: NDRG family member 4
  ENSP ID: ENSP00000454956
MAGLQELRFPEEKPLLRGQDATELESSDAFLLAADTDWKEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLA

SEQ ID NO: 55644 - protein, 153 aa, Homo sapiens
  Payload ID: 10957
  Gene Symbol: NDRG4
  Gene Name: NDRG family member 4
  ENSP ID: ENSP00000455054
MKVLGHRLELLTGLLLHDVTMAGLQELRFPEEKPLLRGQDATELESSDAFLLAADTDWKRSQERRLPRVSSTVSPLQEHDIETPYGLLHVVIRGSPKGNRPAILTYHDVGLNHKLCFNTFFNFEDMQEITKHFVVCHVDAPGQQVGASQFPQG

SEQ ID NO: 55645 - protein, 111 aa, Homo sapiens
  Payload ID: 10957
  Gene Symbol: NDRG4
  Gene Name: NDRG family member 4
  ENSP ID: ENSP00000455324
MAGLQELRFPEEKPLLRGQDATELESSDAFLLAADTDWKEHDIETPYGLLHVVIRGSPKGNRPAILTYHDVGLNHKLCFNTFFNFEDMQEITKHFVVCHVDAPGQQVGASQ

SEQ ID NO: 55646 - protein, 154 aa, Homo sapiens
  Payload ID: 10957
  Gene Symbol: NDRG4
  Gene Name: NDRG family member 4
  ENSP ID: ENSP00000455421
  MOD_RES (1)..(1): Any amino acid
XQLIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQCPQPA

SEQ ID NO: 55647 - protein, 40 aa, Homo sapiens
  Payload ID: 10957
  Gene Symbol: NDRG4
  Gene Name: NDRG family member 4
  ENSP ID: ENSP00000455465
MAGLQELRFPEEKPLLRGQDATELESSDAFLLAADTDWKA

SEQ ID NO: 55648 - protein, 38 aa, Homo sapiens
  Payload ID: 10957
  Gene Symbol: NDRG4
  Gene Name: NDRG family member 4
  ENSP ID: ENSP00000455518
MPECWDGVGEGNAGAVKLAGLGDPRWSPGHLLSPGHQA

SEQ ID NO: 55649 - protein, 83 aa, Homo sapiens
  Payload ID: 10957
  Gene Symbol: NDRG4
  Gene Name: NDRG family member 4
  ENSP ID: ENSP00000455541
MMWASTDMQEITKHFVVCHVDAPGQQVGASQFPQGYQFPSMEQLAAMLPSVVQHFGFKYVIGIGVGAGAYVLAKFALIFPDLV

SEQ ID NO: 55650 - protein, 173 aa, Homo sapiens
  Payload ID: 10957
  Gene Symbol: NDRG4
  Gene Name: NDRG family member 4
  ENSP ID: ENSP00000455660
MSTDSSLLLHDVTMAGLQELRFPEEKPLLRGQDATELESSDAFLLAADTDWKEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFAVSLP

SEQ ID NO: 55651 - protein, 327 aa, Homo sapiens
  Payload ID: 10957
  Gene Symbol: NDRG4
  Gene Name: NDRG family member 4
  ENSP ID: ENSP00000455806
MPECWDGEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKPGKLTEAFKYFLQGMGYMPSASMTRLARSRTASLTSASSVDGSRPQACTHSESSEGLGQVNHTMEVSC

SEQ ID NO: 55652 - protein, 150 aa, Homo sapiens
  Payload ID: 10957
  Gene Symbol: NDRG4
  Gene Name: NDRG family member 4
  ENSP ID: ENSP00000456135
MAGLQELRFPEEKPLLRGQDATELESSDAFLLAADTDWKEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAY

SEQ ID NO: 55653 - protein, 357 aa, Homo sapiens
  Payload ID: 10957
  Gene Symbol: NDRG4
  Gene Name: NDRG family member 4
  Uniprot ID: Q9ULP0
  ENSP ID: ENSP00000456338
MPECWDGRSQERRLPRVSSTVSPLQEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 55654 - protein, 142 aa, Homo sapiens
  Payload ID: 10957
  Gene Symbol: NDRG4
  Gene Name: NDRG family member 4
  ENSP ID: ENSP00000456400
MAGLQELRFPEEKPLLRGQDATELESSDAFLLAADTDWKEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIG

SEQ ID NO: 55655 - protein, 65 aa, Homo sapiens
  Payload ID: 10957
  Gene Symbol: NDRG4
  Gene Name: NDRG family member 4
  ENSP ID: ENSP00000456583
MKVLGHRLELLTGLLLHDVTMAGLQELRFPEEKPLLRGQDATELESSDAFLLAADTDWKPQRPGH

SEQ ID NO: 55656 - protein, 109 aa, Homo sapiens
  Payload ID: 10957
  Gene Symbol: NDRG4
  Gene Name: NDRG family member 4
  ENSP ID: ENSP00000456641
MQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDT

SEQ ID NO: 55657 - protein, 35 aa, Homo sapiens
  Payload ID: 10957
  Gene Symbol: NDRG4
  Gene Name: NDRG family member 4
  ENSP ID: ENSP00000456863
MQEITKHFVVCHVDAPGQQVGASQFPQGYQFPSME

SEQ ID NO: 55658 - protein, 284 aa, Homo sapiens
  Payload ID: 10957
  Gene Symbol: NDRG4
  Gene Name: NDRG family member 4
  ENSP ID: ENSP00000457119
MQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 55659 - protein, 143 aa, Homo sapiens
  Payload ID: 10957
  Gene Symbol: NDRG4
  Gene Name: NDRG family member 4
  ENSP ID: ENSP00000457413
MPECWDGVGEGNAGAVKLAGLGDPRWSPGHLLSPGHQEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGV

SEQ ID NO: 55660 - protein, 128 aa, Homo sapiens
  Payload ID: 10957
  Gene Symbol: NDRG4
  Gene Name: NDRG family member 4
  ENSP ID: ENSP00000457435
MQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQ

SEQ ID NO: 55661 - protein, 45 aa, Homo sapiens
  Payload ID: 10957
  Gene Symbol: NDRG4
  Gene Name: NDRG family member 4
  ENSP ID: ENSP00000457638
MKVLGHRLELLTGSQNRGFPNHGFMILRPPAPRRDHGRAAGAAIP

SEQ ID NO: 55662 - protein, 352 aa, Homo sapiens
  Payload ID: 10957
  Gene Symbol: NDRG4
  Gene Name: NDRG family member 4
  Uniprot ID: Q9ULP0
  ENSP ID: ENSP00000457659
MPECWDGEHDIETPYGLLHVVIRGSPKGNRPAILTYHDVGLNHKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYIAYLKDRRLSGGAVPSASMTRLARSRTASLTSASSVDGSRPQACTHSESSEGLGQVNHTMEVSC

SEQ ID NO: 55663 - protein, 64 aa, Homo sapiens
  Payload ID: 10957
  Gene Symbol: NDRG4
  Gene Name: NDRG family member 4
  ENSP ID: ENSP00000457678
MQEITKHFVVCHVDAPGQQVGASQFPQGYQFPSMEQLAAMLPSVVQHFGFKYVIGIGVGAGAYV

SEQ ID NO: 55664 - protein, 19 aa, Homo sapiens
  Payload ID: 10957
  Gene Symbol: NDRG4
  Gene Name: NDRG family member 4
  ENSP ID: ENSP00000458032
MMWASTTNYASTPSSTSRT

SEQ ID NO: 55665 - protein, 153 aa, Homo sapiens
  Payload ID: 10957
  Gene Symbol: NDRG4
  Gene Name: NDRG family member 4
  ENSP ID: ENSP00000458092
MKVLGHRLELLTGLLLHDVTMAGLQELRFPEEKPLLRGQDATELESSDAFLLAADTDWKVGEGNAGAVKLAGLGDPRWSPGHLLSPGHQEHDIETPYGLLHVVIRGSPKGNRPAILTYHDVGLNHKLCFNTFFNFEDMQEITKHFVVCHVDAP

SEQ ID NO: 55666 - protein, 357 aa, Homo sapiens
  Payload ID: 10957
  Gene Symbol: NDRG4
  Gene Name: NDRG family member 4
  Uniprot ID: Q9ULP0
  ENSP ID: ENSP00000458113
MPECWDGEHDIETPYGLLHVVIRGSPKGNRPAILTYHDVGLNRKCSPASVSPPLPPISQSDKLCFNTFFNFEDMQEITKHFVVCHVDAPGQQVGASQFPQGYQFPSMEQLAAMLPSVVQHFGFKYVIGIGVGAGAYVLAKFALIFPDLVEGLVLVNIDPNGKGWIDWAATKLSGLTSTLPDTVLSHLFSQEELVNNTELVQSYRQQIGNVVNQANLQLFWNMYNSRRDLDINRPGTVPNAKTLRCPVMLVVGDNAPAEDGVVECNSKLDPTTTTFLKMADSGGLPQVTQPGKLTEAFKYFLQGMGYMPSASMTRLARSRTASLTSASSVDGSRPQACTHSESSEGLGQVNHTMEVSC

SEQ ID NO: 55667 - protein, 81 aa, Homo sapiens
  Payload ID: 10958
  Gene Symbol: NDUFA4
  Gene Name: NDUFA4, mitochondrial complex associated
  Uniprot ID: O00483
  ENSP ID: ENSP00000339720
MLRQIIGQAKKHPSLIPLFVFIGTGATGATLYLLRLALFNPDVCWDRNNPEPWNKLGPNDQYKFYSVNVDYSKLKKERPDF

SEQ ID NO: 55668 - protein, 114 aa, Homo sapiens
  Payload ID: 10959
  Gene Symbol: NDUFC2-KCTD14
  Gene Name: NDUFC2-KCTD14 readthrough
  Uniprot ID: E9PQ53
  ENSP ID: ENSP00000432614
MIARRNPEPLRFLPDEARSLPPPKLTDPRLLYIGFLGYCSGLIDNLIRRRPIATAGLHRQLLYITAFFFAGYYLVKREDYLYAVRDREMFGYMKLHPEDFPEEDVYCCGAERRG

SEQ ID NO: 55669 - protein, 66 aa, Homo sapiens
  Payload ID: 10959
  Gene Symbol: NDUFC2-KCTD14
  Gene Name: NDUFC2-KCTD14 readthrough
  ENSP ID: ENSP00000435967
MIARRNPEPLRFLPDEARSLPPPKLTDPRLLYIGFLGYCSGLIDNLIRRRPIATADVYCCGAERRG

SEQ ID NO: 55670 - protein, 134 aa, Homo sapiens
  Payload ID: 10959
  Gene Symbol: NDUFC2-KCTD14
  Gene Name: NDUFC2-KCTD14 readthrough
  ENSP ID: ENSP00000478766
MIARRNPEPLRFLPDEARSLPPPKLTDPRLLYIGFLGYCSGLIDNLIRRRPIATAGLHRQLLYITAFFFAGYYLVKREDYLYAVRDREMFGYMKLHPEDFPEEGGDIGLCCLSPGSLSDTPAVFAVGSSAATTH

SEQ ID NO: 55671 - protein, 86 aa, Homo sapiens
  Payload ID: 10959
  Gene Symbol: NDUFC2-KCTD14
  Gene Name: NDUFC2-KCTD14 readthrough
  ENSP ID: ENSP00000481472
MIARRNPEPLRFLPDEARSLPPPKLTDPRLLYIGFLGYCSGLIDNLIRRRPIATAGGDIGLCCLSPGSLSDTPAVFAVGSSAATTH

SEQ ID NO: 55672 - protein, 1014 aa, Homo sapiens
  Payload ID: 10960
  Gene Symbol: NEBL
  Gene Name: nebulette
  Uniprot ID: O76041
  ENSP ID: ENSP00000366326
MRVPVFEDIKDETEEEKIGEEENEEDQVFYKPVIEDLSMELARKCTELISDIRYKEEFKKSKDKCTFVTDSPMLNHVKNIGAFISEAKYKGTIKADLSNSLYKRMPATIDSVFAGEVTQLQSEVAYKQKHDAAKGFSDYAHMKEPPEVKHAMEVNKHQSNISYRKDVQDTHTYSAELDRPDIKMATQISKIISNAEYKKGQGIMNKEPAVIGRPDFEHAVEASKLSSQIKYKEKFDNEMKDKKHHYNPLESASFRQNQLAATLASNVKYKKDIQNMHDPVSDLPNLLFLDHVLKASKMLSGREYKKLFEENKGMYHFDADAVEHLHHKGNAVLQSQVKYKEEYEKNKGKPMLEFVETPSYQASKEAQKMQSEKVYKEDFEKEIKGRSSLDLDKTPEFLHVKYITNLLREKEYKKDLENEIKGKGMELNSEVLDIQRAKRASEMASEKEYKKDLESIIKGKGMQAGTDTLEMQHAKKAAEIASEKDYKRDLETEIKGKGMQVSTDTLDVQRAKKASEMASQKQYKKDLENEIKGKGMQVSMDIPDILRAKRTSEIYSQRKYKDEAEKMLSNYSTIADTPEIQRIKTTQQNISAVFYKKEVGAGTAVKDSPEIERVKKNQQNISSVKYKEEIKHATAISDPPELKRVKENQKNISNLQYKEQNYKATPVSMTPEIERVRRNQEQLSAVKYKGELQRGTAISDPPELKRAKENQKNISNVYYRGQLGRATTLSVTPEMERVKKNQENISSVKYTQDHKQMKGRPSLILDTPAMRHVKEAQNHISMVKYHEDFEKTKGRGFTPVVDDPVTERVRKNTQVVSDAAYKGVHPHIVEMDRRPGIIVDLKVWRTDPGSIFDLDPLEDNIQSRSLHMLSEKASHYRRHWSRSHSSSTFGTGLGDDRSEISEIYPSFSCCSEVTRPSDEGAPVLPGAYQQSHSQGYGYMHQTSVSSMRSMQHSPNLRTYRAMYDYSAQDEDEVSFRDGDYIVNVQPIDDGWMYGTVQRTGRTGMLPANYIEFVN

SEQ ID NO: 55673 - protein, 270 aa, Homo sapiens
  Payload ID: 10960
  Gene Symbol: NEBL
  Gene Name: nebulette
  Uniprot ID: O76041
  ENSP ID: ENSP00000393896
MNPQCARCGKVVYPTEKVNCLDKYWHKGCFHCEVCKMALNMNNYKGYEKKPYCNAHYPKQSFTTVADTPENLRLKQQSELQSQVKYKRDFEESKGRGFSIVTDTPELQRLKRTQEQISNVKYHEDFEKTKGRGFTPVVDDPVTERVRKNTQVVSDAAYKGVHPHIVEMDRRPGIIVAPVLPGAYQQSHSQGYGYMHQTSVSSMRSMQHSPNLRTYRAMYDYSAQDEDEVSFRDGDYIVNVQPIDDGWMYGTVQRTGRTGMLPANYIEFVN

SEQ ID NO: 55674 - protein, 117 aa, Homo sapiens
  Payload ID: 10960
  Gene Symbol: NEBL
  Gene Name: nebulette
  ENSP ID: ENSP00000396512
MRNNCTASLMKVFYKPVIEDLSMELARKCTELISDIRYKEEFKKSKDKCTFVTDSPMLNHVKNIGAFISEAKYKGTIKADLSNSLYKRMPATIDSVFAGEVTQLQSEVAYKQKHDAA

SEQ ID NO: 55675 - protein, 115 aa, Homo sapiens
  Payload ID: 10960
  Gene Symbol: NEBL
  Gene Name: nebulette
  ENSP ID: ENSP00000489224
  MOD_RES (1)..(1): Any amino acid
XKNQQNISSVKYKEEIKHATAISDPPELKRVKENQKNISNLQYKEQNYKATPVSMTPEIERVRRNQEQLSAVKYKGELQRGTAISDPPELKRAKENQKNISNVFITEVSWEELPL

SEQ ID NO: 55676 - protein, 63 aa, Homo sapiens
  Payload ID: 10960
  Gene Symbol: NEBL
  Gene Name: nebulette
  ENSP ID: ENSP00000489545
VSMTPEIERVRRNQEQLSAGMNCVSRKFGTVLLYLSCVCLFKRSSLSTQMYWALSWSPRHKDG

SEQ ID NO: 55677 - protein, 94 aa, Homo sapiens
  Payload ID: 10960
  Gene Symbol: NEBL
  Gene Name: nebulette
  ENSP ID: ENSP00000489562
DPPELKRAKENQKNISNVYYRGQLGRATTLSVTPEMERVKKNQENISSVKYTQDHKQMKGRPSLILDTPAMRHVKEAQNHISMVGSNQIILKTC

SEQ ID NO: 55678 - protein, 6669 aa, Homo sapiens
  Payload ID: 10961
  Gene Symbol: NEB
  Gene Name: nebulin
  Uniprot ID: P20929
  ENSP ID: ENSP00000172853
MADDEDYEEVVEYYTEEVVYEEVPGETITKIYETTTTRTSDYEQSETSKPALAQPALAQPASAKPVERRKVIRKKVDPSKFMTPYIAHSQKMQDLFSPNKYKEKFEKTKGQPYASTTDTPELRRIKKVQDQLSEVKYRMDGDVAKTICHVDEKAKDIEHAKKVSQQVSKVLYKQNWEDTKDKYLLPPDAPELVQAVKNTAMFSKKLYTEDWEADKSLFYPYNDSPELRRVAQAQKALSDVAYKKGLAEQQAQFTPLADPPDIEFAKKVTNQVSKQKYKEDYENKIKGKWSETPCFEVANARMNADNISTRKYQEDFENMKDQIYFMQTETPEYKMNKKAGVAASKVKYKEDYEKNKGKADYNVLPASENPQLRQLKAAGDALSDKLYKENYEKTKAKSINYCETPKFKLDTVLQNFSSDKKYKDSYLKDILGHYVGSFEDPYHSHCMKVTAQNSDKNYKAEYEEDRGKGFFPQTITQEYEAIKKLDQCKDHTYKVHPDKTKFTQVTDSPVLLQAQVNSKQLSDLNYKAKHESEKFKCHIPPDTPAFIQHKVNAYNLSDNLYKQDWEKSKAKKFDIKVDAIPLLAAKANTKNTSDVMYKKDYEKNKGKMIGVLSINDDPKMLHSLKVAKNQSDRLYKENYEKTKAKSMNYCETPKYQLDTQLKNFSEARYKDLYVKDVLGHYVGSMEDPYHTHCMKVAAQNSDKSYKAEYEEDKGKCYFPQTITQEYEAIKKLDQCKDHTYKVHPDKTKFTAVTDSPVLLQAQLNTKQLSDLNYKAKHEGEKFKCHIPADAPQFIQHRVNAYNLSDNVYKQDWEKSKAKKFDIKVDAIPLLAAKANTKNTSDVMYKKDYEKSKGKMIGALSINDDPKMLHSLKTAKNQSDREYRKDYEKSKTIYTAPLDMLQVTQAKKSQAIASDVDYKHILHSYSYPPDSINVDLAKKAYALQSDVEYKADYNSWMKGCGWVPFGSLEMEKAKRASDILNEKKYRQHPDTLKFTSIEDAPITVQSKINQAQRSDIAYKAKGEEIIHKYNLPPDLPQFIQAKVNAYNISENMYKADLKDLSKKGYDLRTDAIPIRAAKAARQAASDVQYKKDYEKAKGKMVGFQSLQDDPKLVHYMNVAKIQSDREYKKDYEKTKSKYNTPHDMFNVVAAKKAQDVVSNVNYKHSLHHYTYLPDAMDLELSKNMMQIQSDNVYKEDYNNWMKGIGWIPIGSLDVEKVKKAGDALNEKKYRQHPDTLKFTSIVDSPVMVQAKQNTKQVSDILYKAKGEDVKHKYTMSPDLPQFLQAKCNAYNISDVCYKRDWYDLIAKGNNVLGDAIPITAAKASRNIASDYKYKEAYEKSKGKHVGFRSLQDDPKLVHYMNVAKLQSDREYKKNYENTKTSYHTPGDMVSITAAKMAQDVATNVNYKQPLHHYTYLPDAMSLEHTRNVNQIQSDNVYKDEYNSFLKGIGWIPIGSLEVEKVKKAGDALNERKYRQHPDTVKFTSVPDSMGMVLAQHNTKQLSDLNYKVEGEKLKHKYTIDPELPQFIQAKVNALNMSDAHYKADWKKTIAKGYDLRPDAIPIVAAKSSRNIASDCKYKEAYEKAKGKQVGFLSLQDDPKLVHYMNVAKIQSDREYKKGYEASKTKYHTPLDMVSVTAAKKSQEVATNANYRQSYHHYTLLPDALNVEHSRNAMQIQSDNLYKSDFTNWMKGIGWVPIESLEVEKAKKAGEILSEKKYRQHPEKLKFTYAMDTMEQALNKSNKLNMDKRLYTEKWNKDKTTIHVMPDTPDILLSRVNQITMSDKLYKAGWEEEKKKGYDLRPDAIAIKAARASRDIASDYKYKKAYEQAKGKHIGFRSLEDDPKLVHFMQVAKMQSDREYKKGYEKSKTSFHTPVDMLSVVAAKKSQEVATNANYRNVIHTYNMLPDAMSFELAKNMMQIQSDNQYKADYADFMKGIGWLPLGSLEAEKNKKAMEIISEKKYRQHPDTLKYSTLMDSMNMVLAQNNAKIMNEHLYKQAWEADKTKVHIMPDIPQIILAKANAINMSDKLYKLSLEESKKKGYDLRPDAIPIKAAKASRDIASDYKYKYNYEKGKGKMVGFRSLEDDPKLVHSMQVAKMQSDREYKKNYENTKTSYHTPADMLSVTAAKDAQANITNTNYKHLIHKYILLPDAMNIELTRNMNRIQSDNEYKQDYNEWYKGLGWSPAGSLEVEKAKKATEYASDQKYRQHPSNFQFKKLTDSMDMVLAKQNAHTMNKHLYTIDWNKDKTKIHVMPDTPDILQAKQNQTLYSQKLYKLGWEEALKKGYDLPVDAISVQLAKASRDIASDYKYKQGYRKQLGHHVGFRSLQDDPKLVLSMNVAKMQSEREYKKDFEKWKTKFSSPVDMLGVVLAKKCQELVSDVDYKNYLHQWTCLPDQNDVVQAKKVYELQSENLYKSDLEWLRGIGWSPLGSLEAEKNKRASEIISEKKYRQPPDRNKFTSIPDAMDIVLAKTNAKNRSDRLYREAWDKDKTQIHIMPDTPDIVLAKANLINTSDKLYRMGYEELKRKGYDLPVDAIPIKAAKASREIASEYKYKEGFRKQLGHHIGARNIEDDPKMMWSMHVAKIQSDREYKKDFEKWKTKFSSPVDMLGVVLAKKCQTLVSDVDYKNYLHQWTCLPDQSDVIHARQAYDLQSDNLYKSDLQWLKGIGWMTSGSLEDEKNKRATQILSDHVYRQHPDQFKFSSLMDSIPMVLAKNNAITMNHRLYTEAWDKDKTTVHIMPDTPEVLLAKQNKVNYSEKLYKLGLEEAKRKGYDMRVDAIPIKAAKASRDIASEFKYKEGYRKQLGHHIGARAIRDDPKMMWSMHVAKIQSDREYKKDFEKWKTKFSSPVDMLGVVLAKKCQTLVSDVDYKNYLHQWTCLPDQSDVIHARQAYDLQSDNMYKSDLQWMRGIGWVSIGSLDVEKCKRATEILSDKIYRQPPDRFKFTSVTDSLEQVLAKNNAITMNKRLYTEAWDKDKTQIHIMPDTPEIMLARQNKINYSETLYKLANEEAKKKGYDLRSDAIPIVAAKASRDVISDYKYKDGYRKQLGHHIGARNIEDDPKMMWSMHVAKIQSDREYKKDFEKWKTKFSSPVDMLGVVLAKKCQTLVSDVDYKNYLHEWTCLPDQNDVIHARQAYDLQSDNIYKSDLQWLRGIGWVPIGSMDVVKCKRAAEILSDNIYRQPPDKLKFTSVTDSLEQVLAKNNALNMNKRLYTEAWDKDKTQVHIMPDTPEIMLARQNKINYSESLYRQAMEEAKKEGYDLRSDAIPIVAAKASRDIASDYKYKEAYRKQLGHHIGARAVHDDPKIMWSLHIAKVQSDREYKKDFEKYKTRYSSPVDMLGIVLAKKCQTLVSDVDYKHPLHEWICLPDQNDIIHARKAYDLQSDNLYKSDLEWMKGIGWVPIDSLEVVRAKRAGELLSDTIYRQRPETLKFTSITDTPEQVLAKNNALNMNKRLYTEAWDNDKKTIHVMPDTPEIMLAKLNRINYSDKLYKLALEESKKEGYDLRLDAIPIQAAKASRDIASDYKYKEGYRKQLGHHIGARNIKDDPKMMWSIHVAKIQSDREYKKEFEKWKTKFSSPVDMLGVVLAKKCQILVSDIDYKHPLHEWTCLPDQNDVIQARKAYDLQSDAIYKSDLEWLRGIGWVPIGSVEVEKVKRAGEILSDRKYRQPADQLKFTCITDTPEIVLAKNNALTMSKHLYTEAWDADKTSIHVMPDTPDILLAKSNSANISQKLYTKGWDESKMKDYDLRADAISIKSAKASRDIASDYKYKEAYEKQKGHHIGAQSIEDDPKIMCAIHAGKIQSEREYKKEFQKWKTKFSSPVDMLSILLAKKCQTLVTDIDYRNYLHEWTCMPDQNDIIQAKKAYDLQSDALYKADLEWLRGIGWMPQGSPEVLRVKNAQNIFCDSVYRTPVVNLKYTSIVDTPEVVLAKSNAENISIPKYREVWDKDKTSIHIMPDTPEINLARANALNVSNKLYREGWDEMKAGCDVRLDAIPIQAAKASREIASDYKYKLDHEKQKGHYVGTLTARDDNKIRWALIADKLQNEREYRLDWAKWKAKIQSPVDMLSILHSKNSQALVSDMDYRNYLHQWTCMPDQNDVIQAKKAYELQSDNVYKADLEWLRGIGWMPNDSVSVNHAKHAADIFSEKKYRTKIETLNFTPVDDRVDYVTAKQSGEILDDIKYRKDWNATKSKYTLTETPLLHTAQEAARILDQYLYKEGWERQKATGYILPPDAVPFVHAHHCNDVQSELKYKAEHVKQKGHYVGVPTMRDDPKLVWFEHAGQIQNERLYKEDYHKTKAKINIPADMVSVLAAKQGQTLVSDIDYRNYLHQWMCHPDQNDVIQARKAYDLQSDNVYRADLEWLRGIGWIPLDSVDHVRVTKNQEMMSQIKYKKNALENYPNFRSVVDPPEIVLAKINSVNQSDVKYKETFNKAKGKYTFSPDTPHISHSKDMGKLYSTILYKGAWEGTKAYGYTLDERYIPIVGAKHADLVNSELKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDTPEIRQVKKTQEAVSELIYKSDFFKMQGHMISLPYTPQVIHCRYVGDITSDIKYKEDLQVLKGFGCFLYDTPDMVRSRHLRKLWSNYLYTDKARKMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNEKKYRADYEQRKDKYHLVVDEPRHLLAKTAGDQISQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENLGKGIPTPITPEMERVKRNQENFSSVLYKENMGKGTPLAVTPEMERVKHNQENISSVLYKENVGKATATPVTPEMQRVKRNQENISSVLYKENLGKATPTPFTPEMERVKRNQENFSSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 55679 - protein, 659 aa, Homo sapiens
  Payload ID: 10961
  Gene Symbol: NEB
  Gene Name: nebulin
  ENSP ID: ENSP00000380498
  MOD_RES (1)..(1): Any amino acid
XQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENLGKGIPTPITPEMERVKRNQENFSSVLYKENLGTGIPIPITPEMQRVKHNQENLSSVLYKENMGKGTPLPVTPEMERVKHNQENISSVLYKENMGKGTPLPVTPEMERVKHNQENISSVLYKENMGKGTPLAVTPEMERVKHNQENISSVLYKENVGKATATPVTPEMQRVKRNQENISSVLYKENLGKATPTPFTPEMERVKRNQENFSSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 55680 - protein, 8525 aa, Homo sapiens
  Payload ID: 10961
  Gene Symbol: NEB
  Gene Name: nebulin
  Uniprot ID: P20929
  ENSP ID: ENSP00000380505
MADDEDYEEVVEYYTEEVVYEEVPGETITKIYETTTTRTSDYEQSETSKPALAQPALAQPASAKPVERRKVIRKKVDPSKFMTPYIAHSQKMQDLFSPNKYKEKFEKTKGQPYASTTDTPELRRIKKVQDQLSEVKYRMDGDVAKTICHVDEKAKDIEHAKKVSQQVSKVLYKQNWEDTKDKYLLPPDAPELVQAVKNTAMFSKKLYTEDWEADKSLFYPYNDSPELRRVAQAQKALSDVAYKKGLAEQQAQFTPLADPPDIEFAKKVTNQVSKQKYKEDYENKIKGKWSETPCFEVANARMNADNISTRKYQEDFENMKDQIYFMQTETPEYKMNKKAGVAASKVKYKEDYEKNKGKADYNVLPASENPQLRQLKAAGDALSDKLYKENYEKTKAKSINYCETPKFKLDTVLQNFSSDKKYKDSYLKDILGHYVGSFEDPYHSHCMKVTAQNSDKNYKAEYEEDRGKGFFPQTITQEYEAIKKLDQCKDHTYKVHPDKTKFTQVTDSPVLLQAQVNSKQLSDLNYKAKHESEKFKCHIPPDTPAFIQHKVNAYNLSDNLYKQDWEKSKAKKFDIKVDAIPLLAAKANTKNTSDVMYKKDYEKNKGKMIGVLSINDDPKMLHSLKVAKNQSDRLYKENYEKTKAKSMNYCETPKYQLDTQLKNFSEARYKDLYVKDVLGHYVGSMEDPYHTHCMKVAAQNSDKSYKAEYEEDKGKCYFPQTITQEYEAIKKLDQCKDHTYKVHPDKTKFTAVTDSPVLLQAQLNTKQLSDLNYKAKHEGEKFKCHIPADAPQFIQHRVNAYNLSDNVYKQDWEKSKAKKFDIKVDAIPLLAAKANTKNTSDVMYKKDYEKSKGKMIGALSINDDPKMLHSLKTAKNQSDREYRKDYEKSKTIYTAPLDMLQVTQAKKSQAIASDVDYKHILHSYSYPPDSINVDLAKKAYALQSDVEYKADYNSWMKGCGWVPFGSLEMEKAKRASDILNEKKYRQHPDTLKFTSIEDAPITVQSKINQAQRSDIAYKAKGEEIIHKYNLPPDLPQFIQAKVNAYNISENMYKADLKDLSKKGYDLRTDAIPIRAAKAARQAASDVQYKKDYEKAKGKMVGFQSLQDDPKLVHYMNVAKIQSDREYKKDYEKTKSKYNTPHDMFNVVAAKKAQDVVSNVNYKHSLHHYTYLPDAMDLELSKNMMQIQSDNVYKEDYNNWMKGIGWIPIGSLDVEKVKKAGDALNEKKYRQHPDTLKFTSIVDSPVMVQAKQNTKQVSDILYKAKGEDVKHKYTMSPDLPQFLQAKCNAYNISDVCYKRDWYDLIAKGNNVLGDAIPITAAKASRNIASDYKYKEAYEKSKGKHVGFRSLQDDPKLVHYMNVAKLQSDREYKKNYENTKTSYHTPGDMVSITAAKMAQDVATNVNYKQPLHHYTYLPDAMSLEHTRNVNQIQSDNVYKDEYNSFLKGIGWIPIGSLEVEKVKKAGDALNERKYRQHPDTVKFTSVPDSMGMVLAQHNTKQLSDLNYKVEGEKLKHKYTIDPELPQFIQAKVNALNMSDAHYKADWKKTIAKGYDLRPDAIPIVAAKSSRNIASDCKYKEAYEKAKGKQVGFLSLQDDPKLVHYMNVAKIQSDREYKKGYEASKTKYHTPLDMVSVTAAKKSQEVATNANYRQSYHHYTLLPDALNVEHSRNAMQIQSDNLYKSDFTNWMKGIGWVPIESLEVEKAKKAGEILSEKKYRQHPEKLKFTYAMDTMEQALNKSNKLNMDKRLYTEKWNKDKTTIHVMPDTPDILLSRVNQITMSDKLYKAGWEEEKKKGYDLRPDAIAIKAARASRDIASDYKYKKAYEQAKGKHIGFRSLEDDPKLVHFMQVAKMQSDREYKKGYEKSKTSFHTPVDMLSVVAAKKSQEVATNANYRNVIHTYNMLPDAMSFELAKNMMQIQSDNQYKADYADFMKGIGWLPLGSLEAEKNKKAMEIISEKKYRQHPDTLKYSTLMDSMNMVLAQNNAKIMNEHLYKQAWEADKTKVHIMPDIPQIILAKANAINMSDKLYKLSLEESKKKGYDLRPDAIPIKAAKASRDIASDYKYKYNYEKGKGKMVGFRSLEDDPKLVHSMQVAKMQSDREYKKNYENTKTSYHTPADMLSVTAAKDAQANITNTNYKHLIHKYILLPDAMNIELTRNMNRIQSDNEYKQDYNEWYKGLGWSPAGSLEVEKAKKATEYASDQKYRQHPSNFQFKKLTDSMDMVLAKQNAHTMNKHLYTIDWNKDKTKIHVMPDTPDILQAKQNQTLYSQKLYKLGWEEALKKGYDLPVDAISVQLAKASRDIASDYKYKQGYRKQLGHHVGFRSLQDDPKLVLSMNVAKMQSEREYKKDFEKWKTKFSSPVDMLGVVLAKKCQELVSDVDYKNYLHQWTCLPDQNDVVQAKKVYELQSENLYKSDLEWLRGIGWSPLGSLEAEKNKRASEIISEKKYRQPPDRNKFTSIPDAMDIVLAKTNAKNRSDRLYREAWDKDKTQIHIMPDTPDIVLAKANLINTSDKLYRMGYEELKRKGYDLPVDAIPIKAAKASREIASEYKYKEGFRKQLGHHIGARNIEDDPKMMWSMHVAKIQSDREYKKDFEKWKTKFSSPVDMLGVVLAKKCQTLVSDVDYKNYLHQWTCLPDQSDVIHARQAYDLQSDNLYKSDLQWLKGIGWMTSGSLEDEKNKRATQILSDHVYRQHPDQFKFSSLMDSIPMVLAKNNAITMNHRLYTEAWDKDKTTVHIMPDTPEVLLAKQNKVNYSEKLYKLGLEEAKRKGYDMRVDAIPIKAAKASRDIASEFKYKEGYRKQLGHHIGARAIRDDPKMMWSMHVAKIQSDREYKKDFEKWKTKFSSPVDMLGVVLAKKCQTLVSDVDYKNYLHQWTCLPDQSDVIHARQAYDLQSDNMYKSDLQWMRGIGWVSIGSLDVEKCKRATEILSDKIYRQPPDRFKFTSVTDSLEQVLAKNNAITMNKRLYTEAWDKDKTQIHIMPDTPEIMLARMNKINYSESLYKLANEEAKKKGYDLRSDAIPIVAAKASRDIISDYKYKDGYCKQLGHHIGARNIEDDPKMMWSMHVAKIQSDREYKKDFEKWKTKFSSPVDMLGVVLAKKCQTLVSDVDYKNYLHEWTCLPDQSDVIHARQAYDLQSDNIYKSDLQWLRGIGWVPIGSMDVVKCKRATEILSDNIYRQPPDKLKFTSVTDSLEQVLAKNNALNMNKRLYTEAWDKDKTQIHIMPDTPEIMLARQNKINYSETLYKLANEEAKKKGYDLRSDAIPIVAAKASRDVISDYKYKDGYRKQLGHHIGARNIEDDPKMMWSMHVAKIQSDREYKKDFEKWKTKFSSPVDMLGVVLAKKCQTLVSDVDYKNYLHEWTCLPDQNDVIHARQAYDLQSDNIYKSDLQWLRGIGWVPIGSMDVVKCKRAAEILSDNIYRQPPDKLKFTSVTDSLEQVLAKNNALNMNKRLYTEAWDKDKTQVHIMPDTPEIMLARQNKINYSESLYRQAMEEAKKEGYDLRSDAIPIVAAKASRDIASDYKYKEAYRKQLGHHIGARAVHDDPKIMWSLHIAKVQSDREYKKDFEKYKTRYSSPVDMLGIVLAKKCQTLVSDVDYKHPLHEWICLPDQNDIIHARKAYDLQSDNLYKSDLEWMKGIGWVPIDSLEVVRAKRAGELLSDTIYRQRPETLKFTSITDTPEQVLAKNNALNMNKRLYTEAWDNDKKTIHVMPDTPEIMLAKLNRINYSDKLYKLALEESKKEGYDLRLDAIPIQAAKASRDIASDYKYKEGYRKQLGHHIGARNIKDDPKMMWSIHVAKIQSDREYKKEFEKWKTKFSSPVDMLGVVLAKKCQILVSDIDYKHPLHEWTCLPDQNDVIQARKAYDLQSDAIYKSDLEWLRGIGWVPIGSVEVEKVKRAGEILSDRKYRQPADQLKFTCITDTPEIVLAKNNALTMSKHLYTEAWDADKTSIHVMPDTPDILLAKSNSANISQKLYTKGWDESKMKDYDLRADAISIKSAKASRDIASDYKYKEAYEKQKGHHIGAQSIEDDPKIMCAIHAGKIQSEREYKKEFQKWKTKFSSPVDMLSILLAKKCQTLVTDIDYRNYLHEWTCMPDQNDIIQAKKAYDLQSDSVYKADLEWLRGIGWMPEGSVEMNRVKVAQDLVNERLYRTRPEALSFTSIVDTPEVVLAKANSLQISEKLYQEAWNKDKSNITIPSDTPEMLQAHINALQISNKLYQKDWNDAKQKGYDIRADAIEIKHAKASREIASEYKYKEGYRKQLGHHMGFRTLQDDPKSVWAIHAAKIQSDREYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRDAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHHWSCFPDQNDVIQARKAYDLQSDSVYKADLEWLRGIGWMPEGSVEMNRVKVAQDLVNERLYRTRPEALSFTSIVDTPEVVLAKANSLQISEKLYQEAWNKDKSNITIPSDTPEMLQAHINALQISNKLYQKDWNDTKQKGYDIRADAIEIKHAKASREIASEYKYKEGYRKQLGHHMGFRTLQDDPKSVWAIHAAKIQSDREYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRNAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHHWSCFPDQNDVIQARKAYDLQSDSVYKADLEWLRGIGWMPEGSVEMNRVKVAQDLVNERLYRTRPEALSFTSIVDTPEVVLAKANSLQISEKLYQEAWNKDKSNITIPSDTPEMLQAHINALQISNKLYQKDWNDTKQKGYDIRADAIEIKHAKASREIASEYKYKEGYRKQLGHHMGFRTLQDDPKSVWAIHAAKIQSDREYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRDAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHRWSCFPDQNDVIQARKAYDLQSDALYKADLEWLRGIGWMPQGSPEVLRVKNAQNIFCDSVYRTPVVNLKYTSIVDTPEVVLAKSNAENISIPKYREVWDKDKTSIHIMPDTPEINLARANALNVSNKLYREGWDEMKAGCDVRLDAIPIQAAKASREIASDYKYKLDHEKQKGHYVGTLTARDDNKIRWALIADKLQNEREYRLDWAKWKAKIQSPVDMLSILHSKNSQALVSDMDYRNYLHQWTCMPDQNDVIQAKKAYELQSDNVYKADLEWLRGIGWMPNDSVSVNHAKHAADIFSEKKYRTKIETLNFTPVDDRVDYVTAKQSGEILDDIKYRKDWNATKSKYTLTETPLLHTAQEAARILDQYLYKEGWERQKATGYILPPDAVPFVHAHHCNDVQSELKYKAEHVKQKGHYVGVPTMRDDPKLVWFEHAGQIQNERLYKEDYHKTKAKINIPADMVSVLAAKQGQTLVSDIDYRNYLHQWMCHPDQNDVIQARKAYDLQSDNVYRADLEWLRGIGWIPLDSVDHVRVTKNQEMMSQIKYKKNALENYPNFRSVVDPPEIVLAKINSVNQSDVKYKETFNKAKGKYTFSPDTPHISHSKDMGKLYSTILYKGAWEGTKAYGYTLDERYIPIVGAKHADLVNSELKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDTPEIRQVKKTQEAVSELIYKSDFFKMQGHMISLPYTPQVIHCRYVGDITSDIKYKEDLQVLKGFGCFLYDTPDMVRSRHLRKLWSNYLYTDKARKMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNERKYKSSAKMFLQHGCNEILRPDMLTALYNSHMWSQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENLGKGIPTPITPEMERVKRNQENFSSILYKENLSKGTPLPVTPEMERVKLNQENFSSVLYKENVGKGIPIPITPEMERVKHNQENFSSVLYKENLGTGIPIPITPEMQRVKHNQENLSSVLYKENMGKGTPLPVTPEMERVKHNQENISSVLYKENMGKGTPLPVTPEMERVKHNQENISSVLYKENMGKGTPLAVTPEMERVKHNQENISSVLYKENVGKATATPVTPEMQRVKRNQENISSVLYKENLGKATPTPFTPEMERVKRNQENFSSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 55681 - protein, 6669 aa, Homo sapiens
  Payload ID: 10961
  Gene Symbol: NEB
  Gene Name: nebulin
  Uniprot ID: P20929
  ENSP ID: ENSP00000386259
MADDEDYEEVVEYYTEEVVYEEVPGETITKIYETTTTRTSDYEQSETSKPALAQPALAQPASAKPVERRKVIRKKVDPSKFMTPYIAHSQKMQDLFSPNKYKEKFEKTKGQPYASTTDTPELRRIKKVQDQLSEVKYRMDGDVAKTICHVDEKAKDIEHAKKVSQQVSKVLYKQNWEDTKDKYLLPPDAPELVQAVKNTAMFSKKLYTEDWEADKSLFYPYNDSPELRRVAQAQKALSDVAYKKGLAEQQAQFTPLADPPDIEFAKKVTNQVSKQKYKEDYENKIKGKWSETPCFEVANARMNADNISTRKYQEDFENMKDQIYFMQTETPEYKMNKKAGVAASKVKYKEDYEKNKGKADYNVLPASENPQLRQLKAAGDALSDKLYKENYEKTKAKSINYCETPKFKLDTVLQNFSSDKKYKDSYLKDILGHYVGSFEDPYHSHCMKVTAQNSDKNYKAEYEEDRGKGFFPQTITQEYEAIKKLDQCKDHTYKVHPDKTKFTQVTDSPVLLQAQVNSKQLSDLNYKAKHESEKFKCHIPPDTPAFIQHKVNAYNLSDNLYKQDWEKSKAKKFDIKVDAIPLLAAKANTKNTSDVMYKKDYEKNKGKMIGVLSINDDPKMLHSLKVAKNQSDRLYKENYEKTKAKSMNYCETPKYQLDTQLKNFSEARYKDLYVKDVLGHYVGSMEDPYHTHCMKVAAQNSDKSYKAEYEEDKGKCYFPQTITQEYEAIKKLDQCKDHTYKVHPDKTKFTAVTDSPVLLQAQLNTKQLSDLNYKAKHEGEKFKCHIPADAPQFIQHRVNAYNLSDNVYKQDWEKSKAKKFDIKVDAIPLLAAKANTKNTSDVMYKKDYEKSKGKMIGALSINDDPKMLHSLKTAKNQSDREYRKDYEKSKTIYTAPLDMLQVTQAKKSQAIASDVDYKHILHSYSYPPDSINVDLAKKAYALQSDVEYKADYNSWMKGCGWVPFGSLEMEKAKRASDILNEKKYRQHPDTLKFTSIEDAPITVQSKINQAQRSDIAYKAKGEEIIHKYNLPPDLPQFIQAKVNAYNISENMYKADLKDLSKKGYDLRTDAIPIRAAKAARQAASDVQYKKDYEKAKGKMVGFQSLQDDPKLVHYMNVAKIQSDREYKKDYEKTKSKYNTPHDMFNVVAAKKAQDVVSNVNYKHSLHHYTYLPDAMDLELSKNMMQIQSDNVYKEDYNNWMKGIGWIPIGSLDVEKVKKAGDALNEKKYRQHPDTLKFTSIVDSPVMVQAKQNTKQVSDILYKAKGEDVKHKYTMSPDLPQFLQAKCNAYNISDVCYKRDWYDLIAKGNNVLGDAIPITAAKASRNIASDYKYKEAYEKSKGKHVGFRSLQDDPKLVHYMNVAKLQSDREYKKNYENTKTSYHTPGDMVSITAAKMAQDVATNVNYKQPLHHYTYLPDAMSLEHTRNVNQIQSDNVYKDEYNSFLKGIGWIPIGSLEVEKVKKAGDALNERKYRQHPDTVKFTSVPDSMGMVLAQHNTKQLSDLNYKVEGEKLKHKYTIDPELPQFIQAKVNALNMSDAHYKADWKKTIAKGYDLRPDAIPIVAAKSSRNIASDCKYKEAYEKAKGKQVGFLSLQDDPKLVHYMNVAKIQSDREYKKGYEASKTKYHTPLDMVSVTAAKKSQEVATNANYRQSYHHYTLLPDALNVEHSRNAMQIQSDNLYKSDFTNWMKGIGWVPIESLEVEKAKKAGEILSEKKYRQHPEKLKFTYAMDTMEQALNKSNKLNMDKRLYTEKWNKDKTTIHVMPDTPDILLSRVNQITMSDKLYKAGWEEEKKKGYDLRPDAIAIKAARASRDIASDYKYKKAYEQAKGKHIGFRSLEDDPKLVHFMQVAKMQSDREYKKGYEKSKTSFHTPVDMLSVVAAKKSQEVATNANYRNVIHTYNMLPDAMSFELAKNMMQIQSDNQYKADYADFMKGIGWLPLGSLEAEKNKKAMEIISEKKYRQHPDTLKYSTLMDSMNMVLAQNNAKIMNEHLYKQAWEADKTKVHIMPDIPQIILAKANAINMSDKLYKLSLEESKKKGYDLRPDAIPIKAAKASRDIASDYKYKYNYEKGKGKMVGFRSLEDDPKLVHSMQVAKMQSDREYKKNYENTKTSYHTPADMLSVTAAKDAQANITNTNYKHLIHKYILLPDAMNIELTRNMNRIQSDNEYKQDYNEWYKGLGWSPAGSLEVEKAKKATEYASDQKYRQHPSNFQFKKLTDSMDMVLAKQNAHTMNKHLYTIDWNKDKTKIHVMPDTPDILQAKQNQTLYSQKLYKLGWEEALKKGYDLPVDAISVQLAKASRDIASDYKYKQGYRKQLGHHVGFRSLQDDPKLVLSMNVAKMQSEREYKKDFEKWKTKFSSPVDMLGVVLAKKCQELVSDVDYKNYLHQWTCLPDQNDVVQAKKVYELQSENLYKSDLEWLRGIGWSPLGSLEAEKNKRASEIISEKKYRQPPDRNKFTSIPDAMDIVLAKTNAKNRSDRLYREAWDKDKTQIHIMPDTPDIVLAKANLINTSDKLYRMGYEELKRKGYDLPVDAIPIKAAKASREIASEYKYKEGFRKQLGHHIGARNIEDDPKMMWSMHVAKIQSDREYKKDFEKWKTKFSSPVDMLGVVLAKKCQTLVSDVDYKNYLHQWTCLPDQSDVIHARQAYDLQSDNLYKSDLQWLKGIGWMTSGSLEDEKNKRATQILSDHVYRQHPDQFKFSSLMDSIPMVLAKNNAITMNHRLYTEAWDKDKTTVHIMPDTPEVLLAKQNKVNYSEKLYKLGLEEAKRKGYDMRVDAIPIKAAKASRDIASEFKYKEGYRKQLGHHIGARAIRDDPKMMWSMHVAKIQSDREYKKDFEKWKTKFSSPVDMLGVVLAKKCQTLVSDVDYKNYLHQWTCLPDQSDVIHARQAYDLQSDNMYKSDLQWMRGIGWVSIGSLDVEKCKRATEILSDKIYRQPPDRFKFTSVTDSLEQVLAKNNALNMNKRLYTEAWDKDKTQIHIMPDTPEIMLARQNKINYSETLYKLANEEAKKKGYDLRSDAIPIVAAKASRDVISDYKYKDGYRKQLGHHIGARNIEDDPKMMWSMHVAKIQSDREYKKDFEKWKTKFSSPVDMLGVVLAKKCQTLVSDVDYKNYLHEWTCLPDQNDVIHARQAYDLQSDNIYKSDLQWLRGIGWVPIGSMDVVKCKRAAEILSDNIYRQPPDKLKFTSVTDSLEQVLAKNNALNMNKRLYTEAWDKDKTQVHIMPDTPEIMLARQNKINYSESLYRQAMEEAKKEGYDLRSDAIPIVAAKASRDIASDYKYKEAYRKQLGHHIGARAVHDDPKIMWSLHIAKVQSDREYKKDFEKYKTRYSSPVDMLGIVLAKKCQTLVSDVDYKHPLHEWICLPDQNDIIHARKAYDLQSDNLYKSDLEWMKGIGWVPIDSLEVVRAKRAGELLSDTIYRQRPETLKFTSITDTPEQVLAKNNALNMNKRLYTEAWDNDKKTIHVMPDTPEIMLAKLNRINYSDKLYKLALEESKKEGYDLRLDAIPIQAAKASRDIASDYKYKEGYRKQLGHHIGARNIKDDPKMMWSIHVAKIQSDREYKKEFEKWKTKFSSPVDMLGVVLAKKCQILVSDIDYKHPLHEWTCLPDQNDVIQARKAYDLQSDAIYKSDLEWLRGIGWVPIGSVEVEKVKRAGEILSDRKYRQPADQLKFTCITDTPEIVLAKNNALTMSKHLYTEAWDADKTSIHVMPDTPDILLAKSNSANISQKLYTKGWDESKMKDYDLRADAISIKSAKASRDIASDYKYKEAYEKQKGHHIGAQSIEDDPKIMCAIHAGKIQSEREYKKEFQKWKTKFSSPVDMLSILLAKKCQTLVTDIDYRNYLHEWTCMPDQNDIIQAKKAYDLQSDALYKADLEWLRGIGWMPQGSPEVLRVKNAQNIFCDSVYRTPVVNLKYTSIVDTPEVVLAKSNAENISIPKYREVWDKDKTSIHIMPDTPEINLARANALNVSNKLYREGWDEMKAGCDVRLDAIPIQAAKASREIASDYKYKLDHEKQKGHYVGTLTARDDNKIRWALIADKLQNEREYRLDWAKWKAKIQSPVDMLSILHSKNSQALVSDMDYRNYLHQWTCMPDQNDVIQAKKAYELQSDNVYKADLEWLRGIGWMPNDSVSVNHAKHAADIFSEKKYRTKIETLNFTPVDDRVDYVTAKQSGEILDDIKYRKDWNATKSKYTLTETPLLHTAQEAARILDQYLYKEGWERQKATGYILPPDAVPFVHAHHCNDVQSELKYKAEHVKQKGHYVGVPTMRDDPKLVWFEHAGQIQNERLYKEDYHKTKAKINIPADMVSVLAAKQGQTLVSDIDYRNYLHQWMCHPDQNDVIQARKAYDLQSDNVYRADLEWLRGIGWIPLDSVDHVRVTKNQEMMSQIKYKKNALENYPNFRSVVDPPEIVLAKINSVNQSDVKYKETFNKAKGKYTFSPDTPHISHSKDMGKLYSTILYKGAWEGTKAYGYTLDERYIPIVGAKHADLVNSELKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDTPEIRQVKKTQEAVSELIYKSDFFKMQGHMISLPYTPQVIHCRYVGDITSDIKYKEDLQVLKGFGCFLYDTPDMVRSRHLRKLWSNYLYTDKARKMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNEKKYRADYEQRKDKYHLVVDEPRHLLAKTAGDQISQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENLGKGIPTPITPEMERVKRNQENFSSVLYKENMGKGTPLAVTPEMERVKHNQENISSVLYKENVGKATATPVTPEMQRVKRNQENISSVLYKENLGKATPTPFTPEMERVKRNQENFSSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 55682 - protein, 766 aa, Homo sapiens
  Payload ID: 10961
  Gene Symbol: NEB
  Gene Name: nebulin
  ENSP ID: ENSP00000389074
  MOD_RES (1)..(1): Any amino acid
XKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLVLYKEDVSPGTAIGKTPEMMRVKQTQDHISSVKYKEAIGQGTPIPDLPEVKRVKETQKHISSVLYKENVGKATATPVTPEMQRVKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 55683 - protein, 255 aa, Homo sapiens
  Payload ID: 10961
  Gene Symbol: NEB
  Gene Name: nebulin
  ENSP ID: ENSP00000404876
RNATDIASQIKYKQSAEMEKANFTSVVDTPEIIHAQQVKNLSSQLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENLGKGIPTPITPEMERVKRNQENFSSVLYKENMGKGTPLPVTPEMERVKHNQENISSVLYKENMGKGTPLAVTPEMER

SEQ ID NO: 55684 - protein, 250 aa, Homo sapiens [sequence omitted]

SEQ ID NO: 55685 - protein, 401 aa, Homo sapiens
  Payload ID: 10961
  Gene Symbol: NEB
  Gene Name: nebulin
  ENSP ID: ENSP00000408570
  MOD_RES (1)..(1): Any amino acid
XKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENLGKGIPTPITPEMERVKRNQENFSSILYKENLSKGTPLPVTPEMERVKLNQENFSSVLYKENLGTGIPIPITPEMQRVKHNQENLSSVLYKENMGKGTPLPVTPEMERVKHNQENISSVLYKENMGKGTPLPVTPEMERVKHNQENISSVLYKENMGKGTPLAVTPEMERVKHNQENISSVLYKENVGKATATPVTPEMQRVKRNQENISSVLYKENLGKATPTPFTPEMERVKRNQENFSSVLYKENMRKATPTPVTPEMERAKRNQENISS

SEQ ID NO: 55686 - protein, 3007 aa, Homo sapiens
  Payload ID: 10961
  Gene Symbol: NEB
  Gene Name: nebulin
  ENSP ID: ENSP00000410961
GIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRDAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHRWSCFPDQNDVIQARKAYDLQSDALYKADLEWLRGIGWMPQGSPEVLRVKNAQNIFCDSVYRTPVVNLKYTSIVDTPEVVLAKSNAENISIPKYREVWDKDKTSIHIMPDTPEINLARANALNVSNKLYREGWDEMKAGCDVRLDAIPIQAAKASREIASDYKYKLDHEKQKGHYVGTLTARDDNKIRWALIADKLQNEREYRLDWAKWKAKIQSPVDMLSILHSKNSQALVSDMDYRNYLHQWTCMPDQNDVIQAKKAYELQSDNVYKADLEWLRGIGWMPNDSVSVNHAKHAADIFSEKKYRTKIETLNFTPVDDRVDYVTAKQSGEILDDIKYRKDWNATKSKYTLTETPLLHTAQEAARILDQYLYKEGWERQKATGYILPPDAVPFVHAHHCNDVQSELKYKAEHVKQKGHYVGVPTMRDDPKLVWFEHAGQIQNERLYKEDYHKTKAKINIPADMVSVLAAKQGQTLVSDIDYRNYLHQWMCHPDQNDVIQARKAYDLQSDNVYRADLEWLRGIGWIPLDSVDHVRVTKNQEMMSQIKYKKNALENYPNFRSVVDPPEIVLAKINSVNQSDVKYKETFNKAKGKYTFSPDTPHISHSKDMGKLYSTILYKGAWEGTKAYGYTLDERYIPIVGAKHADLVNSELKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDTPEIRQVKKTQEAVSELIYKSDFFKMQGHMISLPYTPQVIHCRYVGDITSDIKYKEDLQVLKGFGCFLYDTPDMVRSRHLRKLWSNYLYTDKARKMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNEKKYRADYEQRKDKYHLVVDEPRHLLAKTAGDQISQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENMGKGTPLAVTPEMERVKHNQENISSVLYKENVGKATATPVTPEMQRVKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 55687 - protein, 8525 aa, Homo sapiens
  Payload ID: 10961
  Gene Symbol: NEB
  Gene Name: nebulin
  Uniprot ID: P20929
  ENSP ID: ENSP00000416578
MADDEDYEEVVEYYTEEVVYEEVPGETITKIYETTTTRTSDYEQSETSKPALAQPALAQPASAKPVERRKVIRKKVDPSKFMTPYIAHSQKMQDLFSPNKYKEKFEKTKGQPYASTTDTPELRRIKKVQDQLSEVKYRMDGDVAKTICHVDEKAKDIEHAKKVSQQVSKVLYKQNWEDTKDKYLLPPDAPELVQAVKNTAMFSKKLYTEDWEADKSLFYPYNDSPELRRVAQAQKALSDVAYKKGLAEQQAQFTPLADPPDIEFAKKVTNQVSKQKYKEDYENKIKGKWSETPCFEVANARMNADNISTRKYQEDFENMKDQIYFMQTETPEYKMNKKAGVAASKVKYKEDYEKNKGKADYNVLPASENPQLRQLKAAGDALSDKLYKENYEKTKAKSINYCETPKFKLDTVLQNFSSDKKYKDSYLKDILGHYVGSFEDPYHSHCMKVTAQNSDKNYKAEYEEDRGKGFFPQTITQEYEAIKKLDQCKDHTYKVHPDKTKFTQVTDSPVLLQAQVNSKQLSDLNYKAKHESEKFKCHIPPDTPAFIQHKVNAYNLSDNLYKQDWEKSKAKKFDIKVDAIPLLAAKANTKNTSDVMYKKDYEKNKGKMIGVLSINDDPKMLHSLKVAKNQSDRLYKENYEKTKAKSMNYCETPKYQLDTQLKNFSEARYKDLYVKDVLGHYVGSMEDPYHTHCMKVAAQNSDKSYKAEYEEDKGKCYFPQTITQEYEAIKKLDQCKDHTYKVHPDKTKFTAVTDSPVLLQAQLNTKQLSDLNYKAKHEGEKFKCHIPADAPQFIQHRVNAYNLSDNVYKQDWEKSKAKKFDIKVDAIPLLAAKANTKNTSDVMYKKDYEKSKGKMIGALSINDDPKMLHSLKTAKNQSDREYRKDYEKSKTIYTAPLDMLQVTQAKKSQAIASDVDYKHILHSYSYPPDSINVDLAKKAYALQSDVEYKADYNSWMKGCGWVPFGSLEMEKAKRASDILNEKKYRQHPDTLKFTSIEDAPITVQSKINQAQRSDIAYKAKGEEIIHKYNLPPDLPQFIQAKVNAYNISENMYKADLKDLSKKGYDLRTDAIPIRAAKAARQAASDVQYKKDYEKAKGKMVGFQSLQDDPKLVHYMNVAKIQSDREYKKDYEKTKSKYNTPHDMFNVVAAKKAQDVVSNVNYKHSLHHYTYLPDAMDLELSKNMMQIQSDNVYKEDYNNWMKGIGWIPIGSLDVEKVKKAGDALNEKKYRQHPDTLKFTSIVDSPVMVQAKQNTKQVSDILYKAKGEDVKHKYTMSPDLPQFLQAKCNAYNISDVCYKRDWYDLIAKGNNVLGDAIPITAAKASRNIASDYKYKEAYEKSKGKHVGFRSLQDDPKLVHYMNVAKLQSDREYKKNYENTKTSYHTPGDMVSITAAKMAQDVATNVNYKQPLHHYTYLPDAMSLEHTRNVNQIQSDNVYKDEYNSFLKGIGWIPIGSLEVEKVKKAGDALNERKYRQHPDTVKFTSVPDSMGMVLAQHNTKQLSDLNYKVEGEKLKHKYTIDPELPQFIQAKVNALNMSDAHYKADWKKTIAKGYDLRPDAIPIVAAKSSRNIASDCKYKEAYEKAKGKQVGFLSLQDDPKLVHYMNVAKIQSDREYKKGYEASKTKYHTPLDMVSVTAAKKSQEVATNANYRQSYHHYTLLPDALNVEHSRNAMQIQSDNLYKSDFTNWMKGIGWVPIESLEVEKAKKAGEILSEKKYRQHPEKLKFTYAMDTMEQALNKSNKLNMDKRLYTEKWNKDKTTIHVMPDTPDILLSRVNQITMSDKLYKAGWEEEKKKGYDLRPDAIAIKAARASRDIASDYKYKKAYEQAKGKHIGFRSLEDDPKLVHFMQVAKMQSDREYKKGYEKSKTSFHTPVDMLSVVAAKKSQEVATNANYRNVIHTYNMLPDAMSFELAKNMMQIQSDNQYKADYADFMKGIGWLPLGSLEAEKNKKAMEIISEKKYRQHPDTLKYSTLMDSMNMVLAQNNAKIMNEHLYKQAWEADKTKVHIMPDIPQIILAKANAINMSDKLYKLSLEESKKKGYDLRPDAIPIKAAKASRDIASDYKYKYNYEKGKGKMVGFRSLEDDPKLVHSMQVAKMQSDREYKKNYENTKTSYHTPADMLSVTAAKDAQANITNTNYKHLIHKYILLPDAMNIELTRNMNRIQSDNEYKQDYNEWYKGLGWSPAGSLEVEKAKKATEYASDQKYRQHPSNFQFKKLTDSMDMVLAKQNAHTMNKHLYTIDWNKDKTKIHVMPDTPDILQAKQNQTLYSQKLYKLGWEEALKKGYDLPVDAISVQLAKASRDIASDYKYKQGYRKQLGHHVGFRSLQDDPKLVLSMNVAKMQSEREYKKDFEKWKTKFSSPVDMLGVVLAKKCQELVSDVDYKNYLHQWTCLPDQNDVVQAKKVYELQSENLYKSDLEWLRGIGWSPLGSLEAEKNKRASEIISEKKYRQPPDRNKFTSIPDAMDIVLAKTNAKNRSDRLYREAWDKDKTQIHIMPDTPDIVLAKANLINTSDKLYRMGYEELKRKGYDLPVDAIPIKAAKASREIASEYKYKEGFRKQLGHHIGARNIEDDPKMMWSMHVAKIQSDREYKKDFEKWKTKFSSPVDMLGVVLAKKCQTLVSDVDYKNYLHQWTCLPDQSDVIHARQAYDLQSDNLYKSDLQWLKGIGWMTSGSLEDEKNKRATQILSDHVYRQHPDQFKFSSLMDSIPMVLAKNNAITMNHRLYTEAWDKDKTTVHIMPDTPEVLLAKQNKVNYSEKLYKLGLEEAKRKGYDMRVDAIPIKAAKASRDIASEFKYKEGYRKQLGHHIGARAIRDDPKMMWSMHVAKIQSDREYKKDFEKWKTKFSSPVDMLGVVLAKKCQTLVSDVDYKNYLHQWTCLPDQSDVIHARQAYDLQSDNMYKSDLQWMRGIGWVSIGSLDVEKCKRATEILSDKIYRQPPDRFKFTSVTDSLEQVLAKNNAITMNKRLYTEAWDKDKTQIHIMPDTPEIMLARMNKINYSESLYKLANEEAKKKGYDLRSDAIPIVAAKASRDIISDYKYKDGYCKQLGHHIGARNIEDDPKMMWSMHVAKIQSDREYKKDFEKWKTKFSSPVDMLGVVLAKKCQTLVSDVDYKNYLHEWTCLPDQSDVIHARQAYDLQSDNIYKSDLQWLRGIGWVPIGSMDVVKCKRATEILSDNIYRQPPDKLKFTSVTDSLEQVLAKNNALNMNKRLYTEAWDKDKTQIHIMPDTPEIMLARQNKINYSETLYKLANEEAKKKGYDLRSDAIPIVAAKASRDVISDYKYKDGYRKQLGHHIGARNIEDDPKMMWSMHVAKIQSDREYKKDFEKWKTKFSSPVDMLGVVLAKKCQTLVSDVDYKNYLHEWTCLPDQNDVIHARQAYDLQSDNIYKSDLQWLRGIGWVPIGSMDVVKCKRAAEILSDNIYRQPPDKLKFTSVTDSLEQVLAKNNALNMNKRLYTEAWDKDKTQVHIMPDTPEIMLARQNKINYSESLYRQAMEEAKKEGYDLRSDAIPIVAAKASRDIASDYKYKEAYRKQLGHHIGARAVHDDPKIMWSLHIAKVQSDREYKKDFEKYKTRYSSPVDMLGIVLAKKCQTLVSDVDYKHPLHEWICLPDQNDIIHARKAYDLQSDNLYKSDLEWMKGIGWVPIDSLEVVRAKRAGELLSDTIYRQRPETLKFTSITDTPEQVLAKNNALNMNKRLYTEAWDNDKKTIHVMPDTPEIMLAKLNRINYSDKLYKLALEESKKEGYDLRLDAIPIQAAKASRDIASDYKYKEGYRKQLGHHIGARNIKDDPKMMWSIHVAKIQSDREYKKEFEKWKTKFSSPVDMLGVVLAKKCQILVSDIDYKHPLHEWTCLPDQNDVIQARKAYDLQSDAIYKSDLEWLRGIGWVPIGSVEVEKVKRAGEILSDRKYRQPADQLKFTCITDTPEIVLAKNNALTMSKHLYTEAWDADKTSIHVMPDTPDILLAKSNSANISQKLYTKGWDESKMKDYDLRADAISIKSAKASRDIASDYKYKEAYEKQKGHHIGAQSIEDDPKIMCAIHAGKIQSEREYKKEFQKWKTKFSSPVDMLSILLAKKCQTLVTDIDYRNYLHEWTCMPDQNDIIQAKKAYDLQSDSVYKADLEWLRGIGWMPEGSVEMNRVKVAQDLVNERLYRTRPEALSFTSIVDTPEVVLAKANSLQISEKLYQEAWNKDKSNITIPSDTPEMLQAHINALQISNKLYQKDWNDAKQKGYDIRADAIEIKHAKASREIASEYKYKEGYRKQLGHHMGFRTLQDDPKSVWAIHAAKIQSDREYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRDAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHHWSCFPDQNDVIQARKAYDLQSDSVYKADLEWLRGIGWMPEGSVEMNRVKVAQDLVNERLYRTRPEALSFTSIVDTPEVVLAKANSLQISEKLYQEAWNKDKSNITIPSDTPEMLQAHINALQISNKLYQKDWNDTKQKGYDIRADAIEIKHAKASREIASEYKYKEGYRKQLGHHMGFRTLQDDPKSVWAIHAAKIQSDREYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRNAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHHWSCFPDQNDVIQARKAYDLQSDSVYKADLEWLRGIGWMPEGSVEMNRVKVAQDLVNERLYRTRPEALSFTSIVDTPEVVLAKANSLQISEKLYQEAWNKDKSNITIPSDTPEMLQAHINALQISNKLYQKDWNDTKQKGYDIRADAIEIKHAKASREIASEYKYKEGYRKQLGHHMGFRTLQDDPKSVWAIHAAKIQSDREYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRDAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHRWSCFPDQNDVIQARKAYDLQSDALYKADLEWLRGIGWMPQGSPEVLRVKNAQNIFCDSVYRTPVVNLKYTSIVDTPEVVLAKSNAENISIPKYREVWDKDKTSIHIMPDTPEINLARANALNVSNKLYREGWDEMKAGCDVRLDAIPIQAAKASREIASDYKYKLDHEKQKGHYVGTLTARDDNKIRWALIADKLQNEREYRLDWAKWKAKIQSPVDMLSILHSKNSQALVSDMDYRNYLHQWTCMPDQNDVIQAKKAYELQSDNVYKADLEWLRGIGWMPNDSVSVNHAKHAADIFSEKKYRTKIETLNFTPVDDRVDYVTAKQSGEILDDIKYRKDWNATKSKYTLTETPLLHTAQEAARILDQYLYKEGWERQKATGYILPPDAVPFVHAHHCNDVQSELKYKAEHVKQKGHYVGVPTMRDDPKLVWFEHAGQIQNERLYKEDYHKTKAKINIPADMVSVLAAKQGQTLVSDIDYRNYLHQWMCHPDQNDVIQARKAYDLQSDNVYRADLEWLRGIGWIPLDSVDHVRVTKNQEMMSQIKYKKNALENYPNFRSVVDPPEIVLAKINSVNQSDVKYKETFNKAKGKYTFSPDTPHISHSKDMGKLYSTILYKGAWEGTKAYGYTLDERYIPIVGAKHADLVNSELKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDTPEIRQVKKTQEAVSELIYKSDFFKMQGHMISLPYTPQVIHCRYVGDITSDIKYKEDLQVLKGFGCFLYDTPDMVRSRHLRKLWSNYLYTDKARKMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNEKKYRADYEQRKDKYHLVVDEPRHLLAKTAGDQISQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENLGKGIPTPITPEMERVKRNQENFSSILYKENLSKGTPLPVTPEMERVKLNQENFSSVLYKENVGKGIPIPITPEMERVKHNQENFSSVLYKENLGTGIPIPITPEMQRVKHNQENLSSVLYKENMGKGTPLPVTPEMERVKHNQENISSVLYKENMGKGTPLPVTPEMERVKHNQENISSVLYKENMGKGTPLAVTPEMERVKHNQENISSVLYKENVGKATATPVTPEMQRVKRNQENISSVLYKENLGKATPTPFTPEMERVKRNQENFSSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 55688 - protein, 8525 aa, Homo sapiens; identical to SEQ ID NO: 55680
  Payload ID: 10961
  Gene Symbol: NEB
  Gene Name: nebulin
  Uniprot ID: P20929
  ENSP ID: ENSP00000473894

SEQ ID NO: 55689 - protein, 8525 aa, Homo sapiens; identical to SEQ ID NO: 55687
  Payload ID: 10961
  Gene Symbol: NEB
  Gene Name: nebulin
  Uniprot ID: P20929
  ENSP ID: ENSP00000474498

SEQ ID NO: 55690 - protein, 8560 aa, Homo sapiens
  Payload ID: 10961
  Gene Symbol: NEB
  Gene Name: nebulin
  ENSP ID: ENSP00000484342
MADDEDYEEVVEYYTEEVVYEEVPGETITKIYETTTTRTSDYEQSETSKPALAQPALAQPASAKPVERRKVIRKKVDPSKFMTPYIAHSQKMQDLFSPNKYKEKFEKTKGQPYASTTDTPELRRIKKVQDQLSEVKYRMDGDVAKTICHVDEKAKDIEHAKKVSQQVSKVLYKQNWEDTKDKYLLPPDAPELVQAVKNTAMFSKKLYTEDWEADKSLFYPYNDSPELRRVAQAQKALSDVAYKKGLAEQQAQFTPLADPPDIEFAKKVTNQVSKQKYKEDYENKIKGKWSETPCFEVANARMNADNISTRKYQEDFENMKDQIYFMQTETPEYKMNKKAGVAASKVKYKEDYEKNKGKADYNVLPASENPQLRQLKAAGDALSDKLYKENYEKTKAKSINYCETPKFKLDTVLQNFSSDKKYKDSYLKDILGHYVGSFEDPYHSHCMKVTAQNSDKNYKAEYEEDRGKGFFPQTITQEYEAIKKLDQCKDHTYKVHPDKTKFTQVTDSPVLLQAQVNSKQLSDLNYKAKHESEKFKCHIPPDTPAFIQHKVNAYNLSDNLYKQDWEKSKAKKFDIKVDAIPLLAAKANTKNTSDVMYKKDYEKNKGKMIGVLSINDDPKMLHSLKVAKNQSDRLYKENYEKTKAKSMNYCETPKYQLDTQLKNFSEARYKDLYVKDVLGHYVGSMEDPYHTHCMKVAAQNSDKSYKAEYEEDKGKCYFPQTITQEYEAIKKLDQCKDHTYKVHPDKTKFTAVTDSPVLLQAQLNTKQLSDLNYKAKHEGEKFKCHIPADAPQFIQHRVNAYNLSDNVYKQDWEKSKAKKFDIKVDAIPLLAAKANTKNTSDVMYKKDYEKSKGKMIGALSINDDPKMLHSLKTAKNQSDREYRKDYEKSKTIYTAPLDMLQVTQAKKSQAIASDVDYKHILHSYSYPPDSINVDLAKKAYALQSDVEYKADYNSWMKGCGWVPFGSLEMEKAKRASDILNEKKYRQHPDTLKFTSIEDAPITVQSKINQAQRSDIAYKAKGEEIIHKYNLPPDLPQFIQAKVNAYNISENMYKADLKDLSKKGYDLRTDAIPIRAAKAARQAASDVQYKKDYEKAKGKMVGFQSLQDDPKLVHYMNVAKIQSDREYKKDYEKTKSKYNTPHDMFNVVAAKKAQDVVSNVNYKHSLHHYTYLPDAMDLELSKNMMQIQSDNVYKEDYNNWMKGIGWIPIGSLDVEKVKKAGDALNEKKYRQHPDTLKFTSIVDSPVMVQAKQNTKQVSDILYKAKGEDVKHKYTMSPDLPQFLQAKCNAYNISDVCYKRDWYDLIAKGNNVLGDAIPITAAKASRNIASDYKYKEAYEKSKGKHVGFRSLQDDPKLVHYMNVAKLQSDREYKKNYENTKTSYHTPGDMVSITAAKMAQDVATNVNYKQPLHHYTYLPDAMSLEHTRNVNQIQSDNVYKDEYNSFLKGIGWIPIGSLEVEKVKKAGDALNERKYRQHPDTVKFTSVPDSMGMVLAQHNTKQLSDLNYKVEGEKLKHKYTIDPELPQFIQAKVNALNMSDAHYKADWKKTIAKGYDLRPDAIPIVAAKSSRNIASDCKYKEAYEKAKGKQVGFLSLQDDPKLVHYMNVAKIQSDREYKKGYEASKTKYHTPLDMVSVTAAKKSQEVATNANYRQSYHHYTLLPDALNVEHSRNAMQIQSDNLYKSDFTNWMKGIGWVPIESLEVEKAKKAGEILSEKKYRQHPEKLKFTYAMDTMEQALNKSNKLNMDKRLYTEKWNKDKTTIHVMPDTPDILLSRVNQITMSDKLYKAGWEEEKKKGYDLRPDAIAIKAARASRDIASDYKYKKAYEQAKGKHIGFRSLEDDPKLVHFMQVAKMQSDREYKKGYEKSKTSFHTPVDMLSVVAAKKSQEVATNANYRNVIHTYNMLPDAMSFELAKNMMQIQSDNQYKADYADFMKGIGWLPLGSLEAEKNKKAMEIISEKKYRQHPDTLKYSTLMDSMNMVLAQNNAKIMNEHLYKQAWEADKTKVHIMPDIPQIILAKANAINMSDKLYKLSLEESKKKGYDLRPDAIPIKAAKASRDIASDYKYKYNYEKGKGKMVGFRSLEDDPKLVHSMQVAKMQSDREYKKNYENTKTSYHTPADMLSVTAAKDAQANITNTNYKHLIHKYILLPDAMNIELTRNMNRIQSDNEYKQDYNEWYKGLGWSPAGSLEVEKAKKATEYASDQKYRQHPSNFQFKKLTDSMDMVLAKQNAHTMNKHLYTIDWNKDKTKIHVMPDTPDILQAKQNQTLYSQKLYKLGWEEALKKGYDLPVDAISVQLAKASRDIASDYKYKQGYRKQLGHHVGFRSLQDDPKLVLSMNVAKMQSEREYKKDFEKWKTKFSSPVDMLGVVLAKKCQELVSDVDYKNYLHQWTCLPDQNDVVQAKKVYELQSENLYKSDLEWLRGIGWSPLGSLEAEKNKRASEIISEKKYRQPPDRNKFTSIPDAMDIVLAKTNAKNRSDRLYREAWDKDKTQIHIMPDTPDIVLAKANLINTSDKLYRMGYEELKRKGYDLPVDAIPIKAAKASREIASEYKYKEGFRKQLGHHIGARNIEDDPKMMWSMHVAKIQSDREYKKDFEKWKTKFSSPVDMLGVVLAKKCQTLVSDVDYKNYLHQWTCLPDQSDVIHARQAYDLQSDNLYKSDLQWLKGIGWMTSGSLEDEKNKRATQILSDHVYRQHPDQFKFSSLMDSIPMVLAKNNAITMNHRLYTEAWDKDKTTVHIMPDTPEVLLAKQNKVNYSEKLYKLGLEEAKRKGYDMRVDAIPIKAAKASRDIASEFKYKEGYRKQLGHHIGARAIRDDPKMMWSMHVAKIQSDREYKKDFEKWKTKFSSPVDMLGVVLAKKCQTLVSDVDYKNYLHQWTCLPDQSDVIHARQAYDLQSDNMYKSDLQWMRGIGWVSIGSLDVEKCKRATEILSDKIYRQPPDRFKFTSVTDSLEQVLAKNNAITMNKRLYTEAWDKDKTQIHIMPDTPEIMLARMNKINYSESLYKLANEEAKKKGYDLRSDAIPIVAAKASRDIISDYKYKDGYCKQLGHHIGARNIEDDPKMMWSMHVAKIQSDREYKKDFEKWKTKFSSPVDMLGVVLAKKCQTLVSDVDYKNYLHEWTCLPDQSDVIHARQAYDLQSDNIYKSDLQWLRGIGWVPIGSMDVVKCKRATEILSDNIYRQPPDKLKFTSVTDSLEQVLAKNNALNMNKRLYTEAWDKDKTQIHIMPDTPEIMLARQNKINYSETLYKLANEEAKKKGYDLRSDAIPIVAAKASRDVISDYKYKDGYRKQLGHHIGARNIEDDPKMMWSMHVAKIQSDREYKKDFEKWKTKFSSPVDMLGVVLAKKCQTLVSDVDYKNYLHEWTCLPDQNDVIHARQAYDLQSDNIYKSDLQWLRGIGWVPIGSMDVVKCKRAAEILSDNIYRQPPDKLKFTSVTDSLEQVLAKNNALNMNKRLYTEAWDKDKTQVHIMPDTPEIMLARQNKINYSESLYRQAMEEAKKEGYDLRSDAIPIVAAKASRDIASDYKYKEAYRKQLGHHIGARAVHDDPKIMWSLHIAKVQSDREYKKDFEKYKTRYSSPVDMLGIVLAKKCQTLVSDVDYKHPLHEWICLPDQNDIIHARKAYDLQSDNLYKSDLEWMKGIGWVPIDSLEVVRAKRAGELLSDTIYRQRPETLKFTSITDTPEQVLAKNNALNMNKRLYTEAWDNDKKTIHVMPDTPEIMLAKLNRINYSDKLYKLALEESKKEGYDLRLDAIPIQAAKASRDIASDYKYKEGYRKQLGHHIGARNIKDDPKMMWSIHVAKIQSDREYKKEFEKWKTKFSSPVDMLGVVLAKKCQILVSDIDYKHPLHEWTCLPDQNDVIQARKAYDLQSDAIYKSDLEWLRGIGWVPIGSVEVEKVKRAGEILSDRKYRQPADQLKFTCITDTPEIVLAKNNALTMSKHLYTEAWDADKTSIHVMPDTPDILLAKSNSANISQKLYTKGWDESKMKDYDLRADAISIKSAKASRDIASDYKYKEAYEKQKGHHIGAQSIEDDPKIMCAIHAGKIQSEREYKKEFQKWKTKFSSPVDMLSILLAKKCQTLVTDIDYRNYLHEWTCMPDQNDIIQAKKAYDLQSDSVYKADLEWLRGIGWMPEGSVEMNRVKVAQDLVNERLYRTRPEALSFTSIVDTPEVVLAKANSLQISEKLYQEAWNKDKSNITIPSDTPEMLQAHINALQISNKLYQKDWNDAKQKGYDIRADAIEIKHAKASREIASEYKYKEGYRKQLGHHMGFRTLQDDPKSVWAIHAAKIQSDREYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRDAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHHWSCFPDQNDVIQARKAYDLQSDSVYKADLEWLRGIGWMPEGSVEMNRVKVAQDLVNERLYRTRPEALSFTSIVDTPEVVLAKANSLQISEKLYQEAWNKDKSNITIPSDTPEMLQAHINALQISNKLYQKDWNDTKQKGYDIRADAIEIKHAKASREIASEYKYKEGYRKQLGHHMGFRTLQDDPKSVWAIHAAKIQSDREYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRNAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHHWSCFPDQNDVIQARKAYDLQSDSVYKADLEWLRGIGWMPEGSVEMNRVKVAQDLVNERLYRTRPEALSFTSIVDTPEVVLAKANSLQISEKLYQEAWNKDKSNITIPSDTPEMLQAHINALQISNKLYQKDWNDTKQKGYDIRADAIEIKHAKASREIASEYKYKEGYRKQLGHHMGFRTLQDDPKSVWAIHAAKIQSDREYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRDAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHRWSCFPDQNDVIQARKAYDLQSDALYKADLEWLRGIGWMPQGSPEVLRVKNAQNIFCDSVYRTPVVNLKYTSIVDTPEVVLAKSNAENISIPKYREVWDKDKTSIHIMPDTPEINLARANALNVSNKLYREGWDEMKAGCDVRLDAIPIQAAKASREIASDYKYKLDHEKQKGHYVGTLTARDDNKIRWALIADKLQNEREYRLDWAKWKAKIQSPVDMLSILHSKNSQALVSDMDYRNYLHQWTCMPDQNDVIQAKKAYELQSDNVYKADLEWLRGIGWMPNDSVSVNHAKHAADIFSEKKYRTKIETLNFTPVDDRVDYVTAKQSGEILDDIKYRKDWNATKSKYTLTETPLLHTAQEAARILDQYLYKEGWERQKATGYILPPDAVPFVHAHHCNDVQSELKYKAEHVKQKGHYVGVPTMRDDPKLVWFEHAGQIQNERLYKEDYHKTKAKINIPADMVSVLAAKQGQTLVSDIDYRNYLHQWMCHPDQNDVIQARKAYDLQSDNVYRADLEWLRGIGWIPLDSVDHVRVTKNQEMMSQIKYKKNALENYPNFRSVVDPPEIVLAKINSVNQSDVKYKETFNKAKGKYTFSPDTPHISHSKDMGKLYSTILYKGAWEGTKAYGYTLDERYIPIVGAKHADLVNSELKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDTPEIRQVKKTQEAVSELIYKSDFFKMQGHMISLPYTPQVIHCRYVGDITSDIKYKEDLQVLKGFGCFLYDTPDMVRSRHLRKLWSNYLYTDKARKMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNEKKYRADYEQRKDKYHLVVDEPRHLLAKTAGDQISQRKYKSSAKMFLQHGCNEILRPDMLTALYNSHMWSQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENLGKGIPTPITPEMERVKRNQENFSSILYKENLSKGTPLPVTPEMERVKLNQENFSSVLYKENVGKGIPIPITPEMERVKHNQENFSSVLYKENLGTGIPIPITPEMQRVKHNQENLSSVLYKENMGKGTPLPVTPEMERVKHNQENISSVLYKENMGKGTPLPVTPEMERVKHNQENISSVLYKENMGKGTPLAVTPEMERVKHNQENISSVLYKENVGKATATPVTPEMQRVKRNQENISSVLYKENLGKATPTPFTPEMERVKRNQENFSSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 55691 - protein, 1730 aa, Homo sapiens
  Payload ID: 10962
  Gene Symbol: NRAP
  Gene Name: nebulin-related anchoring protein
  Uniprot ID: Q86VF7
  ENSP ID: ENSP00000353078
MNVQPCSRCGYGVYPAEKISCIDQIWHKACFHCEVCKMMLSVNNFVSHQKKPYCHAHNPKNNTFTSVYHTPLNLNVRTFPEAISGIHDQEDGEQCKSVFHWDMKSKDKEGAPNRQPLANERAYWTGYGEGNAWCPGALPDPEIVRMVEARKSLGEEYTEDYEQPRGKGSFPAMITPAYQRAKKANQLASQVEYKRGHDERISRFSTVVDTPELLRSKAGAQLQSDVRYTEDYEQQRGKGSFPAMITPAYQIAKRANELASDVRYHQQYQKEMRGMAGPAIGAEGILTRECADQYGQGYPEEYEEHRGKGSFPAMITPAYQNAKKAHELASDIKYRQDFNKMKGAAHYHSLPAQDNLVLKQAQSVNKLVSEVEYKKDLESSRGHSINYCETPQFRNVSKISKFTSDNKYKENYQNHMRGRYEGVGMDRRTLHAMKVGSLASNVAYKADYKHDIVDYNYPATLTPSYQTAMKLVPLKDANYRQSIDKLKYSSVTDTPQIVQAKINAQQLSHVNYRADYEKNKLNYTLPQDVPQLVKAKTNAKLFSEVKYKEGWEKTKGKGFEMKLDAMSLLAAKASGELASNIKYKEEYEKTKGKAMGTADSRLLHSLQIAKMSSEVEYKKGFEESKTRFHLPMDMVNIRHAKKAQTLASDLDYRKKLHEYTVLPEDMKTQWAKKAYGLQSELQYKADLAWMKGVGWLTEGSLNLEQAKKAGQLVSEKNYRQRVDELKFTSVTDSSQMEHAKKSQELQSGVAYKAGNEQSVHQYTISKDEPLFLQARANAANLSEKLYKSSWENQKAKGFELRLDSLTFLAAKAKRDLASEVKYKEDYERSRGKLIGAKDVQGDSQMSHSLQMSKLQSELEYKKGFEDTKSQCHVSLDMVHLVHARKAQHLATDVGYKTAEHHFTALPTDMKVEWAKKAYGLQSDNQYRADVKWMKGMGWVATGSLNVEQAKKAGELISEKKYRQHPDALKFTSIKDTPEMVQARISYTQAVDRLYREQGENIKHHYTPTADLPEVLLAKLNAMNISETRYKESWSKLRDGGYKLRLDALPFQAAKASGEIISDYKYKEAFEKMKGQMLGSRSLEDDISLAHSVYATSLQSDVNYKKGFEHSKAQFHLPLDMAALVHAKKAQTLASNQDYKHPLPQYTSLAEDLRLSCAKKAHKLQSENLYRSDLNFMRGVACVIPGTLEIEGRKKASELISESKYRQHPHSFKYTAVTDTPNLLHAKFSNQITNERLYKAAGEDARHEYTMTLGLPEFIRAKTNAANLSDARYKESWRNLRAQGYKLTIEALPFQAARASGDIASDFLYRHDFVKERGKLIGPQSVRDDPRIQHCRRMGQLQSELQYRRGATSSQAQFHLPMDMVHLVHAKNAQALASDHDYRTQYHKFTALPEDLKMAWAKKAHALQSELRYKSDLIGMKGIGWLALRSPQMESAKKAGELISETKYRKKPDSIKFTTVVDSPDLVHAKNSYMHCNERMYRSGDAESLHRYTLIPDHPDFTRARLNALHLSDKVYRNSWEQTRAGSYDFRLDAIPFQTARASREIASDFRYKEAFLRDRGLQIGYRSVDDDPRMKHFLNVGRLQSDNEYKKDFAKSRSQFHSSTDQPGLLQAKRSQQLASDVHYRQPLPQPTCDPEQLGLRHAQKAHQLQSDVKYKSDLNLTRGVGWTPPGSYKVEMARRAAELANARGLGLQGAYRGAEAVEAGDHQSGEVNPDATEILHVKKKKALLL

SEQ ID NO: 55692 - protein, 1695 aa, Homo sapiens
  Payload ID: 10962
  Gene Symbol: NRAP
  Gene Name: nebulin-related anchoring protein
  Uniprot ID: Q86VF7
  ENSP ID: ENSP00000353666
MNVQPCSRCGYGVYPAEKISCIDQIWHKACFHCEVCKMMLSVNNFVSHQKKPYCHAHNPKNNTFTSVYHTPLNLNVRTFPEAISGIHDQEDGEQCKSVFHWDMKSKDKEGAPNRQPLANERAYWTGYGEGNAWCPGALPDPEIVRMVEARKSLGEEYTEDYEQPRGKGSFPAMITPAYQRAKKANQLASQVEYKRGHDERISRFSTVVDTPELLRSKAGAQLQSDVRYTEDYEQQRGKGSFPAMITPAYQIAKRANELASDVRYHQQYQKEMRGMAGPAIGAEGILTRECADQYGQGYPEEYEEHRGKGSFPAMITPAYQNAKKAHELASDIKYRQDFNKMKGAAHYHSLPAQDNLVLKQAQSVNKLVSENKYKENYQNHMRGRYEGVGMDRRTLHAMKVGSLASNVAYKADYKHDIVDYNYPATLTPSYQTAMKLVPLKDANYRQSIDKLKYSSVTDTPQIVQAKINAQQLSHVNYRADYEKNKLNYTLPQDVPQLVKAKTNAKLFSEVKYKEGWEKTKGKGFEMKLDAMSLLAAKASGELASNIKYKEEYEKTKGKAMGTADSRLLHSLQIAKMSSEVEYKKGFEESKTRFHLPMDMVNIRHAKKAQTLASDLDYRKKLHEYTVLPEDMKTQWAKKAYGLQSELQYKADLAWMKGVGWLTEGSLNLEQAKKAGQLVSEKNYRQRVDELKFTSVTDSSQMEHAKKSQELQSGVAYKAGNEQSVHQYTISKDEPLFLQARANAANLSEKLYKSSWENQKAKGFELRLDSLTFLAAKAKRDLASEVKYKEDYERSRGKLIGAKDVQGDSQMSHSLQMSKLQSELEYKKGFEDTKSQCHVSLDMVHLVHARKAQHLATDVGYKTAEHHFTALPTDMKVEWAKKAYGLQSDNQYRADVKWMKGMGWVATGSLNVEQAKKAGELISEKKYRQHPDALKFTSIKDTPEMVQARISYTQAVDRLYREQGENIKHHYTPTADLPEVLLAKLNAMNISETRYKESWSKLRDGGYKLRLDALPFQAAKASGEIISDYKYKEAFEKMKGQMLGSRSLEDDISLAHSVYATSLQSDVNYKKGFEHSKAQFHLPLDMAALVHAKKAQTLASNQDYKHPLPQYTSLAEDLRLSCAKKAHKLQSENLYRSDLNFMRGVACVIPGTLEIEGRKKASELISESKYRQHPHSFKYTAVTDTPNLLHAKFSNQITNERLYKAAGEDARHEYTMTLGLPEFIRAKTNAANLSDARYKESWRNLRAQGYKLTIEALPFQAARASGDIASDFLYRHDFVKERGKLIGPQSVRDDPRIQHCRRMGQLQSELQYRRGATSSQAQFHLPMDMVHLVHAKNAQALASDHDYRTQYHKFTALPEDLKMAWAKKAHALQSELRYKSDLIGMKGIGWLALRSPQMESAKKAGELISETKYRKKPDSIKFTTVVDSPDLVHAKNSYMHCNERMYRSGDAESLHRYTLIPDHPDFTRARLNALHLSDKVYRNSWEQTRAGSYDFRLDAIPFQTARASREIASDFRYKEAFLRDRGLQIGYRSVDDDPRMKHFLNVGRLQSDNEYKKDFAKSRSQFHSSTDQPGLLQAKRSQQLASDVHYRQPLPQPTCDPEQLGLRHAQKAHQLQSDVKYKSDLNLTRGVGWTPPGSYKVEMARRAAELANARGLGLQGAYRGAEAVEAGDHQSGEVNPDATEILHVKKKKALLL

SEQ ID NO: 55693 - protein, 1731 aa, Homo sapiens
  Payload ID: 10962
  Gene Symbol: NRAP
  Gene Name: nebulin-related anchoring protein
  ENSP ID: ENSP00000358365
MNVQPCSRCGYGVYPAEKISCIDQIWHKACFHCEVCKMMLSVNNFVSHQKKPYCHAHNPKNNTFTSVYHTPLNLNVRTFPEAISGIHDQEDGEQCKSVFHWDMKSKDKEGAPNRQPLANERAYWTGYGEGNAWCPGALPDPEIVRMVEARKSLGEEYTEDYEQPRGKGSFPAMITPAYQRAKKANQLASQVEYKRGHDERISRFSTVVDTPELLRSKAGAQLQSDVRYTEDYEQQRGKGSFPAMITPAYQIAKRANELASDVRYHQQYQKEMRGMAGPAIGAEGILTRECADQYGQGYPEEYEEHRGKGSFPAMITPAYQNAKKAHELASDIKYRQDFNKMKGAAHYHSLPAQDNLVLKQAQSVNKLVSEVEYKKDLESSRGHSINYCETPQFRNVSKISKFTSDNKYKENYQNHMRGRYEGVGMDRRTLHAMKVGSLASNVAYKADYKHDIVDYNYPATLTPSYQTAMKLVPLKDANYRQSIDKLKYSSVTDTPQIVQAKINAQQLSHVNYRADYEKNKLNYTLPQDVPQLVKAKTNAKLFSEVKYKEGWEKTKGKGFEMKLDAMSLLAAKASGELASNIKYKEEYEKTKGKAMGTADSRLLHSLQIAKMSSEVEYKKGFEESKTRFHLPMDMVNIRHAKKAQTLASDLDYRKKLHEYTVLPEDMKTQWAKKAYGLQSELQYKADLAWMKGVGWLTEGSLNLEQAKKAGQLVSEKNYRQRVDELKFTSVTDSSQMEHAKKSQELQSGVAYKAGNEQSVHQYTISKDEPLFLQARANAANLSEKLYKSSWENQKAKGFELRLDSLTFLAAKAKRDLASEVKYKEDYERSRGKLIGAKDVQGDSQMSHSLQMSKLQSELEYKKGFEDTKSQCHVSLDMVHLVHARKAQHLATDVGYKTAEHHFTALPTDMKVEWAKKAYGLQSDNQYRADVKWMKGMGWVATGSLNVEQAKKAGELISEKKYRQHPDALKFTSIKDTPEMVQARISYTQAVDRLYREQGENIKHHYTPTADLPEVLLAKLNAMNISETRYKESWSKLRDGGYKLRLDALPFQAAKASGEIISDYKYKEAFEKMKGQMLGSRSLEDDISLAHSVYATSLQSDVNYKKGFEHSKAQFHLPLDMAALVHAKKAQTLASNQDYKHPLPQYTSLAEDLRLSCAKKAHKLQSENLYRSDLNFMRGVACVIPGTLEIEGRKKASELISESKYRQHPHSFKYTAVTDTPNLLHAKFSNQITNERLYKAAGEDARHEYTMTLGLPEFIRAKTNAANLSDARYKESWRNLRAQGYKLTIEALPFQAARASGDIASDFLYRHDFVKERGKLIGPQSVRDDPRIQHCRRMGQLQSELQYRRGATSSQAQFHLPMDMVHLVHAKNAQALASDHDYRTQYHKFTALPEDLKMAWAKKAHALQSELRYKSDLIGMKGIGWLALRSPQMESAKKAGELISETKYRKKPDSIKFTTVVDSPDLVHAKNSYMHCNERMYRSGDAESLHRYTLIPDHPDFTRARLNALHLSDKVYRNSWEQTRAGSYDFRLDAIPFQTARASREIASDFRYKEAFLRDRGLQIGYRSVDDDPRMKHFLNVGRLQSDNEYKKDFAKSRSQFHSSTDQPGLLQAKRSQQLASDVHYRQPLPQPTCDPEQLGLRHAQKAHQLQSDVKYKSDLNLTRGVGWTPPGSYKVEMARRAAELANARGLGLQGAYQRGAEAVEAGDHQSGEVNPDATEILHVKKKKALLL

SEQ ID NO: 55694 - protein, 1703 aa, Homo sapiens
  Payload ID: 10962
  Gene Symbol: NRAP
  Gene Name: nebulin-related anchoring protein
  Uniprot ID: Q86VF7
  ENSP ID: ENSP00000358367
MNVQPCSRCGYGVYPAEKISCIDQIWHKACFHCEVCKMMLSVNNFVSHQKKPYCHAHNPKNNTFTSVYHTPLNLNVRTFPEAISGIHDQEDGEQCKSVFHWDMKSKDKEGAPNRQPLANERAYWTGYGEGNAWCPGALPDPEIVRMVEARKSLGEEYTEDYEQPRGKGSFPAMITPAYQRAKKANQLASQVEYKRGHDERISRFSTVVDTPELLRSKAGAQLQSDVRYTEDYEQQRGKGSFPAMITPAYQIAKRANELASDVRYHQQYQKEMRGMAGPAIGAEGILTRECADQYGQGYPEEYEEHRGKGSFPAMITPAYQNAKKAHELASDIKYRQDFNKMKGAAHYHSLPAQDNLVLKQAQSVNKLVSENKYKENYQNHMRGRYEGVGMDRRTLHAMKVGSLASNVAYKADYKHDIVDYNYPATLTPSYQTAMKLVPLKDANYRQSIDKLKYSSVTDTPQIVQAKINAQQLSHVNYRADYEKNKLNYTLPQDVPQLVKAKTNAKLFSEVKYKEGWEKTKGKGFEMKLDAMSLLAAKASGELASNVHLLLSLKIKYKEEYEKTKGKAMGTADSRLLHSLQIAKMSSEVEYKKGFEESKTRFHLPMDMVNIRHAKKAQTLASDLDYRKKLHEYTVLPEDMKTQWAKKAYGLQSELQYKADLAWMKGVGWLTEGSLNLEQAKKAGQLVSEKNYRQRVDELKFTSVTDSSQMEHAKKSQELQSGVAYKAGNEQSVHQYTISKDEPLFLQARANAANLSEKLYKSSWENQKAKGFELRLDSLTFLAAKAKRDLASEVKYKEDYERSRGKLIGAKDVQGDSQMSHSLQMSKLQSELEYKKGFEDTKSQCHVSLDMVHLVHARKAQHLATDVGYKTAEHHFTALPTDMKVEWAKKAYGLQSDNQYRADVKWMKGMGWVATGSLNVEQAKKAGELISEKKYRQHPDALKFTSIKDTPEMVQARISYTQAVDRLYREQGENIKHHYTPTADLPEVLLAKLNAMNISETRYKESWSKLRDGGYKLRLDALPFQAAKASGEIISDYKYKEAFEKMKGQMLGSRSLEDDISLAHSVYATSLQSDVNYKKGFEHSKAQFHLPLDMAALVHAKKAQTLASNQDYKHPLPQYTSLAEDLRLSCAKKAHKLQSENLYRSDLNFMRGVACVIPGTLEIEGRKKASELISESKYRQHPHSFKYTAVTDTPNLLHAKFSNQITNERLYKAAGEDARHEYTMTLGLPEFIRAKTNAANLSDARYKESWRNLRAQGYKLTIEALPFQAARASGDIASDFLYRHDFVKERGKLIGPQSVRDDPRIQHCRRMGQLQSELQYRRGATSSQAQFHLPMDMVHLVHAKNAQALASDHDYRTQYHKFTALPEDLKMAWAKKAHALQSELRYKSDLIGMKGIGWLALRSPQMESAKKAGELISETKYRKKPDSIKFTTVVDSPDLVHAKNSYMHCNERMYRSGDAESLHRYTLIPDHPDFTRARLNALHLSDKVYRNSWEQTRAGSYDFRLDAIPFQTARASREIASDFRYKEAFLRDRGLQIGYRSVDDDPRMKHFLNVGRLQSDNEYKKDFAKSRSQFHSSTDQPGLLQAKRSQQLASDVHYRQPLPQPTCDPEQLGLRHAQKAHQLQSDVKYKSDLNLTRGVGWTPPGSYKVEMARRAAELANARGLGLQGAYRGAEAVEAGDHQSGEVNPDATEILHVKKKKALLL

SEQ ID NO: 55695 - protein, 275 aa, Homo sapiens
  Payload ID: 10963
  Gene Symbol: NECAP1
  Gene Name: NECAP endocytosis associated 1
  Uniprot ID: Q8NC96
  ENSP ID: ENSP00000341737
MATELEYESVLCVKPDVSVYRIPPRASNRGYRASDWKLDQPDWTGRLRITSKGKTAYIKLEDKVSGELFAQAPVEQYPGIAVETVTDSSRYFVIRIQDGTGRSAFIGIGFTDRGDAFDFNVSLQDHFKWVKQESEISKESQEMDARPKLDLGFKEGQTIKLCIGNITNKKGGASKPRTARGGGLSLLPPPPGGKVTIPPPSSSVAISNHVTPPPIPKSNHGGSDADILLDLDSPAPVTTPAPTPVSVSNDLWGDFSTASSSVPNQAPQPSNWVQF

SEQ ID NO: 55696 - protein, 102 aa, Homo sapiens
  Payload ID: 10963
  Gene Symbol: NECAP1
  Gene Name: NECAP endocytosis associated 1
  Uniprot ID: Q8NC96
  ENSP ID: ENSP00000401963
MATELEYESVLCVKPDVSVYRIPPRASNRGYRASDWKLDQPDWTGRLRITSKGKTAYIKLEDKVSGELFAQAPVEQYPGIAVETVTDSSRYFVIRIQDGTGG

SEQ ID NO: 55697 - protein, 116 aa, Homo sapiens
  Payload ID: 10963
  Gene Symbol: NECAP1
  Gene Name: NECAP endocytosis associated 1
  ENSP ID: ENSP00000439319
MDARPKLDLGFKEGQTIKLCIGNITNKKGGASKPRTARGGGLSLLPPPPGGKVTIPPPSSSVAISNHVTPPPIPKSNHGGSDADILLDLDSPAPVTTPAPTPVSVSNDLWGDFSTA

SEQ ID NO: 55698 - protein, 110 aa, Homo sapiens
  Payload ID: 10963
  Gene Symbol: NECAP1
  Gene Name: NECAP endocytosis associated 1
  ENSP ID: ENSP00000440658
MATELEYESVLCVKPDVSVYRIPPRASNRGYRASDWKLDQPDWTGRLRITSKGKTAYIKLEDKVSGELFAQAPVEQYPGIAVETVTDSSRYFVIRIQDGTEHYKQERRCF

SEQ ID NO: 55699 - protein, 263 aa, Homo sapiens
  Payload ID: 10964
  Gene Symbol: NECAP2
  Gene Name: NECAP endocytosis associated 2
  Uniprot ID: Q9NVZ3
  ENSP ID: ENSP00000338746
MEESGYESVLCVKPDVHVYRIPPRATNRGYRAAEWQLDQPSWSGRLRITAKGQMAYIKLEDRTSGELFAQAPVDQFPGTAVESVTDSSRYFVIRIEDGNGRRAFIGIGFGDRGDAFDFNVALQDHFKWVKQQCEFAKQAQNPDQGPKLDLGFKEGQTIKLNIANMKKKEGAAGNPRVRPASTGGLSLLPPPPGGKTSTLIPPPGEQLAVGGSLVQPAVAPSSGGAPVPWPQPNPATADIWGDFTKSTGSTSSQTQPGTGWVQF

SEQ ID NO: 55700 - protein, 273 aa, Homo sapiens
  Payload ID: 10964
  Gene Symbol: NECAP2
  Gene Name: NECAP endocytosis associated 2
  Uniprot ID: Q9NVZ3
  ENSP ID: ENSP00000391942
MEESGYESVLCVKPDVHVYRIPPRATNRGYRAAEWQLDQPSWSGRLRITAKGQMAYIKLEDRTSGELFAQAPVDQFPGTAVESVTDSSRYFVIRIEDGNGRRAFIGIGFGDRGDAFDFNVALQDHFKWVKQQCEFAKQAQNPDQGPKLDLGFKEGQTIKLNIANMKKKEGAAGNPRVRPASTGGLSLLPPPPGGKTSTLIPPPGEQLAVGGSLVQPAVAPSSDQLPARPSQAQAGSSSDLSTVFPHVTSGKALPHLGQRKEDEALLSWPVFGA

SEQ ID NO: 55701 - protein, 237 aa, Homo sapiens
  Payload ID: 10964
  Gene Symbol: NECAP2
  Gene Name: NECAP endocytosis associated 2
  Uniprot ID: Q9NVZ3
  ENSP ID: ENSP00000407091
MEESGAAEWQLDQPSWSGRLRITAKGQMAYIKLEDRTSGELFAQAPVDQFPGTAVESVTDSSRYFVIRIEDGNGRRAFIGIGFGDRGDAFDFNVALQDHFKWVKQQCEFAKQAQNPDQGPKLDLGFKEGQTIKLNIANMKKKEGAAGNPRVRPASTGGLSLLPPPPGGKTSTLIPPPGEQLAVGGSLVQPAVAPSSGGAPVPWPQPNPATADIWGDFTKSTGSTSSQTQPGTGWVQF

SEQ ID NO: 55702 - protein, 194 aa, Homo sapiens
  Payload ID: 10964
  Gene Symbol: NECAP2
  Gene Name: NECAP endocytosis associated 2
  ENSP ID: ENSP00000421335
MEESGYESVLCVKPDVHVYRIPPRATNRGYRAAEWQLDQPSWSGRLRITAKGQMAYIKLEDRTSGELFAQAPVDQFPGTAVESVTDSSRYFVIRIEDGNGRRAFIGIGFGDRGDAFDFNVALQDHFKWVKQQCEFAKQAQNPDQGPKLDLGFKEGQTIKLNIALASWPLREKCKSNPVDWLGCDSFSRLEETNI

SEQ ID NO: 55703 - protein, 101 aa, Homo sapiens
  Payload ID: 10964
  Gene Symbol: NECAP2
  Gene Name: NECAP endocytosis associated 2
  ENSP ID: ENSP00000421867
MEESGYESVLCVKPDVHVYRIPPRATNRGYRAAEWQLDQPSWSGRLRITAKGQMAYIKLEDRTSGELFAQAPVDQFPGTAVESVTDSSRYFVIRIEDGNGG

SEQ ID NO: 55704 - protein, 63 aa, Homo sapiens
  Payload ID: 10964
  Gene Symbol: NECAP2
  Gene Name: NECAP endocytosis associated 2
  ENSP ID: ENSP00000423213
  MOD_RES (1)..(1): Any amino acid
XGYESVLCVKPDVHVYRIPPRATNRGYRAAEWQLDQPSWSGRLRITAKGQMAYIKLEDRTSGG

SEQ ID NO: 55705 - protein, 202 aa, Homo sapiens
  Payload ID: 10964
  Gene Symbol: NECAP2
  Gene Name: NECAP endocytosis associated 2
  ENSP ID: ENSP00000424509
MEESGYESVLCVKPDVHVYRIPPRATNRGYRGALCSGPGGSVSWHSCGECDGFQQVLRDPHRRWKWWVKQQCEFAKQAQNPDQGPKLDLGFKEGQTIKLNIANMKKKEGAAGNPRVRPASTGGLSLLPPPPGGKTSTLIPPPGEQLAVGGSLVQPAVAPSSGGAPVPWPQPNPATADIWGDFTKSTGSTSSQTQPGTGWVQF

SEQ ID NO: 55706 - protein, 263 aa, Homo sapiens; identical to SEQ ID NO: 55699
  Payload ID: 10964
  Gene Symbol: NECAP2
  Gene Name: NECAP endocytosis associated 2
  Uniprot ID: Q9NVZ3
  ENSP ID: ENSP00000427620

SEQ ID NO: 55707 - protein, 321 aa, Homo sapiens
  Payload ID: 10965
  Gene Symbol: NDN
  Gene Name: necdin, melanoma antigen (MAGE) family member
  Uniprot ID: Q99608
  ENSP ID: ENSP00000332643
MSEQSKDLSDPNFAAEAPNSEVHSSPGVSEGVPPSATLAEPQSPPLGPTAAPQAAPPPQAPNDEGDPKALQQAAEEGRAHQAPSAAQPGPAPPAPAQLVQKAHELMWYVLVKDQKKMIIWFPDMVKDVIGSYKKWCRSILRRTSLILARVFGLHLRLTSLHTMEFALVKALEPEELDRVALSNRMPMTGLLLMILSLIYVKGRGARESAVWNVLRILGLRPWKKHSTFGDVRKLITEEFVQMNYLKYQRVPYVEPPEYEFFWGSRASREITKMQIMEFLARVFKKDPQAWPSRYREALEEARALREANPTAHYPRSSVSED

SEQ ID NO: 55708 - protein, 304 aa, Homo sapiens
  Payload ID: 10966
  Gene Symbol: NDNL2
  Gene Name: necdin-like 2, SMC5-SMC6 complex component
  Uniprot ID: Q96MG7
  ENSP ID: ENSP00000330694
MLQKPRNRGRSGGQAERDRDWSHSGNPGASRAGEDARVLRDGFAEEAPSTSRGPGGSQGSQGPSPQGARRAQAAPAVGPRSQKQLELKVSELVQFLLIKDQKKIPIKRADILKHVIGDYKDIFPDLFKRAAERLQYVFGYKLVELEPKSNTYILINTLEPVEEDAEMRGDQGTPTTGLLMIVLGLIFMKGNTIKETEAWDFLRRLGVYPTKKHLIFGDPKKLITEDFVRQRYLEYRRIPHTDPVDYEFQWGPRTNLETSKMKVLKFVAKVHNQDPKDWPAQYCEALADEENRARPQPSGPAPSS

SEQ ID NO: 55709 - protein, 304 aa, Homo sapiens; identical to SEQ ID NO: 55708
  Payload ID: 10966
  Gene Symbol: NDNL2
  Gene Name: necdin-like 2, SMC5-SMC6 complex component
  Uniprot ID: Q96MG7
  ENSP ID: ENSP00000487893

SEQ ID NO: 55710 - protein, 896 aa, Homo sapiens
  Payload ID: 10967
  Gene Symbol: N4BP1
  Gene Name: NEDD4 binding protein 1
  Uniprot ID: O75113
  ENSP ID: ENSP00000262384
MAARAVLDEFTAPAEKAELLEQSRGRIEGLFGVSLAVLGALGAEEPLPARIWLQLCGAQEAVHSAKEYIKGICEPELEERECYPKDMHCIFVGAESLFLKSLIQDTCADLCILDIGLLGIRGSAEAVVMARSHIQQFVKLFENKENLPSSQKESEVKREFKQFVEAHADNYTMDLLILPTSLKKELLTLTQGEENLFETGDDEVIEMRDSQQTEFTQNAATGLNISRDETVLQEEARNKAGTPVSELTKQMDTVLSSSPDVLFDPINGLTPDEEALSNERICQKRRFSDSEERHTKKQFSLENVQEGEILHDAKTLAGNVIADLSDSSADSENLSPDIKETTEEMEYNILVNFFKTMGYSQEIVEKVIKVYGPSTEPLLLLEEIEKENKRFQEDREFSAGTVYPETNKTKNKGVYSSTNELTTDSTPKKTQAHTQQNMVEKFSQLPFKVEAKPCTSNCRINTFRTVPIEQKHEVWGSNQNYICNTDPETDGLSPSVASPSPKEVNFVSRGASSHQPRVPLFPENGLHQQPEPLLPNNMKSACEKRLGCCSSPHSKPNCSTLSPPMPLPQLLPSVTDARSAGPSDHIDSSVTGVQRFRDTLKIPYKLELKNEPGRTDLKHIVIDGSNVAITHGLKKFFSCRGIAIAVEYFWKLGNRNITVFVPQWRTRRDPNVTEQHFLTQLQELGILSLTPARMVFGERIASHDDRFLLHLADKTGGIIVTNDNFREFVNESVSWREIITKRLLQYTFVGDIFMVPDDPLGRSGPRLEEFLQKEVCLRDMQPLLSALPNVGMFDPSFRVPGTQAASTSHQPPTRIQGAPSSHWLPQQPHFPLLPALPSLQQNLPMPAQRSSAETNELREALLKIFPDSEQRLKIDQILVAHPYMKDLNALSAMVLD

SEQ ID NO: 55711 - protein, 142 aa, Homo sapiens
  Payload ID: 10967
  Gene Symbol: N4BP1
  Gene Name: NEDD4 binding protein 1
  ENSP ID: ENSP00000460667
MHCIFVGAESLFLKSLIQDTCADLCILDIGLLGIRGSAEAVVMARSHIQQFVKLFENKENLPSSQKESEVKREFKQFVEAHADNYTMDLLILPTSLKKELLTLTQGEENLFETGDDEVIEMRDSQQTEFTQNAATGLNISRD

SEQ ID NO: 55712 - protein, 1770 aa, Homo sapiens
  Payload ID: 10968
  Gene Symbol: N4BP2
  Gene Name: NEDD4 binding protein 2
  Uniprot ID: Q86UW6
  ENSP ID: ENSP00000261435
MPRRRKNLGGNPFRKTANPKEVVVSSVASREEPTTTLPSMGETKVDQEELFTSISEIFSDLDPDVVYLMLSECDFKVENAMDCLLELSATDTKIEESSSQSFVASENQVGAAESKIMEKRPEEESEDSKMDSFLDMQLTEDLDSLIQNAFEKLNSSPDDQVYSFLPSQDVNSFNDSSEFINPDSSNMTPIFSTQNMNLNGENLENSGSTLSLNPLPSHSVLNESKCFIKDNTLALESNYPEDSLLSSSLNVASDSIAGCSSLNQKQKELLESECVEAQFSEAPVDLDASEPQACLNLPGLDLPGTGGDQKSTRVSDVFLPSEGFNFKPHKHPELPTKGKDVSYCPVLAPLPLLLPPPPPPPMWNPMIPAFDLFQGNHGFVAPVVTTAAHWRSVNYTFPPSVISHTSPTKVWRNKDGTSAYQVQETPVSQVVRKKTSYVGLVLVLLRGLPGSGKSFLARTLQEDNPSGVILSTDDYFYINGQYQFDVKYLGEAHEWNQNRAKEAFEKKISPIIIDNTNLQAWEMKPYVALSQKHKYKVLFREPDTWWKFKPKELARRNIHGVSKEKITRMLEHYQRFVSVPIIMSSSVPEKIERIELCAYSCEDRSTSPRDDEDIISEKEENILSLSLKHLEFTEEKNLDVTKETMLPENVAYLSNADLNKRRKEISDMNPSIQSALILETPHMYFSDSESKLQATDKSENEQIEMVAVKGYSKTDTDSSMERVSPSTCCSENNQEDCDLANSGPLQNEKSSPGEIVEERATVTKKAFGKQKSKSTLEKFPRHELSNFVGDWPVDKTIGQRTKRNRKTEKTSSVQSDKKYNYPQSHKLVNSVSVNTDCVQQRGSPHESVEDGRKSQCDDASEPLNSYKYDAYKNIDKNSFNIMGDWPSSDSLAQREHRSRMPKTGLSEPNLEIGTNDKMNEISLSTAHEACWGTSSQKLKTLGSSNLGSSEMLLSEMTCESQTCLSKKSHGQHTSLPLTFTNSAPTVSGVVEPQTLAECQEQMPKRDPGKEVGMCTQTEPQDFALLWKIEKNKISISDSIKVLTGRLDGFKPKVFNINTKSDVQEAIPYRVMYDKSTFVEESELTSADESENLNILCKLFGSFSLEALKDLYERCNKDIIWATSLLLDSETKLCEDTEFENFQKSCDGSQIGPFSLGLNLKEIISQRGTLENSNSPVPEFSHGIGISNADSQSTCDAERGNSEQAEMRAVTPENHESMTSIFPSAAVGLKNNNDILPNSQEELLYSSKQSFPGILKATTPKDMSETEKNLVVTETGDNIHSPSHFSDIFNFVSSTSNLELNEEIYFTDSLEIKRNENFPKDYVKFSDEEEFMNEDEKEMKEILMAGSSLSAGVSGEDKTEILNPTPAMAKSLTIDCLELALPPELAFQLNELFGPVGIDSGSLTVEDCVVHIDLNLAKVIHEKWKESVMERQRQEEVSCGKFMQDPSLVGHTGLDNPEQKSSQRTGKKLLKTLTASEMLPLLDHWNTQTKKVSLREIMSEEIALQEKHNLKRETLMFEKDCATKLKEKQLFKIFPAINQNFLVDIFKDHNYSLEHTVQFLNCVLEGDPVKTVVAQEFVHQNENVTSHTGQKSKEKKPKKLKETEETPSELSFQDFEYPDYDDYRAEAFLHQQKRMECYSKAKEAYRIGKKNVATFYAQQGTLHEQKMKEANHLAAIEIFEKVNASLLPQNVLDLHGLHVDEALEHLMRVLEKKTEEFKQNGGKPYLSVITGRGNHSQGGVARIKPAVIKYLISHSFRFSEIKPGCLKVMLK

SEQ ID NO: 55713 - protein, 173 aa, Homo sapiens
  Payload ID: 10968
  Gene Symbol: N4BP2
  Gene Name: NEDD4 binding protein 2
  ENSP ID: ENSP00000422057
MDCLLELSATDTKIEESSSQSFVASENQVGAAESKIMEKRPEEESEDSKMDSFLDMQLTEDLDSLIQNAFEKLNSSPDDQVYSFLPSQDVNSFNDSSEFINPDSSNMTPIFSTQNMNLNGENLENSGSTLSLNPLPSHSVLNESKCFIKDNTLALESNYPEDSLLSSSLNVAS

SEQ ID NO: 55714 - protein, 99 aa, Homo sapiens
  Payload ID: 10968
  Gene Symbol: N4BP2
  Gene Name: NEDD4 binding protein 2
  ENSP ID: ENSP00000422436
MPRRRKNLGGNPFRKTANPKEVVVSSVASREEPTTTLPSMGETKVDQEELFTSISEIFSDLDPDVVYLMLSECDFKGNLIGCLLGASSCAQHFFMDYLI

SEQ ID NO: 55715 - protein, 1400 aa, Homo sapiens
  Payload ID: 10968
  Gene Symbol: N4BP2
  Gene Name: NEDD4 binding protein 2
  ENSP ID: ENSP00000426430
  MOD_RES (1)..(1): Any amino acid
XPPPPPPPMWNPMIPAFDLFQGNHGFVAPVVTTAAHWRSVNYTFPPSVISHTSPTKVWRNKDGTSAYQVQETPVSQVVRKKTSYVGLVLVLLRGLPGSGKSFLARTLQEDNPSGVILSTDDYFYINGQYQFDVKYLGEAHEWNQNRAKEAFEKKISPIIIDNTNLQAWEMKPYVALSQKHKYKVLFREPDTWWKFKPKELARRNIHGVSKEKITRMLEHYQRFVSVPIIMSSSVPEKIERIELCAYSCEDRSTSPRDDEDIISEKEENILSLSLKHLEFTEEKNLDVTKETMLPENVAYLSNADLNKRRKEISDMNPSIQSALILETPHMYFSDSESKLQATDKSENEQIEMVAVKGYSKTDTDSSMERVSPSTCCSENNQEDCDLANSGPLQNEKSSPGEIVEERATVTKKAFGKQKSKSTLEKFPRHELSNFVGDWPVDKTIGQRTKRNRKTEKTSSVQSDKKYNYPQSHKLVNSVSVNTDCVQQRGSPHESVEDGRKSQCDDASEPLNSYKYDAYKNIDKNSFNIMGDWPSSDSLAQREHRSRMPKTGLSEPNLEIGTNDKMNEISLSTAHEACWGTSSQKLKTLGSSNLGSSEMLLSEMTCESQTCLSKKSHGQHTSLPLTFTNSAPTVSGVVEPQTLAECQEQMPKRDPGKEVGMCTQTEPQDFALLWKIEKNKISISDSIKVLTGRLDGFKPKVFNINTKSDVQEAIPYRVMYDKSTFVEESELTSADESENLNILCKLFGSFSLEALKDLYERCNKDIIWATSLLLDSETKLCEDTEFENFQKSCDGSQIGPFSLGLNLKEIISQRGTLENSNSPVPEFSHGIGISNADSQSTCDAERGNSEQAEMRAVTPENHESMTSIFPSAAVGLKNNNDILPNSQEELLYSSKQSFPGILKATTPKDMSETEKNLVVTETGDNIHSPSHFSDIFNFVSSTSNLELNEEIYFTDSLEIKRNENFPKDYVKFSDEEEFMNEDEKEMKEILMAGSSLSAGVSGEDKTEILNPTPAMAKSLTIDCLELALPPELAFQLNELFGPVGIDSGSLTVEDCVVHIDLNLAKVIHEKWKESVMERQRQEEVSCGKFMQDPSLVGHTGLDNPEQKSSQRTGKKLLKTLTASEMLPLLDHWNTQTKKVSLREIMSEEIALQEKHNLKRETLMFEKDCATKLKEKQLFKIFPAINQNFLVDIFKDHNYSLEHTVQFLNCVLEGDPVKTVVAQEFVHQNENVTSHTGQKSKEKKDFEYPDYDDYRAEAFLHQQKRMECYSKAKEAYRIGKKNVATFYAQQGTLHEQKMKEANHLAAIEIFEKVNASLLPQNVLDLHGLHVDEALEHLMRVLEKKTEEFKQNGGKPYLSVITGRGNHSQGGVARIKPAVIKYLISHSFRFSEIKPGCLKVMLK

SEQ ID NO: 55716 - protein, 60 aa, Homo sapiens
  Payload ID: 10969
  Gene Symbol: N4BP2L1
  Gene Name: NEDD4 binding protein 2-like 1
  ENSP ID: ENSP00000345838
MEDSFLQSFGRLSLQPQQQQQRQRPPRPPPRGTPPRRHSFRKHLYLLRGLPGSGKTTLAR

SEQ ID NO: 55717 - protein, 243 aa, Homo sapiens
  Payload ID: 10969
  Gene Symbol: N4BP2L1
  Gene Name: NEDD4 binding protein 2-like 1
  Uniprot ID: Q5TBK1
  ENSP ID: ENSP00000369473
MEDSFLQSFGRLSLQPQQQQQRQRPPRPPPRGTPPRRHSFRKHLYLLRGLPGSGKTTLARQLQHDFPRALIFSTDDFFFREDGAYEFNPDFLEEAHEWNQKRARKAMRNGISPIIIDNTNLHAWEMKPYAVMALENNYEVIFREPDTRWKFNVQELARRNIHGVSREKIHRMKERYEHDVTFHSVLHAEKPSRMNRNQDRNNALPSNNARYWNSYTEFPNRRAHGGFTNESSYHRRGGCHHGY

SEQ ID NO: 55718 - protein, 243 aa, Homo sapiens; identical to SEQ ID NO: 55717
  Payload ID: 10969
  Gene Symbol: N4BP2L1
  Gene Name: NEDD4 binding protein 2-like 1
  Uniprot ID: Q5TBK1
  ENSP ID: ENSP00000369476

SEQ ID NO: 55719 - protein, 173 aa, Homo sapiens
  Payload ID: 10969
  Gene Symbol: N4BP2L1
  Gene Name: NEDD4 binding protein 2-like 1
  Uniprot ID: Q5TBK1
  ENSP ID: ENSP00000369484
MEDSFLQSFGRLSLQPQQQQQRQRPPRPPPRGTPPRRHSFRKHLYLLRGLPGSGKTTLARQLQHDFPRALIFSTDDFFFREDGAYEFNPDFLEEAHEWNQKRARKAMRNGISPIIIDNTNLHAWEMKPYAVMVFQTEQKNLFRLEMDMVVFRPEMKKHSWCLKRKNPPNERTV

SEQ ID NO: 55720 - protein, 137 aa, Homo sapiens
  Payload ID: 10969
  Gene Symbol: N4BP2L1
  Gene Name: NEDD4 binding protein 2-like 1
  ENSP ID: ENSP00000435515
MRNGISPIIIDNTNLHAWEMKPYAVMALENNYEVIFREPDTRWKFNVQELARRNIHGVSREKIHRMKERYEHDVTFHSVLHAEKPSRMNRNQDRNNALPSNNARYWNSYTEFPNRRAHGGFTNESSYHRRGGCHHGY

SEQ ID NO: 55721 - protein, 159 aa, Homo sapiens
  Payload ID: 10969
  Gene Symbol: N4BP2L1
  Gene Name: NEDD4 binding protein 2-like 1
  ENSP ID: ENSP00000475237
  MOD_RES (1)..(1): Any amino acid
XRPPRPPPRGTPPRRHSFRKHLYLLRGLPGSGKTTLARQLQHDFPRALIFSTDDFFFREDGAYEFNPDFLEEAHEWNQKRARKAMRNGISPIIIDNTNLHAWEMKPYAVMALENNYEVIFREPDTRWKFNVQELARRNIHGVSREKIHRMKERLESDLM

SEQ ID NO: 55722 - protein, 79 aa, Homo sapiens
  Payload ID: 10969
  Gene Symbol: N4BP2L1
  Gene Name: NEDD4 binding protein 2-like 1
  ENSP ID: ENSP00000475443
  MOD_RES (1)..(1): Any amino acid
XRPPRPPPRGTPPRRHSFRKHLYLLRGLPGSGKTTLARDDWSEHWPGSLKIVPSDLLRHLLAGDFGQSSSFSGPYVPYM

SEQ ID NO: 55723 - protein, 173 aa, Homo sapiens; identical to SEQ ID NO: 55719
  Payload ID: 10969
  Gene Symbol: N4BP2L1
  Gene Name: NEDD4 binding protein 2-like 1
  Uniprot ID: Q5TBK1
  ENSP ID: ENSP00000483310

SEQ ID NO: 55724 - protein, 136 aa, Homo sapiens
  Payload ID: 10969
  Gene Symbol: N4BP2L1
  Gene Name: NEDD4 binding protein 2-like 1
  ENSP ID: ENSP00000488989
MEDSFLQSFGRLSLQPQQQQQRQRPPRPPPRGTPPRRHSFRKHLYLLRGLPGSGKTTLARCSEWSSGQRRQKSLPSWNMYSIREKKFSRKKGNFSICSALFSQKISKGFHSVLGTWESSVNKTKILPLWTLCARGS

SEQ ID NO: 55725 - protein, 93 aa, Homo sapiens
  Payload ID: 10969
  Gene Symbol: N4BP2L1
  Gene Name: NEDD4 binding protein 2-like 1
  ENSP ID: ENSP00000489267
MEDSFLQSFGRLSLQPQQQQQRQRPPRPPPRGTPPRRHSFRKHLYLLRGLPGSGKTTLASVLGTWESSVNKTKILPLWTLCARDNCSMTFPGP

SEQ ID NO: 55726 - protein, 166 aa, Homo sapiens
  Payload ID: 10969
  Gene Symbol: N4BP2L1
  Gene Name: NEDD4 binding protein 2-like 1
  ENSP ID: ENSP00000489423
  MOD_RES (1)..(1): Any amino acid
XRPPRPPPRGTPPRRHSFRKHLYLLRGLPGSGKTTLARQLQHDFPRALIFSTDDFFFREDGAYEFNPDFLEEAHEWNQKRARKAMRNGISPIIIDNTNLHAWEMKPYAVMALENNYEVIFREPDTRWKFNVQELARQIVSSKWICGLLHQNCLRWLLKSEFMDPIQ

SEQ ID NO: 55727 - protein, 583 aa, Homo sapiens
  Payload ID: 10970
  Gene Symbol: N4BP2L2
  Gene Name: NEDD4 binding protein 2-like 2
  Uniprot ID: Q92802
  ENSP ID: ENSP00000267068
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGTDRFVNQQFQEEKLNKLQKLLILLRGLPGSGKTTLSRILLGQNRDGIVFSTDDYFHHQDGYRYNVNQLGDAHDWNQNRAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRWGGSLGSHNRVCVTNNH

SEQ ID NO: 55728 - protein, 737 aa, Homo sapiens
  Payload ID: 10970
  Gene Symbol: N4BP2L2
  Gene Name: NEDD4 binding protein 2-like 2
  ENSP ID: ENSP00000350104
MALCSALMTIFTIKMGTAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRERVLKKTGHRLSKTKQKRNRKRNKKQNSQNRIMEENSLEFLSDLTPGDQDPSQSEEEDIEKTRRESEYPFIDGLQNEVGDFVTGYKEKRWKNKDPKDSFQNVMSIVELDNTPKNYLSKEGDNLFVSLLLRPNEISVTCPILTQNLSCVTTDDCSGMKVEKHIRNRHTIALDTQDLSAETSCLFMKKREIVDKNLSHEPILCHQHGIRMSDKVLREEQVYTTKINHWAFFTTNLSDEDLQLGSDRQPYFGSWPAGPHKFICEQRPKKDRACKLAGPDSRGQWIQMIFTSVAASEPGNNPEILTDKLLIGNEDFSPPPETMDSFIETNLFRSCLPQPDIPKNALESTKNKKRRKKRIFNLVPNFDLLGQSRIGVKEREKCDLLTKNHGLKITLGEEKDRISERNSEEENKQKLMTFDHHPLWFYLDIIKATPLNIDGQRYSHCLSFNRLRCSASLYKNYIPSFVLHNLSSIWKPSFTNKKLFLTFESQTRVGNKLNDAGFISPEILHSHPDTSCSLGVTSDFHFLNERFDRKLKRWEEPKELPAEDSQDLTSTDYRSLELPLSQGFAFQLVKLFGSPGVPMESLLPDDYVVPLDWKTLKMIYLQWKMSVEKRQKKIG

SEQ ID NO: 55729 - protein, 752 aa, Homo sapiens
  Payload ID: 10970
  Gene Symbol: N4BP2L2
  Gene Name: NEDD4 binding protein 2-like 2
  Uniprot ID: Q92802
  ENSP ID: ENSP00000382328
MSYGEIEEFCLVRIVMALCSALMTIFTIKMGTAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRERVLKKTGHRLSKTKQKRNRKRNKKQNSQNRIMEENSLEFLSDLTPGDQDPSQSEEEDIEKTRRESEYPFIDGLQNEVGDFVTGYKEKRWKNKDPKDSFQNVMSIVELDNTPKNYLSKEGDNLFVSLLLRPNEISVTCPILTQNLSCVTTDDCSGMKVEKHIRNRHTIALDTQDLSAETSCLFMKKREIVDKNLSHEPILCHQHGIRMSDKVLREEQVYTTKINHWAFFTTNLSDEDLQLGSDRQPYFGSWPAGPHKFICEQRPKKDRACKLAGPDSRGQWIQMIFTSVAASEPGNNPEILTDKLLIGNEDFSPPPETMDSFIETNLFRSCLPQPDIPKNALESTKNKKRRKKRIFNLVPNFDLLGQSRIGVKEREKCDLLTKNHGLKITLGEEKDRISERNSEEENKQKLMTFDHHPLWFYLDIIKATPLNIDGQRYSHCLSFNRLRCSASLYKNYIPSFVLHNLSSIWKPSFTNKKLFLTFESQTRVGNKLNDAGFISPEILHSHPDTSCSLGVTSDFHFLNERFDRKLKRWEEPKELPAEDSQDLTSTDYRSLELPLSQGFAFQLVKLFGSPGVPMESLLPDDYVVPLDWKTLKMIYLQWKMSVEKRQKKIG

SEQ ID NO: 55730 - protein, 655 aa, Homo sapiens
  Payload ID: 10970
  Gene Symbol: N4BP2L2
  Gene Name: NEDD4 binding protein 2-like 2
  Uniprot ID: Q92802
  ENSP ID: ENSP00000394239
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGTDRFVNQQFQEEKLNKLQKLLILLRGLPGSGKTTLSRILLGQNRDGIVFSTDDYFHHQDGYRYNVNQLGDAHDWNQNRAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRFDRKLKRWEEPKELPAEDSQDLTSTDYRSLELPLSQGFAFQLVKLFGSPGVPMESLLPDDYVVPLDWKTLKMIYLQWKMSVEKRQKKIG

SEQ ID NO: 55731 - protein, 709 aa, Homo sapiens
  Payload ID: 10970
  Gene Symbol: N4BP2L2
  Gene Name: NEDD4 binding protein 2-like 2
  ENSP ID: ENSP00000423362
MSYGEIEGKFLGPREEVTSEPRCKKLKSTTESYVFHNHSNADFHRIQEKTGNDWVPVTIIDVRGHSYLQENKIKTTDLHRPLHDEMPGNRPDVIESIDSQVLQEARPPLVSADDEIYSTSKAFIGPIYKPPEKKKRNEGRNEAHVLNGINDRGGQKEKQKFNSEKSEIDNELFQFYKEIEELEKEKDGFENSCKESEPSQEQFVPFYEGHNNGLLKPDEEKKDLSNKAMPSHCDYQQNLGNEPDKYPCNGQVIPTFCDTSFTSFRPEWQSVYPFIVPYGPPLPSLNYHLNIQRFSGPPNPPSNIFQAQDDSQIQNGYYVNNCHVNWNCMTFDQNNEYTDCSENRSSVHPSGNGCSMQDRYVSNGFCEVRERCWKDHCMDKHNGTDRFVNQQFQEEKLNKLQKLLILLRGLPGSGKTTLSRILLGQNRDGIVFSTDDYFHHQDGYRYNVNQLGDAHDWNQNRAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRERVLKKTGHRLSKTKQKRNRKRNKKQNSQNRIMEENSLEFLSDLTPGDQDPSQSEEEDIEKTRRESEYPFIDGLQNEVGDFVTGYKEKRWKNKDPKDSFQNVMSIVELDNTPKNYLSKEGDNLFVSLLLRPNEISVTCPILTQ

SEQ ID NO: 55732 - protein, 737 aa, Homo sapiens; identical to SEQ ID NO: 55728
  Payload ID: 10970
  Gene Symbol: N4BP2L2
  Gene Name: NEDD4 binding protein 2-like 2
  ENSP ID: ENSP00000427477

SEQ ID NO: 55733 - protein, 544 aa, Homo sapiens
  Payload ID: 10971
  Gene Symbol: N4BP3
  Gene Name: NEDD4 binding protein 3
  Uniprot ID: O15049
  ENSP ID: ENSP00000274605
MATAPGPAGIAMGSVGSLLERQDFSPEELRAALAGSRGSRQPDGLLRKGLGQREFLSYLHLPKKDSKSTKNTKRAPRNEPADYATLYYREHSRAGDFSKTSLPERGRFDKCRIRPSVFKPTAGNGKGFLSMQSLASHKGQKLWRSNGSLHTLACHPPLSPGPRASQARAQLLHALSLDEGGPEPEPSLSDSSSGGSFGRSPGTGPSPFSSSLGHLNHLGGSLDRASQGPKEAGPPAVLSCLPEPPPPYEFSCSSAEEMGAVLPETCEELKRGLGDEDGSNPFTQVLEERQRLWLAELKRLYVERLHEVTQKAERSERNLQLQLFMAQQEQRRLRKELRAQQGLAPEPRAPGTLPEADPSARPEEEARWEVCQKTAEISLLKQQLREAQAELAQKLAEIFSLKTQLRGSRAQAQAQDAELVRLREAVRSLQEQAPREEAPGSCETDDCKSRGLLGEAGGSEARDSAEQLRAELLQERLRGQEQALRFEQERRTWQEEKERVLRYQREIQGGYMDMYRRNQALEQELRALREPPTPWSPRLESSKI

SEQ ID NO: 55734 - protein, 221 aa, Homo sapiens
  Payload ID: 10972
  Gene Symbol: NDFIP1
  Gene Name: Nedd4 family interacting protein 1
  Uniprot ID: Q9BT67
  ENSP ID: ENSP00000253814
MALALAALAAVEPACGSRYQQLQNEEESGEPEQAAGDAPPPYSSISAESAAYFDYKDESGFPKPPSYNVATTLPSYDEAERTKAEATIPLVPGRDEDFVGRDDFDDADQLRIGNDGIFMLTFFMAFLFNWIGFFLSFCLTTSAAGRYGAISGFGLSLIKWILIVRFSTYFPGYFDGQYWLWWVFLVLGFLLFLRGFINYAKVRKMPETFSNLPRTRVLFIY

SEQ ID NO: 55735 - protein, 336 aa, Homo sapiens
  Payload ID: 10973
  Gene Symbol: NDFIP2
  Gene Name: Nedd4 family interacting protein 2
  Uniprot ID: Q9NV92
  ENSP ID: ENSP00000218652
MARRRSQRVCASGPSMLNSARGAPELLRGTATNAEVSAAAAGATGSEELPPGDRGCRNGGGRGPAATTSSTGVAVGAEHGEDSLSRKPDPEPGRMDHHQPGTGRYQVLLNEEDNSESSAIEQPPTSNPAPQIVQAASSAPALETDSSPPPYSSITVEVPTTSDTEVYGEFYPVPPPYSVATSLPTYDEAEKAKAAAMAAAAAETSQRIQEEECPPRDDFSDADQLRVGNDGIFMLAFFMAFIFNWLGFCLSFCITNTIAGRYGAICGFGLSLIKWILIVRFSDYFTGYFNGQYWLWWIFLVLGLLLFFRGFVNYLKVRNMSESMAAAHRTRYFFLL

SEQ ID NO: 55736 - protein, 222 aa, Homo sapiens
  Payload ID: 10973
  Gene Symbol: NDFIP2
  Gene Name: Nedd4 family interacting protein 2
  ENSP ID: ENSP00000419200
MDHHQPGTGRYQVLLNEEDNSESSAIEQPPTSNPAPQIVQAASSAPALETDSSPPPYSSITVEVPTTSDTEVYGEFYPVPPPYSVATSLPTYDEAEKAKAAAMAAAAAETSQRIQEEECPPRDDFSDADQLRVGNDGIFMLAFFTGRYGAICGFGLSLIKWILIVRFSDYFTGYFNGQYWLWWIFLVLGLLLFFRGFVNYLKVRNMSESMAAAHRTRYFFLL

SEQ ID NO: 55737 - protein, 146 aa, Homo sapiens
  Payload ID: 10973
  Gene Symbol: NDFIP2
  Gene Name: Nedd4 family interacting protein 2
  ENSP ID: ENSP00000419776
MDHHQPGTGRYQVLLNEEDNSESSAIEQPPTSNPAPQIVQAASSAPALETDSSPPPYSSITVEVPTTSDTEVYGEFYPVPPPYSVATSLPTYDEAEKAKAAAMAAAAAETSQRIQEEECPPRDDFSDADQLRVGNDGIFMLAFFIF

SEQ ID NO: 55738 - protein, 336 aa, Homo sapiens; identical to SEQ ID NO: 55735
  Payload ID: 10973
  Gene Symbol: NDFIP2
  Gene Name: Nedd4 family interacting protein 2
  Uniprot ID: Q9NV92
  ENSP ID: ENSP00000480798

SEQ ID NO: 55739 - protein, 242 aa, Homo sapiens
  Payload ID: 10973
  Gene Symbol: NDFIP2
  Gene Name: Nedd4 family interacting protein 2
  ENSP ID: ENSP00000480881
MDHHQPGTGRYQVLLNEEDNSESSAIEQPPTSNPAPQIVQAASSAPALETDSSPPPYSSITVEVPTTSDTEVYGEFYPVPPPYSVATSLPTYDEAEKAKAAAMAAAAAETSQRIQEEECPPRDDFSDADQLRVGNDGIFMLAFFMAFIFNWLGFCLSFCITNTIAGRYGAICGFGLSLIKWILIVRFSDYFTGYFNGQYWLWWIFLVLGLLLFFRGFVNYLKVRNMSESMAAAHRTRYFFLL

SEQ ID NO: 55740 - protein, 534 aa, Homo sapiens
  Payload ID: 10974
  Gene Symbol: NAE1
  Gene Name: NEDD8 activating enzyme E1 subunit 1
  Uniprot ID: Q13564
  ENSP ID: ENSP00000290810
MAQLGKLLKEQKYDRQLRLWGDHGQEALESAHVCLINATATGTEILKNLVLPGIGSFTIIDGNQVSGEDAGNNFFLQRSSIGKNRAEAAMEFLQELNSDVSGSFVEESPENLLDNDPSFFCRFTVVVATQLPESTSLRLADVLWNSQIPLLICRTYGLVGYMRIIIKEHPVIESHPDNALEDLRLDKPFPELREHFQSYDLDHMEKKDHSHTPWIVIIAKYLAQWYSETNGRIPKTYKEKEDFRDLIRQGILKNENGAPEDEENFEEAIKNVNTALNTTQIPSSIEDIFNDDRCINITKQTPSFWILARALKEFVAKEGQGNLPVRGTIPDMIADSGKYIKLQNVYREKAKKDAAAVGNHVAKLLQSIGQAPESISEKELKLLCSNSAFLRVVRCRSLAEEYGLDTINKDEIISSMDNPDNEIVLYLMLRAVDRFHKQQGRYPGVSNYQVEEDIGKLKSCLTGFLQEYGLSVMVKDDYVHEFCRYGAAEPHTIAAFLGGAAAQEVIKIITKQFVIFNNTYIYSGMSQTSATFQL

SEQ ID NO: 55741 - protein, 537 aa, Homo sapiens
  Payload ID: 10974
  Gene Symbol: NAE1
  Gene Name: NEDD8 activating enzyme E1 subunit 1
  Uniprot ID: Q13564
  ENSP ID: ENSP00000351990
MAQLGKLLKEQKYDRQLRLWGDHGQEALESAHVCLINATATGTEILKNLVLPGNVGIGSFTIIDGNQVSGEDAGNNFFLQRSSIGKNRAEAAMEFLQELNSDVSGSFVEESPENLLDNDPSFFCRFTVVVATQLPESTSLRLADVLWNSQIPLLICRTYGLVGYMRIIIKEHPVIESHPDNALEDLRLDKPFPELREHFQSYDLDHMEKKDHSHTPWIVIIAKYLAQWYSETNGRIPKTYKEKEDFRDLIRQGILKNENGAPEDEENFEEAIKNVNTALNTTQIPSSIEDIFNDDRCINITKQTPSFWILARALKEFVAKEGQGNLPVRGTIPDMIADSGKYIKLQNVYREKAKKDAAAVGNHVAKLLQSIGQAPESISEKELKLLCSNSAFLRVVRCRSLAEEYGLDTINKDEIISSMDNPDNEIVLYLMLRAVDRFHKQQGRYPGVSNYQVEEDIGKLKSCLTGFLQEYGLSVMVKDDYVHEFCRYGAAEPHTIAAFLGGAAAQEVIKIITKQFVIFNNTYIYSGMSQTSATFQL

SEQ ID NO: 55742 - protein, 528 aa, Homo sapiens
  Payload ID: 10974
  Gene Symbol: NAE1
  Gene Name: NEDD8 activating enzyme E1 subunit 1
  Uniprot ID: Q13564
  ENSP ID: ENSP00000368776
MDAQQTKTNEARLWGDHGQEALESAHVCLINATATGTEILKNLVLPGIGSFTIIDGNQVSGEDAGNNFFLQRSSIGKNRAEAAMEFLQELNSDVSGSFVEESPENLLDNDPSFFCRFTVVVATQLPESTSLRLADVLWNSQIPLLICRTYGLVGYMRIIIKEHPVIESHPDNALEDLRLDKPFPELREHFQSYDLDHMEKKDHSHTPWIVIIAKYLAQWYSETNGRIPKTYKEKEDFRDLIRQGILKNENGAPEDEENFEEAIKNVNTALNTTQIPSSIEDIFNDDRCINITKQTPSFWILARALKEFVAKEGQGNLPVRGTIPDMIADSGKYIKLQNVYREKAKKDAAAVGNHVAKLLQSIGQAPESISEKELKLLCSNSAFLRVVRCRSLAEEYGLDTINKDEIISSMDNPDNEIVLYLMLRAVDRFHKQQGRYPGVSNYQVEEDIGKLKSCLTGFLQEYGLSVMVKDDYVHEFCRYGAAEPHTIAAFLGGAAAQEVIKIITKQFVIFNNTYIYSGMSQTSATFQL

SEQ ID NO: 55743 - protein, 445 aa, Homo sapiens
  Payload ID: 10974
  Gene Symbol: NAE1
  Gene Name: NEDD8 activating enzyme E1 subunit 1
  Uniprot ID: Q13564
  ENSP ID: ENSP00000377637
MEFLQELNSDVSGSFVEESPENLLDNDPSFFCRFTVVVATQLPESTSLRLADVLWNSQIPLLICRTYGLVGYMRIIIKEHPVIESHPDNALEDLRLDKPFPELREHFQSYDLDHMEKKDHSHTPWIVIIAKYLAQWYSETNGRIPKTYKEKEDFRDLIRQGILKNENGAPEDEENFEEAIKNVNTALNTTQIPSSIEDIFNDDRCINITKQTPSFWILARALKEFVAKEGQGNLPVRGTIPDMIADSGKYIKLQNVYREKAKKDAAAVGNHVAKLLQSIGQAPESISEKELKLLCSNSAFLRVVRCRSLAEEYGLDTINKDEIISSMDNPDNEIVLYLMLRAVDRFHKQQGRYPGVSNYQVEEDIGKLKSCLTGFLQEYGLSVMVKDDYVHEFCRYGAAEPHTIAAFLGGAAAQEVIKIITKQFVIFNNTYIYSGMSQTSATFQL

SEQ ID NO: 55744 - protein, 23 aa, Homo sapiens
  Payload ID: 10974
  Gene Symbol: NAE1
  Gene Name: NEDD8 activating enzyme E1 subunit 1
  ENSP ID: ENSP00000454471
MAQLGKLLKEQKYDRQLRVQKTF

SEQ ID NO: 55745 - protein, 109 aa, Homo sapiens
  Payload ID: 10974
  Gene Symbol: NAE1
  Gene Name: NEDD8 activating enzyme E1 subunit 1
  ENSP ID: ENSP00000454506
MAQLGKLLKEQKYDRQLSTSLRLADVLWNSQIPLLICRTYGLVGYMRIIIKEHPVIESHPDNALEDLRLDKPFPELREHFQSYDLDHMEKKDHSHTPWIVIIAKYLAQW

SEQ ID NO: 55746 - protein, 25 aa, Homo sapiens
  Payload ID: 10974
  Gene Symbol: NAE1
  Gene Name: NEDD8 activating enzyme E1 subunit 1
  ENSP ID: ENSP00000455562
MAQLGKLLKEQKYDRQLRYWFVYNY

SEQ ID NO: 55747 - protein, 167 aa, Homo sapiens
  Payload ID: 10974
  Gene Symbol: NAE1
  Gene Name: NEDD8 activating enzyme E1 subunit 1
  ENSP ID: ENSP00000455967
MAQLGKLLKEQKYDRQLRRSLALSPRLECSGAISAHFKLRLLGSRHSSASASELWGDHGQEALESAHVCLINATATGTEILKNLVLPGIGSFTIIDGNQVSGEDAGNNFFLQRSSIGKNRAEAAMEFLQELNSDVSGSFVEESPENLLDNDPSFFCRFTVVVATQLP

SEQ ID NO: 55748 - protein, 64 aa, Homo sapiens
  Payload ID: 10974
  Gene Symbol: NAE1
  Gene Name: NEDD8 activating enzyme E1 subunit 1
  ENSP ID: ENSP00000456564
MAQLGKLLKEQKYDRQLRRFLHTFDSCLGPYGAYSGVERWMLSKQKQMKPGTVACACSPSNSRG

SEQ ID NO: 55749 - protein, 85 aa, Homo sapiens
  Payload ID: 10974
  Gene Symbol: NAE1
  Gene Name: NEDD8 activating enzyme E1 subunit 1
  ENSP ID: ENSP00000456847
MAQLGKLLKEQKYDRQLRLWGDHGQEALESAHVCLINATATGTEILKNLVLPGIGSFTIIDGNQVSGEDAGNKTELKLPWNSYKN

SEQ ID NO: 55750 - protein, 162 aa, Homo sapiens
  Payload ID: 10974
  Gene Symbol: NAE1
  Gene Name: NEDD8 activating enzyme E1 subunit 1
  ENSP ID: ENSP00000462040
MDAQQTKTNEARLWGDHGQEALESAHVCLINATATGTEILKNLVLPGIGSFTIIDGNQVSGEDAGNNFFLQRSSIGKNRAEAAMEFLQELNSDVSGSFVEESPENLLDNDPSFFCRFTVVVATQLPESTSLRLADVLWNSQIPLLICRTYGLVGYMRIIIKE

SEQ ID NO: 55751 - protein, 129 aa, Homo sapiens
  Payload ID: 10974
  Gene Symbol: NAE1
  Gene Name: NEDD8 activating enzyme E1 subunit 1
  ENSP ID: ENSP00000462937
APESISEKELKLLCSNSAFLRVVRCRSLAEEYGLDTINKDEIISSMDNPDNEIVLYLMLRAVDRFHKQQGRYPGVSNYQVEEDIGKLKSCLTGFLQEYGLSVMVKDDYVHELSCCSRGHQNNHQTICNF

SEQ ID NO: 55752 - protein, 112 aa, Homo sapiens
  Payload ID: 10974
  Gene Symbol: NAE1
  Gene Name: NEDD8 activating enzyme E1 subunit 1
  ENSP ID: ENSP00000463546
FHKQQGRYPGVSNYQVEEDIGKLKSCLTGFLQEYGLSVMVKDDYVHELLIKIHVSVVSFSCRYGAAEPHTIAAFLGGAAAQEVIKIITKQFVIFNNTYIYSGMSQTSATFQL

SEQ ID NO: 55753 - protein, 124 aa, Homo sapiens
  Payload ID: 10974
  Gene Symbol: NAE1
  Gene Name: NEDD8 activating enzyme E1 subunit 1
  ENSP ID: ENSP00000464119
MEFLQELNSDVSGSFVEESPENLLDNDPSFFCRFTVVVATQLPESTSLRLADVLWNSQIPLLICRTYGLVGYMRIIIKEHPVIESHPDNALEDLRLDKPFPELREHFQSYDLDHMEKKDHSHTP

SEQ ID NO: 55754 - protein, 170 aa, Homo sapiens
  Payload ID: 10975
  Gene Symbol: NEDD8-MDP1
  Gene Name: NEDD8-MDP1 readthrough
  ENSP ID: ENSP00000431482
MLIKVKTLTGKEIEIDIEPTDKVERIKERVEEKEGIPPQQQRLIYSGKQIDGTVRDRRGQDVRLYPEVPEVLKRLQSLGVPGAAASRTSEIEGANQLLELFDLFRYFVHREIYPGSKITHFERLQQKTGIPFSQMIFFDDERRNIVDVSKLGVTCIHIQNGMNLQTLSQG

SEQ ID NO: 55755 - protein, 67 aa, Homo sapiens
  Payload ID: 10975
  Gene Symbol: NEDD8-MDP1
  Gene Name: NEDD8-MDP1 readthrough
  ENSP ID: ENSP00000432117
MLIKVKTLTGKEIEIDIEPTDKVERIKERVEEKEGIPPQQQRLIYSGKQILHSLAFLGRHARRPSVP

SEQ ID NO: 55756 - protein, 84 aa, Homo sapiens
  Payload ID: 10975
  Gene Symbol: NEDD8-MDP1
  Gene Name: NEDD8-MDP1 readthrough
  ENSP ID: ENSP00000474249
MLIKVKTLTGKEIEIDIEPTDKVERIKERVEEKEGIPPQQQRLIYSGKQMNDEKTAADYKILVMELYEIGGAKTSDCTQRCLRS

SEQ ID NO: 55757 - protein, 86 aa, Homo sapiens
  Payload ID: 10976
  Gene Symbol: NELFA
  Gene Name: negative elongation factor complex member A
  ENSP ID: ENSP00000330311
MASMRESDTGLWLHNKLGATDELWAPPSIASLLTAAVIDNIRLCFHGLSSAVKLKLLLGTLHLPRRTVDEWVSVKRLPCCHWSAST

SEQ ID NO: 55758 - protein, 539 aa, Homo sapiens
  Payload ID: 10976
  Gene Symbol: NELFA
  Gene Name: negative elongation factor complex member A
  ENSP ID: ENSP00000372335
MPGQRRALSPKMASMRESDTGLWLHNKLGATDELWAPPSIASLLTAAVIDNIRLCFHGLSSAVKLKLLLGTLHLPRRTVDEMKGALMEIIQLASLDSDPWVLMVADILKSFPDTGSLNLELEEQNPNVQDILGELREKVGECEASAMLPLECQYLNKNALTTLAGPLTPPVKHFQLKRKPKSATLRAELLQKSTETAQQLKRSAGVPFHAKGRGLLRKMDTTTPLKGIPKQAPFRSPTAPSVFSPTGNRTPIPPSRTLLRKERGVKLLDISELDMVGAGREAKRRRKTLDAEVVEKPAKEETVVENATPDYAAGLVSTQKLGSLNNEPALPSTSYLPSTPSVVPASSYIPSSETPPAPSSREASRPPEEPSAPSPTLPAQFKQRAPMYNSGLSPATPTPAAPTSPLTPTTPPAVAPTTQTPPVAMVAPQTQAPAQQQPKKNLSLTREQMFAAQEMFKTANKVTRPEKALILGFMAGSRENPCQEQGDVIQIKLSEHTEDLPKADGQGSTTMLVDTVFEMNYATGQWTRFKKYKPMTNVS

SEQ ID NO: 55759 - protein, 532 aa, Homo sapiens
  Payload ID: 10976
  Gene Symbol: NELFA
  Gene Name: negative elongation factor complex member A
  ENSP ID: ENSP00000387647
RKAWGWGFSPGVWTGQGAVVHPQRQPAQLSHTVSSPVGAWQRHRHAMAWLSAFPRGRGFMWPKQALVWMDLASQMKGALMEIIQLASLDSDPWVLMVADILKSFPDTGSLNLELEEQNPNVQDILGELREKVGECEASAMLPLECQYLNKNALTTLAGPLTPPVKHFQLKRKPKSATLRAELLQKSTETAQQLKRSAGVPFHAKGRGLLRKMDTTTPLKGIPKQAPFRSPTAPSVFSPTGNRTPIPPSRTLLRKERGVKLLDISELDMVGAGREAKRRRKTLDAEVVEKPAKEETVVENATPDYAAGLVSTQKLGSLNNEPALPSTSYLPSTPSVVPASSYIPSSETPPAPSSREASRPPEEPSAPSPTLPAQFKQRAPMYNSGLSPATPTPAAPTSPLTPTTPPAVAPTTQTPPVAMVAPQTQAPAQQQPKKNLSLTREQMFAAQEMFKTANKVTRPEKALILGFMAGSRENPCQEQGDVIQIKLSEHTEDLPKADGQGSTTMLVDTVFEMNYATGQWTRFKKYKPMTNVS

SEQ ID NO: 55760 - protein, 102 aa, Homo sapiens
  Payload ID: 10976
  Gene Symbol: NELFA
  Gene Name: negative elongation factor complex member A
  ENSP ID: ENSP00000387776
MASMRESDTGLWLHNKLGATDELWAPPSIASLLTAAVIDNIRLCFHGLSSAVKLKLLLGTLHLPRRTVDEGLALSTRLECSGTIVTHCSLDLLTSDLPISAS

SEQ ID NO: 55761 - protein, 294 aa, Homo sapiens
  Payload ID: 10976
  Gene Symbol: NELFA
  Gene Name: negative elongation factor complex member A
  ENSP ID: ENSP00000395761
MPGQRRALSPKMASMRESDTGLWLHNKLGATDELWAPPSIASLLTAAVIDNIRLCFHGLSSAVKLKLLLGTLHLPRRTVDEHPILQMKGALMEIIQLASLDSDPWVLMVADILKSFPDTGSLNLELEEQNPNVQDILGELREKVGECEASAMLPLECQYLNKNALTTLAGPLTPPVKHFQLKRKPKSATLRAELLQKSTETAQQLKRSAGVPFHAKGRGLLRKMDTTTPLKGIPKQAPFRSPTAPSVFSPTGNRTPIPPSRTLLRKERGVKLLDISELDMVGAGREAKRRRKTL

SEQ ID NO: 55762 - protein, 187 aa, Homo sapiens
  Payload ID: 10976
  Gene Symbol: NELFA
  Gene Name: negative elongation factor complex member A
  ENSP ID: ENSP00000396996
  MOD_RES (1)..(1): Any amino acid
XLCFHGLSSAVKLKLLLGTLHLPRRTVDETPAVRSALCPFYSFLHAVLRHSNKWMKGALMEIIQLASLDSDPWVLMVADILKSFPDTGSLNLELEEQNPNVQDILGELREKVGECEASAMLPLECQYLNKNALTTLAGPLTPPVKHFQLKRKPKSATLRAELLQKSTETAQQLKRSAGVPFHAKGRG

SEQ ID NO: 55763 - protein, 528 aa, Homo sapiens
  Payload ID: 10976
  Gene Symbol: NELFA
  Gene Name: negative elongation factor complex member A
  Uniprot ID: Q9H3P2
  ENSP ID: ENSP00000399165
MASMRESDTGLWLHNKLGATDELWAPPSIASLLTAAVIDNIRLCFHGLSSAVKLKLLLGTLHLPRRTVDEMKGALMEIIQLASLDSDPWVLMVADILKSFPDTGSLNLELEEQNPNVQDILGELREKVGECEASAMLPLECQYLNKNALTTLAGPLTPPVKHFQLKRKPKSATLRAELLQKSTETAQQLKRSAGVPFHAKGRGLLRKMDTTTPLKGIPKQAPFRSPTAPSVFSPTGNRTPIPPSRTLLRKERGVKLLDISELDMVGAGREAKRRRKTLDAEVVEKPAKEETVVENATPDYAAGLVSTQKLGSLNNEPALPSTSYLPSTPSVVPASSYIPSSETPPAPSSREASRPPEEPSAPSPTLPAQFKQRAPMYNSGLSPATPTPAAPTSPLTPTTPPAVAPTTQTPPVAMVAPQTQAPAQQQPKKNLSLTREQMFAAQEMFKTANKVTRPEKALILGFMAGSRENPCQEQGDVIQIKLSEHTEDLPKADGQGSTTMLVDTVFEMNYATGQWTRFKKYKPMTNVS

SEQ ID NO: 55764 - protein, 246 aa, Homo sapiens
  Payload ID: 10976
  Gene Symbol: NELFA
  Gene Name: negative elongation factor complex member A
  ENSP ID: ENSP00000405119
  MOD_RES (1)..(1): Any amino acid
XRSCLRSVPRAGRLRPVNSHVPACAFSPVGECEASAMLPLECQYLNKNALTTLAGPLTPPVKHFQLKRKPKSATLRAELLQKSTETAQQLKRSAGVPFHAKGRGLLRKMDTTTPLKGIPKQAPFRSPTAPSVFSPTGNRTPIPPSRTLLRKERGVKLLDISELDMVGAGREAKRRRKTLDAEVVEKPAKEETVVENATPDYAAGLVSTQKLGSLNNEPALPSTSYLPSTPSVVPASSYIPSSETPP

SEQ ID NO: 55765 - protein, 125 aa, Homo sapiens
  Payload ID: 10976
  Gene Symbol: NELFA
  Gene Name: negative elongation factor complex member A
  ENSP ID: ENSP00000406844
  MOD_RES (1)..(1): Any amino acid
XSDTGLWLHNKLGATDELWAPPSIASLLTAAVIDNIRLCFHGLSSAVKLKLLLGTLHLPRRTVDETPAVRSALCPFYSFLHAVLRHSNKWVCEGLALSTRLECSGTIVTHCSLDLLTSDLPISAS

SEQ ID NO: 55766 - protein, 208 aa, Homo sapiens
  Payload ID: 10976
  Gene Symbol: NELFA
  Gene Name: negative elongation factor complex member A
  ENSP ID: ENSP00000410154
MKGALMEIIQLASLDSDPWVLMVADILKSFPDTGSLNLELEEQNPNVQDILGELREKVGECEASAMLPLECQYLNKNALTTLAGPLTPPVKHFQLKRKPKSATLRAELLQKSTETAQQLKRSAGVPFHAKGRGLLRKMDTTTPLKGIPKQAPFRSPTAPSVFSPTGNRTPIPPSRTLLRKERGVKLLDISELDMVGAGREAKRRRKTL

SEQ ID NO: 55767 - protein, 65 aa, Homo sapiens
  Payload ID: 10976
  Gene Symbol: NELFA
  Gene Name: negative elongation factor complex member A
  ENSP ID: ENSP00000410963
IDNIRLCFHGLSSAVKLKLLLGTLHLPRRTVDEGLALSTRLECSGTIVTHCSLDLLTSDLPISAS

SEQ ID NO: 55768 - protein, 539 aa, Homo sapiens; identical to SEQ ID NO: 55758
  Payload ID: 10976
  Gene Symbol: NELFA
  Gene Name: negative elongation factor complex member A
  ENSP ID: ENSP00000445757

SEQ ID NO: 55769 - protein, 628 aa, Homo sapiens
  Payload ID: 10977
  Gene Symbol: NELFB
  Gene Name: negative elongation factor complex member B
  Uniprot ID: Q8WX92
  ENSP ID: ENSP00000339495
LAELEGAGERGSGGPRGPAERASGVSAAAPGERAGDGAPSRAVAGASAMFAGLQDLGVANGEDLKETLTNCTEPLKAIEQFQTENGVLLPSLQSALPFLDLHGTPRLEFHQSVFDELRDKLLERVSAIASEGKAEERYKKLEDLLEKSFSLVKMPSLQPVVMCVMKHLPKVPEKKLKLVMADKELYRACAVEVKRQIWQDNQALFGDEVSPLLKQYILEKESALFSTELSVLHNFFSPSPKTRRQGEVVQRLTRMVGKNVKLYDMVLQFLRTLFLRTRNVHYCTLRAELLMSLHDLDVGEICTVDPCHKFTWCLDACIRERFVDSKRARELQGFLDGVKKGQEQVLGDLSMILCDPFAINTLALSTVRHLQELVGQETLPRDSPDLLLLLRLLALGQGAWDMIDSQVFKEPKMEVELITRFLPMLMSFLVDDYTFNVDQKLPAEEKAPVSYPNTLPESFTKFLQEQRMACEVGLYYVLHITKQRNKNALLRLLPGLVETFGDLAFGDIFLHLLTGNLALLADEFALEDFCSSLFDGFFLTASPRKENVHRHALRLLIHLHPRVAPSKLEALQKALEPTGQSGEAVKELYSQLGEKLEQLDHRKPSPAQAAETPALELPLPSVPAPAPL

SEQ ID NO: 55770 - protein, 580 aa, Homo sapiens
  Payload ID: 10977
  Gene Symbol: NELFB
  Gene Name: negative elongation factor complex member B
  ENSP ID: ENSP00000489248
MFAGLQDLGVANGEDLKETLTNCTEPLKAIEQFQTENGVLLPSLQSALPFLDLHGTPRLEFHQSVFDELRDKLLERVSAIASEGKAEERYKKLEDLLEKSFSLVKMPSLQPVVMCVMKHLPKVPEKKLKLVMADKELYRACAVEVKRQIWQDNQALFGDEVSPLLKQYILEKESALFSTELSVLHNFFSPSPKTRRQGEVVQRLTRMVGKNVKLYDMVLQFLRTLFLRTRNVHYCTLRAELLMSLHDLDVGEICTVDPCHKFTWCLDACIRERFVDSKRARELQGFLDGVKKGQEQVLGDLSMILCDPFAINTLALSTVRHLQELVGQETLPRDSPDLLLLLRLLALGQGAWDMIDSQVFKEPKMEVELITRFLPMLMSFLVDDYTFNVDQKLPAEEKAPVSYPNTLPESFTKFLQEQRMACEVGLYYVLHITKQRNKNALLRLLPGLVETFGDLAFGDIFLHLLTGNLALLADEFALEDFCSSLFDGFFLTASPRKENVHRHALRLLIHLHPRVAPSKLEALQKALEPTGQSGEAVKELYSQLGEKLEQLDHRKPSPAQAAETPALELPLPSVPAPAPL

SEQ ID NO: 55771 - protein, 473 aa, Homo sapiens
  Payload ID: 10978
  Gene Symbol: NELFCD
  Gene Name: negative elongation factor complex member C/D
  Uniprot ID: Q8IXH7
  ENSP ID: ENSP00000342300
MAGAVPGAIMDEDYYGSAAEWGDEADGGQQEDDSGEGEDDAEVQQECLHKFSTRDYIMEPSIFNTLKRYFQAGGSPENVIQLLSENYTAVAQTVNLLAEWLIQTGVEPVQVQETVENHLKSLLIKHFDPRKADSIFTEEGETPAWLEQMIAHTTWRDLFYKLAEAHPDCLMLNFTVKLISDAGYQGEITSVSTACQQLEVFSRVLRTSLATILDGGEENLEKNLPEFAKMVCHGEHTYLFAQAMMSVLAQEEQGGSAVRRIAQEVQRFAQEKGHDASQITLALGTAASYPRACQALGAMLSKGALNPADITVLFKMFTSMDPPPVELIRVPAFLDLFMQSLFKPGARINQDHKHKYIHILAYAASVVETWKKNKRVSINKDELKSTSKAVETVHNLCCNENKGASELVAELSTLYQCIRFPVVAMGVLKWVDWTVSEPRYFQLQTDHTPVHLALLDEISTCTSSAPPGPAAAC

SEQ ID NO: 55772 - protein, 593 aa, Homo sapiens
  Payload ID: 10978
  Gene Symbol: NELFCD
  Gene Name: negative elongation factor complex member C/D
  ENSP ID: ENSP00000436783
  MOD_RES (1)..(1): Any amino acid
XEGMAGAVPGAIMDEDYYGSAAEWGDEADGGQQEDDSGEGEDDAEVQQECLHKFSTRDYIMEPSIFNTLKRYFQAGGSPENVIQLLSENYTAVAQTVNLLAEWLIQTGVEPVQVQETVENHLKSLLIKHFDPRKADSIFTEEGETPAWLEQMIAHTTWRDLFYKLAEAHPDCLMLNFTVKLISDAGYQGEITSVSTACQQLEVFSRVLRTSLATILDGGEENLEKNLPEFAKMVCHGEHTYLFAQAMMSVLAQEEQGGSAVRRIAQEVQRFAQEKGHDASQITLALGTAASYPRACQALGAMLSKGALNPADITVLFKMFTSMDPPPVELIRVPAFLDLFMQSLFKPGARINQDHKHKYIHILAYAASVVETWKKNKRVSINKDELKSTSKAVETVHNLCCNENKGASELVAELSTLYQCIRFPVVAMGVLKWVDWTVSEPRYFQLQTDHTPVHLALLDEISTCHQLLHPQVLQLLVKLFETEHSQLDVMEQLELKKTLLDRMVHLLSRGYVLPVVSYIRKCLEKLDTDISLIRYFVTEVLDVIAPPYTSDFVQLFLPILENDSIAGTIKTEGEHDPVTEFIAHCKSNFIMVN

SEQ ID NO: 55773 - protein, 599 aa, Homo sapiens
  Payload ID: 10978
  Gene Symbol: NELFCD
  Gene Name: negative elongation factor complex member C/D
  ENSP ID: ENSP00000473290
MRRARSREGMAGAVPGAIMDEDYYGSAAEWGDEADGGQQEDDSGEGEDDAEVQQECLHKFSTRDYIMEPSIFNTLKRYFQAGGSPENVIQLLSENYTAVAQTVNLLAEWLIQTGVEPVQVQETVENHLKSLLIKHFDPRKADSIFTEEGETPAWLEQMIAHTTWRDLFYKLAEAHPDCLMLNFTVKLISDAGYQGEITSVSTACQQLEVFSRVLRTSLATILDGGEENLEKNLPEFAKMVCHGEHTYLFAQAMMSVLAQEEQGGSAVRRIAQEVQRFAQEKGHDASQITLALGTAASYPRACQALGAMLSKGALNPADITVLFKMFTSMDPPPVELIRVPAFLDLFMQSLFKPGARINQDHKHKYIHILAYAASVVETWKKNKRVSINKDELKSTSKAVETVHNLCCNENKGASELVAELSTLYQCIRFPVVAMGVLKWVDWTVSEPRYFQLQTDHTPVHLALLDEISTCHQLLHPQVLQLLVKLFETEHSQLDVMEQLELKKTLLDRMVHLLSRGYVLPVVSYIRKCLEKLDTDISLIRYFVTEVLDVIAPPYTSDFVQLFLPILENDSIAGTIKTEGEHDPVTEFIAHCKSNFIMVN

SEQ ID NO: 55774 - protein, 387 aa, Homo sapiens
  Payload ID: 10979
  Gene Symbol: NELFE
  Gene Name: negative elongation factor complex member E
  Uniprot ID: P18615
  ENSP ID: ENSP00000364574
MVPKGATMLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLYVYGEDMTPTLLRGAFSPFGNIIDLSMDPPRNCAFVTYEKMESADQAVAELNGTQVESVQLKVNIARKQPMLDAATGKSVWGSLAVQNSPKGCHRDKRTQIVYSDDVYKENLVDGF

SEQ ID NO: 55775 - protein, 380 aa, Homo sapiens
  Payload ID: 10979
  Gene Symbol: NELFE
  Gene Name: negative elongation factor complex member E
  Uniprot ID: P18615
  ENSP ID: ENSP00000364578
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLYVYGEDMTPTLLRGAFSPFGNIIDLSMDPPRNCAFVTYEKMESADQAVAELNGTQVESVQLKVNIARKQPMLDAATGKSVWGSLAVQNSPKGCHRDKRTQIVYSDDVYKENLVDGF

SEQ ID NO: 55776 - protein, 380 aa, Homo sapiens; identical to SEQ ID NO: 55775
  Payload ID: 10979
  Gene Symbol: NELFE
  Gene Name: negative elongation factor complex member E
  Uniprot ID: P18615
  ENSP ID: ENSP00000372660

SEQ ID NO: 55777 - protein, 380 aa, Homo sapiens; identical to SEQ ID NO: 55775
  Payload ID: 10979
  Gene Symbol: NELFE
  Gene Name: negative elongation factor complex member E
  Uniprot ID: P18615
  ENSP ID: ENSP00000372834

SEQ ID NO: 55778 - protein, 350 aa, Homo sapiens
  Payload ID: 10979
  Gene Symbol: NELFE
  Gene Name: negative elongation factor complex member E
  Uniprot ID: P18615
  ENSP ID: ENSP00000388400
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLYVYGEDMTPTLLRGAFSPFGNIIDLSMDPPRNCAFVTYEKMESADQAVAELNGTQVESVQLKVNIARKQPMLDAATGKSVWGSLAVQNSPKGCHRDKRTQIVYSDDVYKENLVDGF

SEQ ID NO: 55779 - protein, 159 aa, Homo sapiens
  Payload ID: 10979
  Gene Symbol: NELFE
  Gene Name: negative elongation factor complex member E
  ENSP ID: ENSP00000390689
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAG

SEQ ID NO: 55780 - protein, 380 aa, Homo sapiens; identical to SEQ ID NO: 55775
  Payload ID: 10979
  Gene Symbol: NELFE
  Gene Name: negative elongation factor complex member E
  Uniprot ID: P18615
  ENSP ID: ENSP00000393005

SEQ ID NO: 55781 - protein, 333 aa, Homo sapiens
  Payload ID: 10979
  Gene Symbol: NELFE
  Gene Name: negative elongation factor complex member E
  ENSP ID: ENSP00000393103
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLYVYGEDMTPTLLRGAFSPFGNIIDLSMDPPRNCAFVTYEKMESADQAVAELNGTQVESVQLKVNIARKQPMLDA

SEQ ID NO: 55782 - protein, 240 aa, Homo sapiens
  Payload ID: 10979
  Gene Symbol: NELFE
  Gene Name: negative elongation factor complex member E
  ENSP ID: ENSP00000393793
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGP

SEQ ID NO: 55783 - protein, 293 aa, Homo sapiens
  Payload ID: 10979
  Gene Symbol: NELFE
  Gene Name: negative elongation factor complex member E
  ENSP ID: ENSP00000393794
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESFVSSSDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLYVYGEDMTPTLLRGAFSPFGNIIDLSMDP

SEQ ID NO: 55784 - protein, 159 aa, Homo sapiens; identical to SEQ ID NO: 55779
  Payload ID: 10979
  Gene Symbol: NELFE
  Gene Name: negative elongation factor complex member E
  ENSP ID: ENSP00000394340

SEQ ID NO: 55785 - protein, 380 aa, Homo sapiens; identical to SEQ ID NO: 55775
  Payload ID: 10979
  Gene Symbol: NELFE
  Gene Name: negative elongation factor complex member E
  Uniprot ID: P18615
  ENSP ID: ENSP00000394879

SEQ ID NO: 55786 - protein, 240 aa, Homo sapiens; identical to SEQ ID NO: 55782
  Payload ID: 10979
  Gene Symbol: NELFE
  Gene Name: negative elongation factor complex member E
  ENSP ID: ENSP00000395175

SEQ ID NO: 55787 - protein, 240 aa, Homo sapiens; identical to SEQ ID NO: 55782
  Payload ID: 10979
  Gene Symbol: NELFE
  Gene Name: negative elongation factor complex member E
  ENSP ID: ENSP00000396604

SEQ ID NO: 55788 - protein, 240 aa, Homo sapiens; identical to SEQ ID NO: 55782
  Payload ID: 10979
  Gene Symbol: NELFE
  Gene Name: negative elongation factor complex member E
  ENSP ID: ENSP00000396971

SEQ ID NO: 55789 - protein, 293 aa, Homo sapiens; identical to SEQ ID NO: 55783
  Payload ID: 10979
  Gene Symbol: NELFE
  Gene Name: negative elongation factor complex member E
  ENSP ID: ENSP00000397565

SEQ ID NO: 55790 - protein, 333 aa, Homo sapiens; identical to SEQ ID NO: 55781
  Payload ID: 10979
  Gene Symbol: NELFE
  Gene Name: negative elongation factor complex member E
  ENSP ID: ENSP00000397914

SEQ ID NO: 55791 - protein, 159 aa, Homo sapiens; identical to SEQ ID NO: 55779
  Payload ID: 10979
  Gene Symbol: NELFE
  Gene Name: negative elongation factor complex member E
  ENSP ID: ENSP00000401342

SEQ ID NO: 55792 - protein, 333 aa, Homo sapiens; identical to SEQ ID NO: 55781
  Payload ID: 10979
  Gene Symbol: NELFE
  Gene Name: negative elongation factor complex member E
  ENSP ID: ENSP00000401745

SEQ ID NO: 55793 - protein, 380 aa, Homo sapiens; identical to SEQ ID NO: 55775
  Payload ID: 10979
  Gene Symbol: NELFE
  Gene Name: negative elongation factor complex member E
  Uniprot ID: P18615
  ENSP ID: ENSP00000403623

SEQ ID NO: 55794 - protein, 333 aa, Homo sapiens; identical to SEQ ID NO: 55781
  Payload ID: 10979
  Gene Symbol: NELFE
  Gene Name: negative elongation factor complex member E
  ENSP ID: ENSP00000403630

SEQ ID NO: 55795 - protein, 333 aa, Homo sapiens; identical to SEQ ID NO: 55781
  Payload ID: 10979
  Gene Symbol: NELFE
  Gene Name: negative elongation factor complex member E
  ENSP ID: ENSP00000407528

SEQ ID NO: 55796 - protein, 293 aa, Homo sapiens; identical to SEQ ID NO: 55783
  Payload ID: 10979
  Gene Symbol: NELFE
  Gene Name: negative elongation factor complex member E
  ENSP ID: ENSP00000407630

SEQ ID NO: 55797 - protein, 159 aa, Homo sapiens; identical to SEQ ID NO: 55779
  Payload ID: 10979
  Gene Symbol: NELFE
  Gene Name: negative elongation factor complex member E
  ENSP ID: ENSP00000409139

SEQ ID NO: 55798 - protein, 293 aa, Homo sapiens; identical to SEQ ID NO: 55783
  Payload ID: 10979
  Gene Symbol: NELFE
  Gene Name: negative elongation factor complex member E
  ENSP ID: ENSP00000409269

SEQ ID NO: 55799 - protein, 293 aa, Homo sapiens; identical to SEQ ID NO: 55783
  Payload ID: 10979
  Gene Symbol: NELFE
  Gene Name: negative elongation factor complex member E
  ENSP ID: ENSP00000409389

SEQ ID NO: 55800 - protein, 293 aa, Homo sapiens; identical to SEQ ID NO: 55783
  Payload ID: 10979
  Gene Symbol: NELFE
  Gene Name: negative elongation factor complex member E
  ENSP ID: ENSP00000410872

SEQ ID NO: 55801 - protein, 159 aa, Homo sapiens; identical to SEQ ID NO: 55779
  Payload ID: 10979
  Gene Symbol: NELFE
  Gene Name: negative elongation factor complex member E
  ENSP ID: ENSP00000411487

SEQ ID NO: 55802 - protein, 240 aa, Homo sapiens; identical to SEQ ID NO: 55782
  Payload ID: 10979
  Gene Symbol: NELFE
  Gene Name: negative elongation factor complex member E
  ENSP ID: ENSP00000411724

SEQ ID NO: 55803 - protein, 159 aa, Homo sapiens; identical to SEQ ID NO: 55779
  Payload ID: 10979
  Gene Symbol: NELFE
  Gene Name: negative elongation factor complex member E
  ENSP ID: ENSP00000414014

SEQ ID NO: 55804 - protein, 260 aa, Homo sapiens
  Payload ID: 10979
  Gene Symbol: NELFE
  Gene Name: negative elongation factor complex member E
  ENSP ID: ENSP00000414029
MLVIPPGLSEEEEALQKKFNKLKKKKKALLALKKQSSSSTTSQGGVKRSLSEQPVMDTATATEQAKQLVKSGAISAIKAETKNSGFKRSRTLEGKLKDPEKGPVPTFQPFQRSISADDDLQESSRRPQRKSLYESDRLRELGPDGEEAEGPGAGDGPPRSFDWGYEERSGAHSSASPPRSRSRDRSHERNRDRDRDRERDRDRDRDRDRERDRDRDRDRDRDRERDRDRERDRDRDREGPFRRSDSFPERRAPRKGNTLY

SEQ ID NO: 55805 - protein, 333 aa, Homo sapiens; identical to SEQ ID NO: 55781
  Payload ID: 10979
  Gene Symbol: NELFE
  Gene Name: negative elongation factor complex member E
  ENSP ID: ENSP00000415567

SEQ ID NO: 55806 - protein, 57 aa, Homo sapiens
  Payload ID: 10979
  Gene Symbol: NELFE
  Gene Name: negative elongation factor complex member E
  ENSP ID: ENSP00000419183
MLVIPPGLSEEEEALQKKFNKLKKKVRDCVWTWPNLSQTLHSEKIWEKGIAGSEEAK

SEQ ID NO: 55807 - protein, 36 aa, Homo sapiens
  Payload ID: 10979
  Gene Symbol: NELFE
  Gene Name: negative elongation factor complex member E
  ENSP ID: ENSP00000420205
MLVIPPGLSEEEEALQKKFNKLKKKTVSFLRVGTMH

SEQ ID NO: 55808 - protein, 36 aa, Homo sapiens; identical to SEQ ID NO: 55807
  Payload ID: 10979
  Gene Symbol: NELFE
  Gene Name: negative elongation factor complex member E
  ENSP ID: ENSP00000486074

SEQ ID NO: 55809 - protein, 36 aa, Homo sapiens; identical to SEQ ID NO: 55807
  Payload ID: 10979
  Gene Symbol: NELFE
  Gene Name: negative elongation factor complex member E
  ENSP ID: ENSP00000486432

SEQ ID NO: 55810 - protein, 36 aa, Homo sapiens; identical to SEQ ID NO: 55807
  Payload ID: 10979
  Gene Symbol: NELFE
  Gene Name: negative elongation factor complex member E
  ENSP ID: ENSP00000486647

SEQ ID NO: 55811 - protein, 36 aa, Homo sapiens; identical to SEQ ID NO: 55807
  Payload ID: 10979
  Gene Symbol: NELFE
  Gene Name: negative elongation factor complex member E
  ENSP ID: ENSP00000486884

SEQ ID NO: 55812 - protein, 36 aa, Homo sapiens; identical to SEQ ID NO: 55807
  Payload ID: 10979
  Gene Symbol: NELFE
  Gene Name: negative elongation factor complex member E
  ENSP ID: ENSP00000487225

SEQ ID NO: 55813 - protein, 36 aa, Homo sapiens; identical to SEQ ID NO: 55807
  Payload ID: 10979
  Gene Symbol: NELFE
  Gene Name: negative elongation factor complex member E
  ENSP ID: ENSP00000487402

SEQ ID NO: 55814 - protein, 692 aa, Homo sapiens
  Payload ID: 10980
  Gene Symbol: NRROS
  Gene Name: negative regulator of reactive oxygen species
  Uniprot ID: Q86YC3
  ENSP ID: ENSP00000328625
MELLPLWLCLGFHFLTVGWRNRSGTATAASQGVCKLVGGAADCRGQSLASVPSSLPPHARMLTLDANPLKTLWNHSLQPYPLLESLSLHSCHLERISRGAFQEQGHLRSLVLGDNCLSENYEETAAALHALPGLRRLDLSGNALTEDMAALMLQNLSSLRSVSLAGNTIMRLDDSVFEGLERLRELDLQRNYIFEIEGGAFDGLAELRHLNLAFNNLPCIVDFGLTRLRVLNVSYNVLEWFLATGGEAAFELETLDLSHNQLLFFPLLPQYSKLRTLLLRDNNMGFYRDLYNTSSPREMVAQFLLVDGNVTNITTVSLWEEFSSSDLADLRFLDMSQNQFQYLPDGFLRKMPSLSHLNLHQNCLMTLHIREHEPPGALTELDLSHNQLSELHLAPGLASCLGSLRLFNLSSNQLLGVPPGLFANARNITTLDMSHNQISLCPLPAASDRVGPPSCVDFRNMASLRSLSLEGCGLGALPDCPFQGTSLTYLDLSSNWGVLNGSLAPLQDVAPMLQVLSLRNMGLHSSFMALDFSGFGNLRDLDLSGNCLTTFPRFGGSLALETLDLRRNSLTALPQKAVSEQLSRGLRTIYLSQNPYDCCGVDGWGALQHGQTVADWAMVTCNLSSKIIRVTELPGGVPRDCKWERLDLGLLYLVLILPSCLTLLVACTVIVLTFKKPLLQVIKSRCHWSSVY

SEQ ID NO: 55815 - protein, 625 aa, Homo sapiens
  Payload ID: 10981
  Gene Symbol: NUB1
  Gene Name: negative regulator of ubiquitin-like proteins 1
  ENSP ID: ENSP00000398644
MKTNGGRCRIRALCWSRREWRGAGMAQKKYLQAKLTQFLREDRIQLWKPPYTDENKKVGLALKDLAKQYSDRLECCENEVEKVIEEIRCKAIERGTGNDNYRTTGIATIEVFLPPRLKKDRKNLLETRLHITGRELRSKIAETFGLQENYIKIVINKKQLQLGKTLEEQGVAHNVKAMVLELKQSEEDARKNFQLEEEEQNEAKLKEKQIQRTKRGLEILAKRAAETVVDPEMTPYLDIANQTGRSIRIPPSERKALMLAMGYHEKGRAFLKRKEYGIALPCLLDADKYFCECCRELLDTVDNYAVLQLDIVWCYFRLEQLECLDDAEKKLNLAQKCFKNCYGENHQRLVHIKGNCGKEKVLFLRLYLLQGIRNYHSGNDVEAYEYLNKARQLFKELYIDPSKVDNLLQLGFTAQEARLGLRACDGNVDHAATHITNRREELAQIRKEEKEKKRRRLENIRFLKGMGYSTHAAQQILLSNPQMWWLNDSNPETDNRQESPSQENIDRLVYMGFDALVAEAALRVFRGNVQLAAQTLAHNGGSLPPELPLSPEDSLSPPATSPSDSAGTSSASTDEDMETEAVNEILEDIPEHEEDYLDSTLEDEEIIIAEYLSYVENRKSATKKN

SEQ ID NO: 55816 - protein, 154 aa, Homo sapiens
  Payload ID: 10981
  Gene Symbol: NUB1
  Gene Name: negative regulator of ubiquitin-like proteins 1
  ENSP ID: ENSP00000418234
MAQKKYLQAKLTQFLREDRIQLWKPPYTDENKKVGLALKDLAKQYSDRLECCENEVEKVIEEIRCKAIERGTGNDNYRTTGIATIEVFLPPRLKKDRKNLLETRLHITGRELRSKIAETFGLQENYIKIVINKKQLQLGKTLEEQGVAHNVKAM

SEQ ID NO: 55817 - protein, 128 aa, Homo sapiens
  Payload ID: 10981
  Gene Symbol: NUB1
  Gene Name: negative regulator of ubiquitin-like proteins 1
  ENSP ID: ENSP00000419679
  MOD_RES (1)..(1): Any amino acid
XRACDGNVDHAATHITNRREELAQIRKEEKEKKRRRLENIRFLKGMGYSTHAAQQVLHAASGNLDEALKVAAPSGPLALSLSSGSCPELPPWLSSILPGSLLWAAPSSGSEGQVSPGLQPRHRLREAT

SEQ ID NO: 55818 - protein, 149 aa, Homo sapiens
  Payload ID: 10981
  Gene Symbol: NUB1
  Gene Name: negative regulator of ubiquitin-like proteins 1
  ENSP ID: ENSP00000420023
MAQKKYLQAKLTQFLREDRIQLWKPPYTDENKKVGLALKDLAKQYSDRLECCENEVEKVIEEIRCKAIERGTGNDNYRTTGIATIEVFLPPRLKKDRKNLLETRLHITGRELRSKAVRGGFRKWHATHMRRRPCGSAPAMGFSRETTEE

SEQ ID NO: 55819 - protein, 254 aa, Homo sapiens
  Payload ID: 10981
  Gene Symbol: NUB1
  Gene Name: negative regulator of ubiquitin-like proteins 1
  ENSP ID: ENSP00000420086
MAQKKYLQAKLTQFLREDRIQLWKPPYTDENKKVGLALKDLAKQYSDRLECCENEVEKVIEEIRCKAIERGTGNDNYRTTGIATIEVFLPPRLKKDRKNLLETRLHITGRELRSKIAETFGLQENYIKIVINKKQLQLGKTLEEQGVAHNVKAMVLELKQSEEDARKNFQLEEEEQNEAKLKEKQIQRTKRGLEILAKRAAETVVDPEMTPYLDIANQTGRSIRIPPSERKALMLAMGYHEKGRAFLKRKEYGI

SEQ ID NO: 55820 - protein, 202 aa, Homo sapiens
  Payload ID: 10981
  Gene Symbol: NUB1
  Gene Name: negative regulator of ubiquitin-like proteins 1
  ENSP ID: ENSP00000420344
  MOD_RES (1)..(1): Any amino acid
XARQLFKELYIDPSKVDNLLQLGFTAQEARLGLRACDGNVDHAATHITNRREILLSNPQMWWLNDSNPETDNRQESPSQENIDRLVYMGFDALVAEAALRVFRGNVQLAAQTLAHNGGSLPPELPLSPEDSLSPPATSPSDSAGTSSASTDEDMETEAVNEILEDIPEHEEDYLDSTLEDEEIIIAEYLSYVENRKSATKKN

SEQ ID NO: 55821 - protein, 267 aa, Homo sapiens
  Payload ID: 10981
  Gene Symbol: NUB1
  Gene Name: negative regulator of ubiquitin-like proteins 1
  ENSP ID: ENSP00000420638
MAQKKYLQAKLTQFLREDRIQLWKPPYTDENKKVGLALKDLAKQYSDRLECCENEVEKVIEEIRCKAIERGTGNDNYRTTGIATIEVFLPPRLKKDRKNLLETRLHITGRELRSKIAETFGLQENYIKIVINKKQLQLGKTLEEQGVAHNVKAMVLELKQSEEDARKNFQLEEEEQNEAKLKEKQIQRTKRGLEILAKRAAETVVDPEMTPYLDIANQTGRSIRIPPSERKALMLAMGYHEKGRAFLKRKEYGIALPCLLDADKYFW

SEQ ID NO: 55822 - protein, 639 aa, Homo sapiens
  Payload ID: 10981
  Gene Symbol: NUB1
  Gene Name: negative regulator of ubiquitin-like proteins 1
  ENSP ID: ENSP00000454264
MKTNGGRCRIRALCWSRREWRGAGMAQKKYLQAKLTQFLREDRIQLWKPPYTDENKKVGLALKDLAKQYSDRLECCENEVEKVIEEIRCKAIERGTGNDNYRTTGIATIEVFLPPRLKKDRKNLLETRLHITGRELRSKIAETFGLQENYIKIVINKKQLQLGKTLEEQGVAHNVKAMVLELKQSEEDARKNFQLEEEEQNEAKLKEKQIQRTKRGLEILAKRAAETVVDPEMTPYLDIANQTGRSIRIPPSERKALMLAMGYHEKGRAFLKRKEYGIALPCLLDADKYFCECCRELLDTVDNYAVLQLDIVWCYFRLEQLECLDDAEKKLNLAQKCFKNCYGENHQRLVHIKGNCGKEKVLFLRLYLLQGIRNYHSGNDVEAYEYLNKARQLFKELYIDPSKVDNLLQLGFTAQEARLGLRACDGNVDHAATHITNRREELAQIRKEEKEKKRRRLENIRFLKGMGYSTHAAQQVLHAASGNLDEALKILLSNPQMWWLNDSNPETDNRQESPSQENIDRLVYMGFDALVAEAALRVFRGNVQLAAQTLAHNGGSLPPELPLSPEDSLSPPATSPSDSAGTSSASTDEDMETEAVNEILEDIPEHEEDYLDSTLEDEEIIIAEYLSYVENRKSATKKN

SEQ ID NO: 55823 - protein, 966 aa, Homo sapiens
  Payload ID: 10982
  Gene Symbol: NBR1
  Gene Name: neighbor of BRCA1 gene 1
  Uniprot ID: Q14596
  ENSP ID: ENSP00000343479
MEPQVTLNVTFKNEIQSFLVSDPENTTWADIEAMVKVSFDLNTIQIKYLDEENEEVSINSQGEYEEALKMAVKQGNQLQMQVHEGHHVVDEAPPPVVGAKRLAARAGKKPLAHYSSLVRVLGSDMKTPEDPAVQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRAEKKQRKAEVKELKKQLKLHRKIHLWNSIHGLQSPKSPLGRPESLLQSNTLMLPLQPCTSVMPMLSAAFVDENLPDGTHLQPGTKFIKHWRMKNTGNVKWSADTKLKFMWGNLTLASTEKKDVLVPCLKAGHVGVVSVEFIAPALEGTYTSHWRLSHKGQQFGPRVWCSIIVDPFPSEESPDNIEKGMISSSKTDDLTCQQEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPLGDSMYSSALSQPGLERGAEGKPGVEAGQEPAEAGERLPGGENQPQEHSISDILTTSQTLETVPLIPEVVELPPSLPRSSPCVHHHGSPGVDLPVTIPEVSSVPDQIRGEPRGSSGLVNSRQKSYDHSRHHHGSSIAGGLVKGALSVAASAYKALFAGPPVTAQPIISEDQTAALMAHLFEMGFCDRQLNLRLLKKHNYNILQVVTELLQLNNNDWYSQRY

SEQ ID NO: 55824 - protein, 837 aa, Homo sapiens
  Payload ID: 10982
  Gene Symbol: NBR1
  Gene Name: neighbor of BRCA1 gene 1
  ENSP ID: ENSP00000437545
MEPQVTLNVTFKNEIQSFLVSDPENTTWADIEAMVSINSQGEYEEALKMAVKQGNQLQMQVHEGHHVVDEAPPPVVGAKRLAARAGKKPLAHYSSLVRVLGSDMKTPEDPAVQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRAEKKQRKAEVKELKKQLKLHRKIHLWNSIHGLQSPKSPLGRPESLLQSNTLMLPLQPCTSVMPMLSAAFVDENLPDGTHLQPGTKFIKHWRMKNTGNVKWSADTKLKFMWGNLTLASTEKKDVLVPCLKAGHVGVVSVEFIAPALEGTYTSHWRLSHKGQQFGPRVWCSIIVDPFPSEESPDNIEKGMISSSKTDDLTCQQEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPLGDSMYSSALSQPGLERGAEGKPGVEAGQEPAEAGERLPGGENQPQEHSISDILTTSQTLETVPLIPEVVELPPSLPRSSPCVHHHGSPGVDLPVTIPEVSSVPDQIRGANNF

SEQ ID NO: 55825 - protein, 42 aa, Homo sapiens
  Payload ID: 10982
  Gene Symbol: NBR1
  Gene Name: neighbor of BRCA1 gene 1
  ENSP ID: ENSP00000466071
MEPQVTLNVTFKNEIQSFLVSDPENTTWADIEAMVKVSFDLN

SEQ ID NO: 55826 - protein, 966 aa, Homo sapiens; identical to SEQ ID NO: 55823
  Payload ID: 10982
  Gene Symbol: NBR1
  Gene Name: neighbor of BRCA1 gene 1
  Uniprot ID: Q14596
  ENSP ID: ENSP00000466667

SEQ ID NO: 55827 - protein, 937 aa, Homo sapiens
  Payload ID: 10982
  Gene Symbol: NBR1
  Gene Name: neighbor of BRCA1 gene 1
  Uniprot ID: Q14596
  ENSP ID: ENSP00000467816
MEPQVTLNVTFKNEIQSFLVSDPENTTWADIEAMVKVSFDLNTIQIKYLDEENEEVSINSQGEYEEALKMAVKQGNQLQMQVHEGHHVVDEAPPPVVGAKRLAARAGKKPLAHYSSLVRVLGSDMKTPEDPAVQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRAEKKQRKAEVKELKKQLKLHRKIHLWNSIHGLQSPKSPLGRPESLLQSNTLMLPLQPCTSVMPMLSAAFVDENLPDGTHLQPGTKFIKHWRMKNTGNVKWSADTKLKFMWGNLTLASTEKKDVLVPCLKAGHVGVVSVEFIAPALEGTYTSHWRLSHKGQQFGPRVWCSIIVDPFPSEESPDNIEKGMISSSKTDDLTCQQEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPLGDSMYSSALSQPGLERGAEGKPGVEAGQEPAEAGERLPGGENQPQEHSISDILTTSQTLETVPLIPEVVELPPSLPRSSPCVHHHGSPGVDLPVTIPEVSSVPDQIRGEPRGSSGLVNSRQKSYDHSRHHHGSSIAGGLVKGALSVAASAYKALFAGPPVTAQGLWGLLSFLHLAKKCFFLKAPSEAFSWF

SEQ ID NO: 55828 - protein, 390 aa, Homo sapiens
  Payload ID: 10983
  Gene Symbol: NEIL1
  Gene Name: nei-like DNA glycosylase 1
  Uniprot ID: Q96FI4
  ENSP ID: ENSP00000347170
MPEGPELHLASQFVNEACRALVFGGCVEKSSVSRNPEVPFESSAYRISASARGKELRLILSPLPGAQPQQEPLALVFRFGMSGSFQLVPREELPRHAHLRFYTAPPGPRLALCFVDIRRFGRWDLGGKWQPGRGPCVLQEYQQFRENVLRNLADKAFDRPICEALLDQRFFNGIGNYLRAEILYRLKIPPFEKARSVLEALQQHRPSPELTLSQKIRTKLQNPDLLELCHSVPKEVVQLGGKGYGSESGEEDFAAFRAWLRCYGMPGMSSLQDRHGRTIWFQGDPGPLAPKGRKSRKKKSKATQLSPEDRVEDALPPSKAPSRTRRAKRDLPKRTATQRPEGTSLQQDPEAPTVPKKGRRKGRQAASGHCRPRKVKADIPSLEPEGTSAS

SEQ ID NO: 55829 - protein, 154 aa, Homo sapiens
  Payload ID: 10983
  Gene Symbol: NEIL1
  Gene Name: nei-like DNA glycosylase 1
  ENSP ID: ENSP00000454292
MPEGPELHLASQFVNEACRALVFGGCVEKSSVSRNPEVPFESSAYRISASARGKELRLILSPLPGAQPQQEPLALVFRFGMSGSFQLVPREELPRHAHLRFYTAPPGPRLALCFVDIRRFGRWDLGGKWQPGRGPCVLQEYQQFRNRFSEPLSP

SEQ ID NO: 55830 - protein, 39 aa, Homo sapiens
  Payload ID: 10983
  Gene Symbol: NEIL1
  Gene Name: nei-like DNA glycosylase 1
  ENSP ID: ENSP00000454729
MPEGPELHLASQFVNEACRALVFGGCVEKSSVSRNPEVP

SEQ ID NO: 55831 - protein, 390 aa, Homo sapiens; identical to SEQ ID NO: 55828
  Payload ID: 10983
  Gene Symbol: NEIL1
  Gene Name: nei-like DNA glycosylase 1
  Uniprot ID: Q96FI4
  ENSP ID: ENSP00000455730

SEQ ID NO: 55832 - protein, 88 aa, Homo sapiens
  Payload ID: 10983
  Gene Symbol: NEIL1
  Gene Name: nei-like DNA glycosylase 1
  ENSP ID: ENSP00000455745
MPEGPELHLASQFVNEACRALVFGGCVEKSSVSRNPEVPFESSAYRISASARGKELRLILSPLPGAQPQQEPLALVFRFGMSGSFQLV

SEQ ID NO: 55833 - protein, 184 aa, Homo sapiens
  Payload ID: 10983
  Gene Symbol: NEIL1
  Gene Name: nei-like DNA glycosylase 1
  ENSP ID: ENSP00000455949
MPEGPELHLASQFVNEACRALVFGGCVEKSSVSRNPEVPFESSAYRISASARGKELRLILSPLPGAQPQQEPLALVFRFGMSGSFQLVPREELPRHAHLRFYTAPPGPRLALCFVDIRRFGRWDLGGKWQPGRGPCVLQEYQQFRENVLRNLADKAFDRPICEALLDQRFFNGIGNYLRAEILY

SEQ ID NO: 55834 - protein, 22 aa, Homo sapiens
  Payload ID: 10983
  Gene Symbol: NEIL1
  Gene Name: nei-like DNA glycosylase 1
  ENSP ID: ENSP00000456466
MPEGPELHLASQFVNEACRALV

SEQ ID NO: 55835 - protein, 132 aa, Homo sapiens
  Payload ID: 10983
  Gene Symbol: NEIL1
  Gene Name: nei-like DNA glycosylase 1
  ENSP ID: ENSP00000456852
MPEGPELHLASQFVNEACRALVFGGCVEKSSVSRNPEVPFESSAYRISASARGKELRLILSPLPGAQPQQEPLALVFRFGMSGSFQLVPREELPRHAHLRFYTAPPGPRLALCFVDIRRFGRWDLGGKWQPG

SEQ ID NO: 55836 - protein, 152 aa, Homo sapiens
  Payload ID: 10983
  Gene Symbol: NEIL1
  Gene Name: nei-like DNA glycosylase 1
  ENSP ID: ENSP00000456945
MPEGPELHLASQFVNEACRALVFGGCVEKSSVSRNPEVPFESSAYRISASARGKELRLILSPLPGAQPQQEPLALVFRFGMSGSFQLVPREELPRHAHLRFYTAPPGPRLALCFVDIRRFGRWDLGGKWQPGRGPCVLQEYQQFRVSLCCLG

SEQ ID NO: 55837 - protein, 199 aa, Homo sapiens
  Payload ID: 10983
  Gene Symbol: NEIL1
  Gene Name: nei-like DNA glycosylase 1
  ENSP ID: ENSP00000457056
MPEGPELHLASQFVNEACRALVFGGCVEKSSVSRNPEVPFESSAYRISASARGKELRLILSPLPGAQPQQEPLALVFRFGMSGSFQLVPREELPRHAHLRFYTAPPGPRLALCFVDIRRFGRWDLGGKWQPGRGPCVLQEYQQFRLKIPPFEKARSVLEALQQHRPSPELTLSQKIRTKLQNPDLLELCHSVPKEVVQL

SEQ ID NO: 55838 - protein, 50 aa, Homo sapiens
  Payload ID: 10983
  Gene Symbol: NEIL1
  Gene Name: nei-like DNA glycosylase 1
  ENSP ID: ENSP00000457081
MPEGPELHLASQFVNEACRALVFGGCVEKSSVSRNPEVPFESSAYRISAS

SEQ ID NO: 55839 - protein, 390 aa, Homo sapiens; identical to SEQ ID NO: 55828
  Payload ID: 10983
  Gene Symbol: NEIL1
  Gene Name: nei-like DNA glycosylase 1
  Uniprot ID: Q96FI4
  ENSP ID: ENSP00000457352

SEQ ID NO: 55840 - protein, 82 aa, Homo sapiens
  Payload ID: 10983
  Gene Symbol: NEIL1
  Gene Name: nei-like DNA glycosylase 1
  ENSP ID: ENSP00000457371
MPEGPELHLASQFVNEACRALVFGGCVEKSSVSRNPEVPFESSAYRISASARGKELRLILSPLPGAQPQQEPLALVFRFGMS

SEQ ID NO: 55841 - protein, 64 aa, Homo sapiens
  Payload ID: 10983
  Gene Symbol: NEIL1
  Gene Name: nei-like DNA glycosylase 1
  ENSP ID: ENSP00000457541
MPEGPELHLASQFVNEACRALVFGGCVEKSSVSRNPEVPFESSAYRISASARGKELRLILSPLP

SEQ ID NO: 55842 - protein, 332 aa, Homo sapiens
  Payload ID: 10984
  Gene Symbol: NEIL2
  Gene Name: nei-like DNA glycosylase 2
  Uniprot ID: Q969S2
  ENSP ID: ENSP00000284503
MPEGPLVRKFHHLVSPFVGQQVVKTGGSSKKLQPASLQSLWLQDTQVHGKKLFLRFDLDEEMGPPGSSPTPEPPQKEVQKEGAADPKQVGEPSGQKTLDGSSRSAELVPQGEDDSEYLERDAPAGDAGRWLRVSFGLFGSVWVNDFSRAKKANKRGDWRDPSPRLVLHFGGGGFLAFYNCQLSWSSSPVVTPTCDILSEKFHRGQALEALGQAQPVCYTLLDQRYFSGLGNIIKNEALYRAGIHPLSLGSVLSASRREVLVDHVVEFSTAWLQGKFQGRPQHTQVYQKEQCPAGHQVMKEAFGPEDGLQRLTWWCPQCQPQLSEEPEQCQFS

SEQ ID NO: 55843 - protein, 271 aa, Homo sapiens
  Payload ID: 10984
  Gene Symbol: NEIL2
  Gene Name: nei-like DNA glycosylase 2
  Uniprot ID: Q969S2
  ENSP ID: ENSP00000384070
MGPPGSSPTPEPPQKEVQKEGAADPKQVGEPSGQKTLDGSSRSAELVPQGEDDSEYLERDAPAGDAGRWLRVSFGLFGSVWVNDFSRAKKANKRGDWRDPSPRLVLHFGGGGFLAFYNCQLSWSSSPVVTPTCDILSEKFHRGQALEALGQAQPVCYTLLDQRYFSGLGNIIKNEALYRAGIHPLSLGSVLSASRREVLVDHVVEFSTAWLQGKFQGRPQHTQVYQKEQCPAGHQVMKEAFGPEDGLQRLTWWCPQCQPQLSEEPEQCQFS

SEQ ID NO: 55844 - protein, 332 aa, Homo sapiens; identical to SEQ ID NO: 55842
  Payload ID: 10984
  Gene Symbol: NEIL2
  Gene Name: nei-like DNA glycosylase 2
  Uniprot ID: Q969S2
  ENSP ID: ENSP00000394023

SEQ ID NO: 55845 - protein, 332 aa, Homo sapiens; identical to SEQ ID NO: 55842
  Payload ID: 10984
  Gene Symbol: NEIL2
  Gene Name: nei-like DNA glycosylase 2
  Uniprot ID: Q969S2
  ENSP ID: ENSP00000397538

SEQ ID NO: 55846 - protein, 216 aa, Homo sapiens
  Payload ID: 10984
  Gene Symbol: NEIL2
  Gene Name: nei-like DNA glycosylase 2
  Uniprot ID: Q969S2
  ENSP ID: ENSP00000435657
MPEGPLVRKFHHLVSPFVGQQVVKTGGSSKKLQPASLQSLWLQDTQVRLVLHFGGGGFLAFYNCQLSWSSSPVVTPTCDILSEKFHRGQALEALGQAQPVCYTLLDQRYFSGLGNIIKNEALYRAGIHPLSLGSVLSASRREVLVDHVVEFSTAWLQGKFQGRPQHTQVYQKEQCPAGHQVMKEAFGPEDGLQRLTWWCPQCQPQLSEEPEQCQFS

SEQ ID NO: 55847 - protein, 60 aa, Homo sapiens
  Payload ID: 10984
  Gene Symbol: NEIL2
  Gene Name: nei-like DNA glycosylase 2
  ENSP ID: ENSP00000437004
MPEGPLVRKFHHLVSPFVGQQVVKTGGSSKKLQPASLQSLWLQDTQVGPALWWWWLPGIL

SEQ ID NO: 55848 - protein, 605 aa, Homo sapiens
  Payload ID: 10985
  Gene Symbol: NEIL3
  Gene Name: nei-like DNA glycosylase 3
  Uniprot ID: Q8TAT5
  ENSP ID: ENSP00000264596
MVEGPGCTLNGEKIRARVLPGQAVTGVRGSALRSLQGRALRLAASTVVVSPQAAALNNDSSQNVLSLFNGYVYSGVETLGKELFMYFGPKALRIHFGMKGFIMINPLEYKYKNGASPVLEVQLTKDLICFFDSSVELRNSMESQQRIRMMKELDVCSPEFSFLRAESEVKKQKGRMLGDVLMDQNVLPGVGNIIKNEALFDSGLHPAVKVCQLTDEQIHHLMKMIRDFSILFYRCRKAGLALSKHYKVYKRPNCGQCHCRITVCRFGDNNRMTYFCPHCQKENPQHVDICKLPTRNTIISWTSSRVDHVMDSVARKSEEHWTCVVCTLINKPSSKACDACLTSRPIDSVLKSEENSTVFSHLMKYPCNTFGKPHTEVKINRKTAFGTTTLVLTDFSNKSSTLERKTKQNQILDEEFQNSPPASVCLNDIQHPSKKTTNDITQPSSKVNISPTISSESKLFSPAHKKPKTAQYSSPELKSCNPGYSNSELQINMTDGPRTLNPDSPRCSKHNRLCILRVVGKDGENKGRQFYACPLPREAQCGFFEWADLSFPFCNHGKRSTMKTVLKIGPNNGKNFFVCPLGKEKQCNFFQWAENGPGIKIIPGC

SEQ ID NO: 55849 - protein, 63 aa, Homo sapiens
  Payload ID: 10985
  Gene Symbol: NEIL3
  Gene Name: nei-like DNA glycosylase 3
  ENSP ID: ENSP00000424735
MVEGPGCTLNGEKIRARVLPGQAVTGVRGSALRSLQGRALRLAASTVVVSPQDSFRNERLHHD

SEQ ID NO: 55850 - protein, 527 aa, Homo sapiens
  Payload ID: 10986
  Gene Symbol: NLK
  Gene Name: nemo-like kinase
  Uniprot ID: Q9UBE8
  ENSP ID: ENSP00000384625
MSLCGARANAKMMAAYNGGTSAAAAGHHHHHHHHLPHLPPPHLHHHHHPQHHLHPGSAAAVHPVQQHTSSAAAAAAAAAAAAAMLNPGQQQPYFPSPAPGQAPGPAAAAPAQVQAAAAATVKAHHHQHSHHPQQQLDIEPDRPIGYGAFGVVWSVTDPRDGKRVALKKMPNVFQNLVSCKRVFRELKMLCFFKHDNVLSALDILQPPHIDYFEEIYVVTELMQSDLHKIIVSPQPLSSDHVKVFLYQILRGLKYLHSAGILHRDIKPGNLLVNSNCVLKICDFGLARVEELDESRHMTQEVVTQYYRAPEILMGSRHYSNAIDIWSVGCIFAELLGRRILFQAQSPIQQLDLITDLLGTPSLEAMRTACEGAKAHILRGPHKQPSLPVLYTLSSQATHEAVHLLCRMLVFDPSKRISAKDALAHPYLDEGRLRYHTCMCKCCFSTSTGRVYTSDFEPVTNPKFDDTFEKNLSSVRQVKEIIHQFILEQQKGNRVPLCINPQSAAFKSFISSTVAQPSEMPPSPLVWE

SEQ ID NO: 55851 - protein, 475 aa, Homo sapiens
  Payload ID: 10986
  Gene Symbol: NLK
  Gene Name: nemo-like kinase
  ENSP ID: ENSP00000433117
LHPGSAAAVHPVQQHTSSAAAAAAAAAAAAAMLNPGQQQPYFPSPAPGQAPGPAAAAPAQVQAAAAATVKAHHHQHSHHPQQQLDIEPDRPIGYGAFGVVWSVTDPRDGKRVALKKMPNVFQNLVSCKRVFRELKMLCFFKHDNVLSALDILQPPHIDYFEEIYVVTELMQSDLHKIIVSPQPLSSDHVKVFLYQILRGLKYLHSAGILHRDIKPGNLLVNSNCVLKICDFGLARVEELDESRHMTQEVVTQYYRAPEILMGSRHYSNAIDIWSVGCIFAELLGRRILFQAQSPIQQLDLITDLLGTPSLEAMRTACEGAKAHILRGPHKQPSLPVLYTLSSQATHEAVHLLCRMLVFDPSKRISAKDALAHPYLDEGRLRYHTCMCKCCFSTSTGRVYTSDFEPVTNPKFDDTFEKNLSSVRQVKEIIHQFILEQQKGNRVPLCINPQSAAFKSFISSTVAQPSEMPPSPLVWE

SEQ ID NO: 55852 - protein, 181 aa, Homo sapiens
  Payload ID: 10986
  Gene Symbol: NLK
  Gene Name: nemo-like kinase
  ENSP ID: ENSP00000464656
MSLCGARANAKMMAAYNGGTSAAAAGHHHHHHHHLPHLPPPHLHHHHHPQHHLHPGSAAAVHPVQQHTSSAAAAAAAAAAAAAMLNPGQQQPYFPSPAPGQAPGPAAAAPAQVQAAAAATVKAHHHQHSHHPQQQLDIEPDRPIGYGAFGVVWLRICSTEKFLHYQPRLTATAGFFGGSAL

SEQ ID NO: 55853 - protein, 1461 aa, Homo sapiens
  Payload ID: 10987
  Gene Symbol: NEO1
  Gene Name: neogenin 1
  Uniprot ID: Q92859
  ENSP ID: ENSP00000261908
MAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTDTSEVDLFVINAPYTPVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKADSSDKMPNDQASGSGGKGSRLPDLGSDYKPPMSGSNSPHGSPTSPLDSNMLLVIIVSVGVITIVVVVIIAVFCTRRTTSHQKKKRAACKSVNGSHKYKGNSKDVKPPDLWIHHERLELKPIDKSPDPNPIMTDTPIPRNSQDITPVDNSMDSNIHQRRNSYRGHESEDSMSTLAGRRGMRPKMMMPFDSQPPQPVISAHPIHSLDNPHHHFHSSSLASPARSHLYHPGSPWPIGTSMSLSDRANSTESVRNTPSTDTMPASSSQTCCTDHQDPEGATSSSYLASSQEEDSGQSLPTAHVRPSHPLKSFAVPAIPPPGPPTYDPALPSTPLLSQQALNHHIHSVKTASIGTLGRSRPPMPVVVPSAPEVQETTRMLEDSESSYEPDELTKEMAHLEGLMKDLNAITTA

SEQ ID NO: 55854 - protein, 1461 aa, Homo sapiens; identical to SEQ ID NO: 55853
  Payload ID: 10987
  Gene Symbol: NEO1
  Gene Name: neogenin 1
  Uniprot ID: Q92859
  ENSP ID: ENSP00000341198

SEQ ID NO: 55855 - protein, 1450 aa, Homo sapiens
  Payload ID: 10987
  Gene Symbol: NEO1
  Gene Name: neogenin 1
  Uniprot ID: Q92859
  ENSP ID: ENSP00000453200
MAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTDTSEVDLFVINAPYTPVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKASGSGGKGSRLPDLGSDYKPPMSGSNSPHGSPTSPLDSNMLLVIIVSVGVITIVVVVIIAVFCTRRTTSHQKKKRAACKSVNGSHKYKGNSKDVKPPDLWIHHERLELKPIDKSPDPNPIMTDTPIPRNSQDITPVDNSMDSNIHQRRNSYRGHESEDSMSTLAGRRGMRPKMMMPFDSQPPQPVISAHPIHSLDNPHHHFHSSSLASPARSHLYHPGSPWPIGTSMSLSDRANSTESVRNTPSTDTMPASSSQTCCTDHQDPEGATSSSYLASSQEEDSGQSLPTAHVRPSHPLKSFAVPAIPPPGPPTYDPALPSTPLLSQQALNHHIHSVKTASIGTLGRSRPPMPVVVPSAPEVQETTRMLEDSESSYEPDELTKEMAHLEGLMKDLNAITTA

SEQ ID NO: 55856 - protein, 1408 aa, Homo sapiens
  Payload ID: 10987
  Gene Symbol: NEO1
  Gene Name: neogenin 1
  Uniprot ID: Q92859
  ENSP ID: ENSP00000453317
MAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTDTSEVDLFVINAPYTPVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKADSSDKMPNDQASGSGGKGSRLPDLGSDYKPPMSGSNSPHGSPTSPLDSNMLLVIIVSVGVITIVVVVIIAVFCTRRTTSHQKKKRAACKSVNGSHKYKGNSKDVKPPDLWIHHERLELKPIDKSPDPNPIMTDTPIPRNSQDITPVDNSMDSNIHQRRNSYRGHESEDSMSTLAGRRGMRPKMMMPFDSQPPQQSVRNTPSTDTMPASSSQTCCTDHQDPEGATSSSYLASSQEEDSGQSLPTAHVRPSHPLKSFAVPAIPPPGPPTYDPALPSTPLLSQQALNHHIHSVKTASIGTLGRSRPPMPVVVPSAPEVQETTRMLEDSESSYEPDELTKEMAHLEGLMKDLNAITTA

SEQ ID NO: 55857 - protein, 1130 aa, Homo sapiens
  Payload ID: 10987
  Gene Symbol: NEO1
  Gene Name: neogenin 1
  ENSP ID: ENSP00000454024
GNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHDVAIPTLPPTSLTSATTDHLAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKASGSGGKGSRLPDLGSDYKPPMSGSNSPHGSPTSPLDSNMLLVIIVSVGVITIVVVVIIAVFCTRRTTSHQKKKRAACKSVNGSHKYKGNSKDVKPPDLWIHHERLELKPIDKSPDPNPIMTDTPIPRNSQDITPVDNSMDSNIHQRRNSYRGHESEDSMSTLAGRRGMRPKMMMPFDSQPPQPVISAHPIHSLDNPHHHFHSSSLASPARSHLYHPGSPWPIGTSMSLSDRANSTESVRNTPSTDTMPASSSQTCCTDHQDPEGATSSSYLASSQEEDSGQSLPTAHVRPSHPLKSFAVPAIPPPGPPTYDPALPSTPLLSQQALNHHIHSVKTASIGTLGRSRPPMPVVVPSAPEVQETTRMLEDSESSYEPDELTKEMAHLEGLMKDLNAITTA

SEQ ID NO: 55858 - protein, 357 aa, Homo sapiens
  Payload ID: 10988
  Gene Symbol: NOV
  Gene Name: nephroblastoma overexpressed
  Uniprot ID: P48745
  ENSP ID: ENSP00000259526
MQSVQSTSFCLRKQCLCLTFLLLHLLGQVAATQRCPPQCPGRCPATPPTCAPGVRAVLDGCSCCLVCARQRGESCSDLEPCDESSGLYCDRSADPSNQTGICTAVEGDNCVFDGVIYRSGEKFQPSCKFQCTCRDGQIGCVPRCQLDVLLPEPNCPAPRKVEVPGECCEKWICGPDEEDSLGGLTLAAYRPEATLGVEVSDSSVNCIEQTTEWTACSKSCGMGFSTRVTNRNRQCEMLKQTRLCMVRPCEQEPEQPTDKKGKKCLRTKKSLKAIHLQFKNCTSLHTYKPRFCGVCSDGRCCTPHNTKTIQAEFQCSPGQIVKKPVMVIGTCTCHTNCPKNNEAFLQELELKTTRGKM

SEQ ID NO: 55859 - protein, 509 aa, Homo sapiens
  Payload ID: 10989
  Gene Symbol: NPNT
  Gene Name: nephronectin
  Uniprot ID: Q6UXI9
  ENSP ID: ENSP00000302557
MDFLLALVLVSSLYLQAAAEFDGRWPRQIVSSIGLCRYGGRIDCCWGWARQSWGQCQPVCQPRCKHGECIGPNKCKCHPGYAGKTCNQDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFSVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSESQR

SEQ ID NO: 55860 - protein, 565 aa, Homo sapiens
  Payload ID: 10989
  Gene Symbol: NPNT
  Gene Name: nephronectin
  Uniprot ID: Q6UXI9
  ENSP ID: ENSP00000369323
MDFLLALVLVSSLYLQAAAEFDGRWPRQIVSSIGLCRYGGRIDCCWGWARQSWGQCQPVCQPRCKHGECIGPNKCKCHPGYAGKTCNQDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFIPRQPSNDLFEIFEIERGVSADDEAKDDPGVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCSEER

SEQ ID NO: 55861 - protein, 595 aa, Homo sapiens
  Payload ID: 10989
  Gene Symbol: NPNT
  Gene Name: nephronectin
  Uniprot ID: Q6UXI9
  ENSP ID: ENSP00000389252
MDFLLALVLVSSLYLQAAAEFDGRWPRQIVSSIGLCRYGGRIDCCWGWARQSWGQCQPVCQPRCKHGECIGPNKCKCHPGYAGKTCNQDEHIPAPLDQGSEQPLFQPLDHQATSLPSRDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFIPRQPSNDLFEIFEIERGVSADDEAKDDPGVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCSEER

SEQ ID NO: 55862 - protein, 582 aa, Homo sapiens
  Payload ID: 10989
  Gene Symbol: NPNT
  Gene Name: nephronectin
  Uniprot ID: Q6UXI9
  ENSP ID: ENSP00000402884
MDFLLALVLVSSLYLQAAAEFDGRWPRQIVSSIGLCRYGGRIDCCWGWARQSWGQCQPFYVLRQRIARIRCQLKAVCQPRCKHGECIGPNKCKCHPGYAGKTCNQDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFIPRQPSNDLFEIFEIERGVSADDEAKDDPGVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCSEER

SEQ ID NO: 55863 - protein, 104 aa, Homo sapiens
  Payload ID: 10989
  Gene Symbol: NPNT
  Gene Name: nephronectin
  ENSP ID: ENSP00000421480
  MOD_RES (1)..(1): Any amino acid
XGLCGWIREKDNDLHWEPIRDPAGITKMIKGLEKKIYDGKLKELGLLSLEKRRLRGKPLMVFKYMKGWHREGGDQLFSICTKNRTRGNWLRLEYKGAFLGRGHC

SEQ ID NO: 55864 - protein, 536 aa, Homo sapiens
  Payload ID: 10989
  Gene Symbol: NPNT
  Gene Name: nephronectin
  Uniprot ID: Q6UXI9
  ENSP ID: ENSP00000422044
MDFLLALVLVSSLYLQAAAEFDGRWPRQIVSSIGLCRYGGRIDCCWGWARQSWGQCQPVCQPRCKHGECIGPNKCKCHPGYAGKTCNQDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFSVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCSEER

SEQ ID NO: 55865 - protein, 566 aa, Homo sapiens
  Payload ID: 10989
  Gene Symbol: NPNT
  Gene Name: nephronectin
  Uniprot ID: Q6UXI9
  ENSP ID: ENSP00000422474
MDFLLALVLVSSLYLQAAAEFDGRWPRQIVSSIGLCRYGGRIDCCWGWARQSWGQCQPVCQPRCKHGECIGPNKCKCHPGYAGKTCNQDEHIPAPLDQGSEQPLFQPLDHQATSLPSRDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFSVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCSEER

SEQ ID NO: 55866 - protein, 609 aa, Homo sapiens
  Payload ID: 10989
  Gene Symbol: NPNT
  Gene Name: nephronectin
  ENSP ID: ENSP00000426146
MDFLLALVLVSSLYLQAAAEFDGRWPRQIVSSIGLCRYGGRIDCCWGWARQSWGQCQPFYVLRQRIARIRCQLKAVCQPRCKHGECIGPNKCKCHPGYAGKTCNQDEHIPAPLDQGSEQPLFQPLDHQATSLPSRDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFIPRQPSNDLFEIFEIERGVSADDEAKDDPGVLVHSCNFDHGLCGWIREKDNDLHWEPIRDPAGGQYLTVSAAKAPGGKAARLVLPLGRLMHSGDLCLSFRHKVTGLHSGTLQVFVRKHGAHGAALWGRNGGHGWRQTQITLRGADIKSVVFKGEKRRGHTGEIGLDDVSLKKGHCS

SEQ ID NO: 55867 - protein, 26 aa, Homo sapiens
  Payload ID: 10989
  Gene Symbol: NPNT
  Gene Name: nephronectin
  ENSP ID: ENSP00000426219
  MOD_RES (1)..(1): Any amino acid
XNDLHWEPIRDPADNCSCLHAGGLDL

SEQ ID NO: 55868 - protein, 61 aa, Homo sapiens
  Payload ID: 10989
  Gene Symbol: NPNT
  Gene Name: nephronectin
  ENSP ID: ENSP00000426951
MNTYGSYKCYCLNGYMLMPDGSCSSALTCSMANCQYGCDVVKGQIRCQCPSPGLQLAPDGR

SEQ ID NO: 55869 - protein, 453 aa, Homo sapiens
  Payload ID: 10989
  Gene Symbol: NPNT
  Gene Name: nephronectin
  ENSP ID: ENSP00000427507
  MOD_RES (1)..(1): Any amino acid
XWPRQIVSSIGLCRYGGRIDCCWGWARQSWGQCQPVCQPRCKHGECIGPNKCKCHPGYAGKTCNQDLNECGLKPRPCKHRCMNTYGSYKCYCLNGYMLMPDGSCSSALTCSMANCQYGCDVVKGQIRCQCPSPGLQLAPDGRTCVDVDECATGRASCPRFRQCVNTFGSYICKCHKGFDLMYIGGKYQCHDIDECSLGQYQCSSFARCYNIRGSYKCKCKEGYQGDGLTCVYIPKVMIEPSGPIHVPKGNGTILKGDTGNNNWIPDVGSTWWPPKTPYIPPIITNRPTSKPTTRPTPKPTPIPTPPPPPPLPTELRTPLPPTTPERPTTGLTTIAPAASTPPGGITVDNRVQTDPQKPRGDVFIPRQPSNDLFEIFEIERGVSADDEAKDDPGVLVHSCNFDHGLCGWIREKDNDLHWEPIRDPAEILQGTQFREIFIGCILSASCVTSYLGC

SEQ ID NO: 55870 - protein, 733 aa, Homo sapiens
  Payload ID: 10990
  Gene Symbol: NPHP1
  Gene Name: nephronophthisis 1 (juvenile)
  Uniprot ID: O15259
  ENSP ID: ENSP00000313169
MLARRQRDPLQALRRRNQELKQQVDSLLSESQLKEALEPNKRQHIYQRCIQLKQAIDENKNALQKLSKADESAPVANYNQRKEEEHTLLDKLTQQLQGLAVTISRENITEVGAPTEEEEESESEDSEDSGGEEEDAEEEEEEKEENESHKWSTGEEYIAVGDFTAQQVGDLTFKKGEILLVIEKKPDGWWIAKDAKGNEGLVPRTYLEPYSEEEEGQESSEEGSEEDVEAVDETADGAEVKQRTDPHWSAVQKAISEAGIFCLVNHVSFCYLIVLMRNRMETVEDTNGSETGFRAWNVQSRGRIFLVSKPVLQQINTVDVLTTMGAIPAGFRPSTLSQLLEEGNQFRANYFLQPELMPSQLAFRDLMWDATEGTIRSRPSRISLILTLWSCKMIPLPGMSIQVLSRHVRLCLFDGNKVLSNIHTVRATWQPKKPKTWTFSPQVTRILPCLLDGDCFIRSNSASPDLGILFELGISYIRNSTGERGELSCGWVFLKLFDASGVPIPAKTYELFLNGGTPYEKGIEVDPSISRRAHGSVFYQIMTMRRQPQLLVKLRSLNRRSRNVLSLLPETLIGNMCSIHLLIFYRQILGDVLLKDRMSLQSTDLISHPMLATFPMLLEQPDVMDALRSSWAGKESTLKRSEKRDKEFLKSTFLLVYHDCVLPLLHSTRLPPFRWAEEETETARWKVITDFLKQNQENQGALQALLSPDGVHEPFDLSEQTYDFLGEMRKNAV

SEQ ID NO: 55871 - protein, 614 aa, Homo sapiens
  Payload ID: 10990
  Gene Symbol: NPHP1
  Gene Name: nephronophthisis 1 (juvenile)
  Uniprot ID: O15259
  ENSP ID: ENSP00000347452
MLARRQRDPLQALRRRNQELKQQVDSLLSESQLKEALEPNKRQHIYQRVGAPTEEEEESESEDSEDSGGEEEDAEEEEEEKEENESHKWSTGEEYIAVGDFTAQQVGDLTFKKGEILLVIEKKPDGWWIAKDAKGNEGLVPRTYLEPYSEEEEGQESSEEGSEEDVEAVDETADGAEVKQRTDPHWSAVQKAISEINTVDVLTTMGAIPAGFRPSTLSQLLEEGNQFRANYFLQPELMPSQLAFRDLMWDATEGTIRSRPSRISLILTLWSCKMIPLPGMSIQVLSRHVRLCLFDGNKVLSNIHTVRATWQPKKPKTWTFSPQVTRILPCLLDGDCFIRSNSASPDLGILFELGISYIRNSTGERGELSCGWVFLKLFDASGVPIPAKTYELFLNGGTPYEKGIEVDPSISRRAHGSVFYQIMTMRRQPQLLVKLRSLNRRSRNVLSLLPETLIGNMCSIHLLIFYRQILGDVLLKDRMSLQSTDLISHPMLATFPMLLEQPDVMDALRSSWAGKESTLKRSEKRDKEFLKSTFLLVYHDCVLPLLHSTRLPPFRWAEEETETARWKVITDFLKQNQENQGALQALLSPDGVHEPFDLSEQTYDFLGEMRKNAV

SEQ ID NO: 55872 - protein, 732 aa, Homo sapiens
  Payload ID: 10990
  Gene Symbol: NPHP1
  Gene Name: nephronophthisis 1 (juvenile)
  Uniprot ID: O15259
  ENSP ID: ENSP00000376953
MLARRQRDPLQALRRRNQELKQQVDSLLSESQLKEALEPNKRQHIYQRCIQLKQAIDENKNALQKLSKADESAPVANYNQRKEEEHTLLDKLTQQLQGLAVTISRENITEVGAPTEEEEESESEDSEDSGGEEEDAEEEEEEKEENESHKWSTGEEYIAVGDFTAQQVGDLTFKKGEILLVIEKKPDGWWIAKDAKGNEGLVPRTYLEPYSEEEEGQESSEEGSEEDVEAVDETADGAEVKQRTDPHWSAVQKAISEAGIFCLVNHVSFCYLIVLMRNRMETVEDTNGSETGFRAWNVQSRGRIFLVSKPVLQINTVDVLTTMGAIPAGFRPSTLSQLLEEGNQFRANYFLQPELMPSQLAFRDLMWDATEGTIRSRPSRISLILTLWSCKMIPLPGMSIQVLSRHVRLCLFDGNKVLSNIHTVRATWQPKKPKTWTFSPQVTRILPCLLDGDCFIRSNSASPDLGILFELGISYIRNSTGERGELSCGWVFLKLFDASGVPIPAKTYELFLNGGTPYEKGIEVDPSISRRAHGSVFYQIMTMRRQPQLLVKLRSLNRRSRNVLSLLPETLIGNMCSIHLLIFYRQILGDVLLKDRMSLQSTDLISHPMLATFPMLLEQPDVMDALRSSWAGKESTLKRSEKRDKEFLKSTFLLVYHDCVLPLLHSTRLPPFRWAEEETETARWKVITDFLKQNQENQGALQALLSPDGVHEPFDLSEQTYDFLGEMRKNAV

SEQ ID NO: 55873 - protein, 677 aa, Homo sapiens
  Payload ID: 10990
  Gene Symbol: NPHP1
  Gene Name: nephronophthisis 1 (juvenile)
  Uniprot ID: O15259
  ENSP ID: ENSP00000389879
MLARRQRDPLQALRRRNQELKQQVDSLLSESQLKEALEPNKRQHIYQRCIQLKQAIDENKNALQKLSKADESAPVANYNQRKEEEHTLLDKLTQQLQGLAVTISRENITEVGAPTEEEEESESEDSEDSGGEEEDAEEEEEEKEENESHKWSTGEEYIAVGDFTAQQVGDLTFKKGEILLVIEKKPDGWWIAKDAKGNEGLVPRTYLEPYSEEEEGQESSEEGSEEDVEAVDETADGAEVKQRTDPHWSAVQKAISEQINTVDVLTTMGAIPAGFRPSTLSQLLEEGNQFRANYFLQPELMPSQLAFRDLMWDATEGTIRSRPSRISLILTLWSCKMIPLPGMSIQVLSRHVRLCLFDGNKVLSNIHTVRATWQPKKPKTWTFSPQVTRILPCLLDGDCFIRSNSASPDLGILFELGISYIRNSTGERGELSCGWVFLKLFDASGVPIPAKTYELFLNGGTPYEKGIEVDPSISRRAHGSVFYQIMTMRRQPQLLVKLRSLNRRSRNVLSLLPETLIGNMCSIHLLIFYRQILGDVLLKDRMSLQSTDLISHPMLATFPMLLEQPDVMDALRSSWAGKESTLKRSEKRDKEFLKSTFLLVYHDCVLPLLHSTRLPPFRWAEEETETARWKVITDFLKQNQENQGALQALLSPDGVHEPFDLSEQTYDFLGEMRKNAV

SEQ ID NO: 55874 - protein, 47 aa, Homo sapiens
  Payload ID: 10990
  Gene Symbol: NPHP1
  Gene Name: nephronophthisis 1 (juvenile)
  ENSP ID: ENSP00000392562
  MOD_RES (1)..(1): Any amino acid
XLISHPMLATFPMLLEQPDVMDALRSSWAGKESTLKRSEKVKYESPH

SEQ ID NO: 55875 - protein, 711 aa, Homo sapiens
  Payload ID: 10990
  Gene Symbol: NPHP1
  Gene Name: nephronophthisis 1 (juvenile)
  ENSP ID: ENSP00000402176
MLARRQRDPLQALRRRNQELKQQVDSLLSESQLKEALEPNKRQHIYQRCIQLKQAIDENKNALQKLSKADESAPVANYNQRKEEEHTLLDKLTQQLQGLAVTISRENITEVGAPTEEEEESESEDSEDSGGEEEDAEEEEEEKEENESHKWSTGEEYIAVGDFTAQQVGDLTFKKGEILLVIEKKPDGWWIAKDAKGNEGLVPRTYLEPYSEEEEGQESSEEGSEEDVEAVDETADGAEVKQRTDPHWSAVQKAISEINTVDVLTTMGAIPAGFRPSTLSQLLEEGNQFRANYFLQPELMPSQLAFRDLMWDATEGTIRSRPSRISLILTLWSCKMIPLPGMSIQVLSRHVRLCLFDGNKVLSNIHTVRATWQPKKPKTWTFSPQVTRILPCLLDGDCFIRSNSASPDLGILFELGISYIRNSTGERGELSCGWVFLKLFDASGVPIPAKTYELFLNGGTPYEKGIEVDPSISRRAHGSVFYQIMTMRRQPQLLVKLRSLNRRSRNVLSLLPETLIGNMCSIHLLIFYRQILGDVLLKDRMSLQSTDLISHPMLATFPMLLEQPDVMDALRSSWAGKESTLKRSEKLSKPVSPREGKKKWPELYHILKTMHCSCLPCYKIMRDKEFLKSTFLLVYHDCVLPLLHSTRLPPFRWAEEETETARWKVITDFLKQNQENQGALQALLSPDGVHEPFDLSEQTYDFLGEMRKNAV

SEQ ID NO: 55876 - protein, 45 aa, Homo sapiens
  Payload ID: 10990
  Gene Symbol: NPHP1
  Gene Name: nephronophthisis 1 (juvenile)
  ENSP ID: ENSP00000406453
  MOD_RES (1)..(1): Any amino acid
XRRQRDPLQALRRRNQELKQQRTPEAEYGTDFLFGVCRTSNQQPL

SEQ ID NO: 55877 - protein, 121 aa, Homo sapiens
  Payload ID: 10990
  Gene Symbol: NPHP1
  Gene Name: nephronophthisis 1 (juvenile)
  ENSP ID: ENSP00000412351
MLARRQRDPLQALRRRNQELKQQVDSLLSESQLKEALEPNKRQHIYQRCIQLKQAIDENKNALQKLSKADESAPVANYNQRKEEEHTLLDKLTQQLQGLAVTISRENITEYASFLPFFFLF

SEQ ID NO: 55878 - protein, 1330 aa, Homo sapiens
  Payload ID: 10991
  Gene Symbol: NPHP3
  Gene Name: nephronophthisis 3 (adolescent)
  Uniprot ID: Q7Z494
  ENSP ID: ENSP00000338766
MGTASSLVSPAGGEVIEDTYGAGGGEACEIPVEVKPKARLLRNSFRRGAGAAAGAGPGSLPRGVGAGGLLGASFKSTGSSVPELEYAAAEYERLRKEYEIFRVSKNQELLSMGRREAKLDTENKRLRAELQALQKTYQKILREKESALEAKYQAMERAATFEHDRDKVKRQFKIFRETKENEIQDLLRAKRELESKLQRLQAQGIQVFDPGESDSDDNCTDVTAAGTQCEYWTGGALGSEPSIGSMIQLQQSFRGPEFAHSSIDVEGPFANVNRDDWDIAVASLLQVTPLFSHSLWSNTVRCYLIYTDETQPEMDLFLKDYSPKLKRMCETMGYFFHAVYFPIDVENQYLTVRKWEIEKSSLVILFIHLTLPSLLLEDCEEAFLKNPEGKPRLIFHRLEDGKVSSDSVQQLIDQVSNLNKTSKAKIIDHSGDPAEGVYKTYICVEKIIKQDILGFENTDLETKDLGSEDSIPEEDDFGDVLWDIHDEQEQMETFQQASNSAHELGFEKYYQRLNDLVAAPAPIPPLLVSGGPGSGKSLLLSKWIQLQQKNSPNTLILSHFVGRPMSTSSESSLIIKRLTLKLMQHSWSVSALTLDPAKLLEEFPRWLEKLSARHQGSIIIVIDSIDQVQQVEKHMKWLIDPLPVNVRVIVSVNVETCPPAWRLWPTLHLDPLSPKDAKSIIIAECHSVDIKLSKEQEKKLERHCRSATTCNALYVTLFGKMIARAGRAGNLDKILHQCFQCQDTLSLYRLVLHSIRESMANDVDKELMKQILCLVNVSHNGVSESELMELYPEMSWTFLTSLIHSLYKMCLLTYGCGLLRFQHLQAWETVRLEYLEGPTVTSSYRQKLINYFTLQLSQDRVTWRSADELPWLFQQQGSKQKLHDCLLNLFVSQNLYKRGHFAELLSYWQFVGKDKSAMATEYFDSLKQYEKNCEGEDNMSCLADLYETLGRFLKDLGLLSQAIVPLQRSLEIRETALDPDHPRVAQSLHQLASVYVQWKKFGNAEQLYKQALEISENAYGADHPYTARELEALATLYQKQNKYEQAEHFRKKSFKIHQKAIKKKGNLYGFALLRRRALQLEELTLGKDTPDNARTLNELGVLYYLQNNLETADQFLKRSLEMRERVLGPDHPDCAQSLNNLAALCNEKKQYDKAEELYERALDIRRRALAPDHPSLAYTVKHLAILYKKMGKLDKAVPLYELAVEIRQKSFGPKHPSVATALVNLAVLYSQMKKHVEALPLYERALKIYEDSLGRMHPRVGETLKNLAVLSYEGGDFEKAAELYKRAMEIKEAETSLLGGKAPSRHSSSGDTFSLKTAHSPNVFLQQGQR

SEQ ID NO: 55879 - protein, 123 aa, Homo sapiens
  Payload ID: 10991
  Gene Symbol: NPHP3
  Gene Name: nephronophthisis 3 (adolescent)
  ENSP ID: ENSP00000418664
AKLDTENKRLRAELQALQKTYQKILREKESALEAKYQAMERAATFEHDRDKVKRQFKIFRETKENEIQDLLRAKRELESKLQRLQAQGIQVFDPGESDSDDNCTDVTVSLESDQHPGIFIANF

SEQ ID NO: 55880 - protein, 538 aa, Homo sapiens
  Payload ID: 10991
  Gene Symbol: NPHP3
  Gene Name: nephronophthisis 3 (adolescent)
  ENSP ID: ENSP00000419907
MGTASSLVSPAGGEVIEDTYGAGGGEACEIPVEALQKTYQKILREKESALEAKYQAMERAATFEHDRDKVKRQFKIFRETKENEIQDLLRAKRELESKLQRLQAQGIQVFDPGESDSDDNCTDVTAAGTQCEYWTGGALGSEPSIGSMIQLQQSFRGPEFAHSSIDVEGPFANVNRDDWDIAVASLLQVTPLFSHSLWSNTVRCYLIYTDETQPEMDLFLKDYSPKLKRMCETMGYFFHAVYFPIDVENQYLTVRKWEIEKSSLVILFIHLTLPSLLLEDCEEAFLKNPEGKPRLIFHRLEDGKVSSDSVQQLIDQVSNLNKTSKAKIIDHSGDPAEGVYKTYICVEKIIKQDILGFENTDLETKDLGSEDSIPEEDDFGDVLWDIHDEQEQMETFQQASNSAHELGFEKYYQRLNDLVAAPAPIPPLLVSGGPGSGKSLLLSKWIQLQQKNSPNTLILSHFVGRPMSTSSESSLIIKRLTLKLMQHSWSVSALTLDPAKLLEEFPRWLEKLSARHQGSIIIVIDSIDQVQVVAYTSS

SEQ ID NO: 55881 - protein, 87 aa, Homo sapiens
  Payload ID: 10991
  Gene Symbol: NPHP3
  Gene Name: nephronophthisis 3 (adolescent)
  ENSP ID: ENSP00000427666
EKKQYDKAEELYERALDIRRRALAPDHPSLAYTVKHLAILYKKMGKLDKAVPLYELAVEIRQKSFGPKHPSVATALVNLAVLYSQML

SEQ ID NO: 55882 - protein, 1426 aa, Homo sapiens
  Payload ID: 10992
  Gene Symbol: NPHP4
  Gene Name: nephronophthisis 4
  Uniprot ID: O75161
  ENSP ID: ENSP00000367398
MNDWHRIFTQNVLVPPHPQRARQPWKESTAFQCVLKWLDGPVIRQGVLEVLSEVECHLRVSFFDVTYRHFFGRTWKTTVKPTKRPPSRIVFNEPLYFHTSLNHPHIVAVVEVVAEGKKRDGSLQTLSCGFGILRIFSNQPDSPISASQDKRLRLYHGTPRALLHPLLQDPAEQNRHMTLIENCSLQYTLKPHPALEPAFHLLPENLLVSGLQQIPGLLPAHGESGDALRKPRLQKPITGHLDDLFFTLYPSLEKFEEELLELHVQDHFQEGCGPLDGGALEILERRLRVGVHNGLGFVQRPQVVVLVPEMDVALTRSASFSRKVVSSSKTSSGSQALVLRSRLRLPEMVGHPAFAVIFQLEYVFSSPAGVDGNAASVTSLSNLACMHMVRWAVWNPLLEADSGRVTLPLQGGIQPNPSHCLVYKVPSASMSSEEVKQVESGTLRFQFSLGSEEHLDAPTEPVSGPKVERRPSRKPPTSPSSPPAPVPRVLAAPQNSPVGPGLSISQLAASPRSPTQHCLARPTSQLPHGSQASPAQAQEFPLEAGISHLEADLSQTSLVLETSIAEQLQELPFTPLHAPIVVGTQTRSSAGQPSRASMVLLQSSGFPEILDANKQPAEAVSATEPVTFNPQKEESDCLQSNEMVLQFLAFSRVAQDCRGTSWPKTVYFTFQFYRFPPATTPRLQLVQLDEAGQPSSGALTHILVPVSRDGTFDAGSPGFQLRYMVGPGFLKPGERRCFARYLAVQTLQIDVWDGDSLLLIGSAAVQMKHLLRQGRPAVQASHELEVVATEYEQDNMVVSGDMLGFGRVKPIGVHSVVKGRLHLTLANVGHPCEQKVRGCSTLPPSRSRVISNDGASRFSGGSLLTTGSSRRKHVVQAQKLADVDSELAAMLLTHARQGKGPQDVSRESDATRRRKLERMRSVRLQEAGGDLGRRGTSVLAQQSVRTQHLRDLQVIAAYRERTKAESIASLLSLAITTEHTLHATLGVAEFFEFVLKNPHNTQHTVTVEIDNPELSVIVDSQEWRDFKGAAGLHTPVEEDMFHLRGSLAPQLYLRPHETAHVPFKFQSFSAGQLAMVQASPGLSNEKGMDAVSPWKSSAVPTKHAKVLFRASGGKPIAVLCLTVELQPHVVDQVFRFYHPELSFLKKAIRLPPWHTFPGAPVGMLGEDPPVHVRCSDPNVICETQNVGPGEPRDIFLKVASGPSPEIKDFFVIIYSDRWLATPTQTWQVYLHSLQRVDVSCVAGQLTRLSLVLRGTQTVRKVRAFTSHPQELKTDPKGVFVLPPRGVQDLHVGVRPLRAGSRFVHLNLVDVDCHQLVASWLVCLCCRQPLISKAFEIMLAAGEGKGVNKRITYTNPYPSRRTFHLHSDHPELLRFREDSFQVGGGETYTIGLQFAPSQRVGEEEILIYINDHEDKNEEAFCVKVIYQ

SEQ ID NO: 55883 - protein, 262 aa, Homo sapiens
  Payload ID: 10992
  Gene Symbol: NPHP4
  Gene Name: nephronophthisis 4
  ENSP ID: ENSP00000367411
MNDWHRIFTQNVLVPPHPQRARQPWKESTAFQCVLKWLDGPVIRQGVLEVLSEVECHLRVSFFDVTYRHFFGRTWKTTVKPTKRPPSRIVFNEPLYFHTSLNHPHIVAVVEVVAEGKKRDGSLQTLSCGFGILRIFSNQPDSPISASQDKRLRLYHGTPRALLHPLLQDPAEQNRHMTLIENCSLQYTLKPHPALEPAFHLLPENLLVSGLQQIPGLLPAHGESGMWPTGRWCPGDPGAAPACGRAQWSGLRAEAAGRCTGA

SEQ ID NO: 55884 - protein, 911 aa, Homo sapiens
  Payload ID: 10992
  Gene Symbol: NPHP4
  Gene Name: nephronophthisis 4
  Uniprot ID: O75161
  ENSP ID: ENSP00000423747
MNDWHRIFTQNVLVPPHPQRARQPWKESTAFQCVLKWLDGPVIRQGVLEVLSEVECHLRVSFFDVTYRHFFGRTWKTTVKPTKRPPSRIVFNEPLYFHTSLNHPHIVAVVEVVAEGKKRDGSLQTLSCGFGILRIFSNQPDSPISASQDKRLRLYHGTPRALLHPLLQDPAEQNRHMTLIENCSLQYTLKPHPALEPAFHLLPENLLVSGLQQIPGLLPAHGESGDALRKPRLQKPITGHLDDLFFTLYPSLEKFEEELLELHVQDHFQEGCGPLDGGALEILERRLRVGVHNGLGFVQRPQVVVLVPEMDVALTRSASFSRKVVSSSKTSSGSQALVLRSRLRLPEMVGHPAFAVIFQLEYVFSSPAGVDGNAASVTSLSNLACMHMVRWAVWNPLLEADSGRVTLPLQGGIQPNPSHCLVYKVPSASMSSEEVKQVESGTLRFQFSLGSEEHLDAPTEPVSGPKVERRPSRKPPTSPSSPPAPVPRVLAAPQNSPVGPGLSISQLAASPRSPTQHCLARPTSQLPHGSQASPAQAEFPLEAGISHLEADLSQTSLVLETSIAEQLQELPFTPLHAPIVVGTQTRSSAGQPSRASMVLLQSSGFPEILDANKQPAEAVSATEPVTFNPQKEESDCLQSNEMVLQFLAFSRVAQDCRGTSWPKTVYFTFQFYRFPPATTPRLQLVQLDEAGQPSSGALTHILVPVSRDGTFDAGSPGFQLRYMVGPGFLKPGERRCFARYLAVQTLQIDVWDGDSLLLIGSAAVQMKHLLRQGRPAVQASHELEVVATEYEQDNMVVSGDMLGFGRVKPIGVHSVVKGRLHLTLANVGHPCEQKVRGCSTLPPSRSRVISNDGASRFSGGSLLTTGSSRRWALQATVLFGEVGTLPVAFVSGWLLICKGRRNGEKVRRNID

SEQ ID NO: 55885 - protein, 138 aa, Homo sapiens
  Payload ID: 10992
  Gene Symbol: NPHP4
  Gene Name: nephronophthisis 4
  ENSP ID: ENSP00000425745
  MOD_RES (1)..(1): Any amino acid
XEMVLQFLAFSRVAQDCRGTSWPKTVYFTFQFYRFPPATTPRLQLVQLDEAGQPSSGALTHILVPVSRDGTFDAGSPGFQLRYMVGPGFLKPGERRCFARYLAVQTLQIDVWDGDSLLLIGSAAVQMKETSHIFSVSQ

SEQ ID NO: 55886 - protein, 911 aa, Homo sapiens; identical to SEQ ID NO: 55884
  Payload ID: 10992
  Gene Symbol: NPHP4
  Gene Name: nephronophthisis 4
  Uniprot ID: O75161
  ENSP ID: ENSP00000481831

SEQ ID NO: 55887 - protein, 1201 aa, Homo sapiens
  Payload ID: 10993
  Gene Symbol: NPHS1
  Gene Name: nephrosis 1, congenital, Finnish type (nephrin)
  Uniprot ID: O60500
  ENSP ID: ENSP00000343634
MALGTTLRASLLLLGLLTEGLAQLAIPASVPRGFWALPENLTVVEGASVELRCGVSTPGSAVQWAKDGLLLGPDPRIPGFPRYRLEGDPARGEFHLHIEACDLSDDAEYECQVGRSEMGPELVSPRVILSILVPPKLLLLTPEAGTMVTWVAGQEYVVNCVSGDAKPAPDITILLSGQTISDISANVNEGSQQKLFTVEATARVTPRSSDNRQLLVCEASSPALEAPIKASFTVNVLFPPGPPVIEWPGLDEGHVRAGQSLELPCVARGGNPLATLQWLKNGQPVSTAWGTEHTQAVARSVLVMTVRPEDHGAQLSCEAHNSVSAGTQEHGITLQVTFPPSAIIILGSASQTENKNVTLSCVSKSSRPRVLLRWWLGWRQLLPMEETVMDGLHGGHISMSNLTFLARREDNGLTLTCEAFSEAFTKETFKKSLILNVKYPAQKLWIEGPPEGQKLRAGTRVRLVCLAIGGNPEPSLMWYKDSRTVTESRLPQESRRVHLGSVEKSGSTFSRELVLVTGPSDNQAKFTCKAGQLSASTQLAVQFPPTNVTILANASALRPGDALNLTCVSVSSNPPVNLSWDKEGERLEGVAAPPRRAPFKGSAAARSVLLQVSSRDHGQRVTCRAHSAELRETVSSFYRLNVLYRPEFLGEQVLVVTAVEQGEALLPVSVSANPAPEAFNWTFRGYRLSPAGGPRHRILSSGALHLWNVTRADDGLYQLHCQNSEGTAEARLRLDVHYAPTIRALQDPTEVNVGGSVDIVCTVDANPILPGMFNWERLGEDEEDQSLDDMEKISRGPTGRLRIHHAKLAQAGAYQCIVDNGVAPPARRLLRLVVRFAPQVEHPTPLTKVAAAGDSTSSATLHCRARGVPNIVFTWTKNGVPLDLQDPRYTEHTYHQGGVHSSLLTIANVSAAQDYALFTCTATNALGSDQTNIQLVSISRPDPPSGLKVVSLTPHSVGLEWKPGFDGGLPQRFCIRYEALGTPGFHYVDVVPPQATTFTLTGLQPSTRYRVWLLASNALGDSGLADKGTQLPITTPGLHQPSGEPEDQLPTEPPSGISEKTEAGSEEDRVRNEYEESQWTGERDTQSSTVSTTEAEPYYRSLRDFSPQLPPTQEEVSYSRGFTGEDEDMAFPGHLYDEVERTYPPSGAWGPLYDEVQMGPWDLHWPEDTYQDPRGIYDQVAGDLDTLEPDSLPFELRGHLV

SEQ ID NO: 55888 - protein, 1241 aa, Homo sapiens
  Payload ID: 10993
  Gene Symbol: NPHS1
  Gene Name: nephrosis 1, congenital, Finnish type (nephrin)
  Uniprot ID: O60500
  ENSP ID: ENSP00000368190
MALGTTLRASLLLLGLLTEGLAQLAIPASVPRGFWALPENLTVVEGASVELRCGVSTPGSAVQWAKDGLLLGPDPRIPGFPRYRLEGDPARGEFHLHIEACDLSDDAEYECQVGRSEMGPELVSPRVILSILVPPKLLLLTPEAGTMVTWVAGQEYVVNCVSGDAKPAPDITILLSGQTISDISANVNEGSQQKLFTVEATARVTPRSSDNRQLLVCEASSPALEAPIKASFTVNVLFPPGPPVIEWPGLDEGHVRAGQSLELPCVARGGNPLATLQWLKNGQPVSTAWGTEHTQAVARSVLVMTVRPEDHGAQLSCEAHNSVSAGTQEHGITLQVTFPPSAIIILGSASQTENKNVTLSCVSKSSRPRVLLRWWLGWRQLLPMEETVMDGLHGGHISMSNLTFLARREDNGLTLTCEAFSEAFTKETFKKSLILNVKYPAQKLWIEGPPEGQKLRAGTRVRLVCLAIGGNPEPSLMWYKDSRTVTESRLPQESRRVHLGSVEKSGSTFSRELVLVTGPSDNQAKFTCKAGQLSASTQLAVQFPPTNVTILANASALRPGDALNLTCVSVSSNPPVNLSWDKEGERLEGVAAPPRRAPFKGSAAARSVLLQVSSRDHGQRVTCRAHSAELRETVSSFYRLNVLYRPEFLGEQVLVVTAVEQGEALLPVSVSANPAPEAFNWTFRGYRLSPAGGPRHRILSSGALHLWNVTRADDGLYQLHCQNSEGTAEARLRLDVHYAPTIRALQDPTEVNVGGSVDIVCTVDANPILPGMFNWERLGEDEEDQSLDDMEKISRGPTGRLRIHHAKLAQAGAYQCIVDNGVAPPARRLLRLVVRFAPQVEHPTPLTKVAAAGDSTSSATLHCRARGVPNIVFTWTKNGVPLDLQDPRYTEHTYHQGGVHSSLLTIANVSAAQDYALFTCTATNALGSDQTNIQLVSISRPDPPSGLKVVSLTPHSVGLEWKPGFDGGLPQRFCIRYEALGTPGFHYVDVVPPQATTFTLTGLQPSTRYRVWLLASNALGDSGLADKGTQLPITTPGLHQPSGEPEDQLPTEPPSGPSGLPLLPVLFALGGLLLLSNASCVGGVLWQRRLRRLAEGISEKTEAGSEEDRVRNEYEESQWTGERDTQSSTVSTTEAEPYYRSLRDFSPQLPPTQEEVSYSRGFTGEDEDMAFPGHLYDEVERTYPPSGAWGPLYDEVQMGPWDLHWPEDTYQDPRGIYDQVAGDLDTLEPDSLPFELRGHLV

SEQ ID NO: 55889 - protein, 383 aa, Homo sapiens
  Payload ID: 10994
  Gene Symbol: NPHS2
  Gene Name: nephrosis 2, idiopathic, steroid-resistant (podocin)
  Uniprot ID: Q9NP85
  ENSP ID: ENSP00000356587
MERRARSSSRESRGRGGRTPHKENKRAKAERSGGGRGRQEAGPEPSGSGRAGTPGEPRAPAATVVDVDEVRGSGEEGTEVVALLESERPEEGTKSSGLGACEWLLVLISLLFIIMTFPFSIWFCVKVVQEYERVIIFRLGHLLPGRAKGPGLFFFLPCLDTYHKVDLRLQTLEIPFHEIVTKDMFIMEIDAICYYRMENASLLLSSLAHVSKAVQFLVQTTMKRLLAHRSLTEILLERKSIAQDAKVALDSVTCIWGIKVERIEIKDVRLPAGLQHSLAVEAEAQRQAKVRMIAAEAEKAASESLRMAAEILSGTPAAVQLRYLHTLQSLSTEKPSTVVLPLPFDLLNCLSSPSNRTQGSLPFPSPSKPVEPLNPKKKDSPML

SEQ ID NO: 55890 - protein, 315 aa, Homo sapiens
  Payload ID: 10994
  Gene Symbol: NPHS2
  Gene Name: nephrosis 2, idiopathic, steroid-resistant (podocin)
  Uniprot ID: Q9NP85
  ENSP ID: ENSP00000356588
MERRARSSSRESRGRGGRTPHKENKRAKAERSGGGRGRQEAGPEPSGSGRAGTPGEPRAPAATVVDVDEVRGSGEEGTEVVALLESERPEEGTKSSGLGACEWLLVLISLLFIIMTFPFSIWFCVKVVQEYERVIIFRLGHLLPGRAKGPGLFFFLPCLDTYHKVDLRLQTLEIPFHEVALDSVTCIWGIKVERIEIKDVRLPAGLQHSLAVEAEAQRQAKVRMIAAEAEKAASESLRMAAEILSGTPAAVQLRYLHTLQSLSTEKPSTVVLPLPFDLLNCLSSPSNRTQGSLPFPSPSKPVEPLNPKKKDSPML

SEQ ID NO: 55891 - protein, 241 aa, Homo sapiens
  Payload ID: 10995
  Gene Symbol: NGF
  Gene Name: nerve growth factor (beta polypeptide)
  Uniprot ID: P01138
  ENSP ID: ENSP00000358525
MSMLFYTLITAFLIGIQAEPHSESNVPAGHTIPQAHWTKLQHSLDTALRRARSAPAAAIAARVAGQTRNITVDPRLFKKRRLRSPRVLFSTQPPREAADTQDLDFEVGGAAPFNRTHRSKRSSSHPIFHRGEFSVCDSVSVWVGDKTTATDIKGKEVMVLGEVNINNSVFKQYFFETKCRDPNPVDSGCRGIDSKHWNSYCTTTHTFVKALTMDGKQAAWRFIRIDTACVCVLSRKAVRRA

SEQ ID NO: 55892 - protein, 427 aa, Homo sapiens
  Payload ID: 10996
  Gene Symbol: NGFR
  Gene Name: nerve growth factor receptor
  Uniprot ID: P08138
  ENSP ID: ENSP00000172229
MGAGATGRAMDGPRLLLLLLLGVSLGGAKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEIPGRWITRSTPPEGSDSTAPSTQEPEAPPEQDLIASTVAGVVTTVMGSSQPVVTRGTTDNLIPVYCSILAAVVVGLVAYIAFKRWNSCKQNKQGANSRPVNQTPPPEGEKLHSDSGISVDSQSLHDQQPHTQTASGQALKGDGGLYSSLPPAKREEVEKLLNGSAGDTWRHLAGELGYQPEHIDSFTHEACPVRALLASWATQDSATLDALLAALRRIQRADLVESLCSESTATSPV

SEQ ID NO: 55893 - protein, 4 aa, Homo sapiens
  Payload ID: 10996
  Gene Symbol: NGFR
  Gene Name: nerve growth factor receptor
  ENSP ID: ENSP00000421514
MSAP

SEQ ID NO: 55894 - protein, 333 aa, Homo sapiens
  Payload ID: 10996
  Gene Symbol: NGFR
  Gene Name: nerve growth factor receptor
  Uniprot ID: P08138
  ENSP ID: ENSP00000421731
MSAPCVEADDAVCRCAYGYYQDETTGRCEACRVCEAGSGLVFSCQDKQNTVCEECPDGTYSDEANHVDPCLPCTVCEDTERQLRECTRWADAECEEIPGRWITRSTPPEGSDSTAPSTQEPEAPPEQDLIASTVAGVVTTVMGSSQPVVTRGTTDNLIPVYCSILAAVVVGLVAYIAFKRWNSCKQNKQGANSRPVNQTPPPEGEKLHSDSGISVDSQSLHDQQPHTQTASGQALKGDGGLYSSLPPAKREEVEKLLNGSAGDTWRHLAGELGYQPEHIDSFTHEACPVRALLASWATQDSATLDALLAALRRIQRADLVESLCSESTATSPV

SEQ ID NO: 55895 - protein, 101 aa, Homo sapiens
  Payload ID: 10997
  Gene Symbol: NGFRAP1
  Gene Name: nerve growth factor receptor (TNFRSF16) associated protein 1
  Uniprot ID: Q00994
  ENSP ID: ENSP00000354843
MEQPMQNGEEDRPLGGGEGHQPAGNRRGQARRLAPNFRWAIPNRQINDGMGGDGDDMEIFMEEMREIRRKLRELQLRNCLRILMGELSNHHDHHDEFCLMP

SEQ ID NO: 55896 - protein, 101 aa, Homo sapiens; identical to SEQ ID NO: 55895
  Payload ID: 10997
  Gene Symbol: NGFRAP1
  Gene Name: nerve growth factor receptor (TNFRSF16) associated protein 1
  Uniprot ID: Q00994
  ENSP ID: ENSP00000361717

SEQ ID NO: 55897 - protein, 111 aa, Homo sapiens
  Payload ID: 10997
  Gene Symbol: NGFRAP1
  Gene Name: nerve growth factor receptor (TNFRSF16) associated protein 1
  Uniprot ID: Q00994
  ENSP ID: ENSP00000361718
MANIHQENEEMEQPMQNGEEDRPLGGGEGHQPAGNRRGQARRLAPNFRWAIPNRQINDGMGGDGDDMEIFMEEMREIRRKLRELQLRNCLRILMGELSNHHDHHDEFCLMP

SEQ ID NO: 55898 - protein, 111 aa, Homo sapiens; identical to SEQ ID NO: 55897
  Payload ID: 10997
  Gene Symbol: NGFRAP1
  Gene Name: nerve growth factor receptor (TNFRSF16) associated protein 1
  Uniprot ID: Q00994
  ENSP ID: ENSP00000361728

SEQ ID NO: 55899 - protein, 133 aa, Homo sapiens
  Payload ID: 10998
  Gene Symbol: NHLH1
  Gene Name: nescient helix loop helix 1
  Uniprot ID: Q02575
  ENSP ID: ENSP00000302189
MMLNSDTMELDLPPTHSETESGFSDCGGGAGPDGAGPGGPGGGQARGPEPGEPGRKDLQHLSREERRRRRRATAKYRTAHATRERIRVEAFNLAFAELRKLLPTLPPDKKLSKIEILRLAICYISYLNHVLDV

SEQ ID NO: 55900 - protein, 135 aa, Homo sapiens
  Payload ID: 10999
  Gene Symbol: NHLH2
  Gene Name: nescient helix loop helix 2
  Uniprot ID: Q02577
  ENSP ID: ENSP00000322087
MMLSPDQAADSDHPSSAHSDPESLGGTDTKVLGSVSDLEPVEEAEGDGKGGSRAALYPHPQQLSREEKRRRRRATAKYRSAHATRERIRVEAFNLAFAELRKLLPTLPPDKKLSKIEILRLAICYISYLNHVLDV

SEQ ID NO: 55901 - protein, 135 aa, Homo sapiens; identical to SEQ ID NO: 55900
  Payload ID: 10999
  Gene Symbol: NHLH2
  Gene Name: nescient helix loop helix 2
  Uniprot ID: Q02577
  ENSP ID: ENSP00000358519

SEQ ID NO: 55902 - protein, 107 aa, Homo sapiens
  Payload ID: 10999
  Gene Symbol: NHLH2
  Gene Name: nescient helix loop helix 2
  ENSP ID: ENSP00000405062
MMLSPDQAADSDHPSSAHSDPESLGGTDTKVLGSVSDLEPVEEAEGDGKGGSRAALYPHPQQLSREEKRRRRRATAKYRSAHATRERIRVEAFNLAFAELRKLLPTL

SEQ ID NO: 55903 - protein, 1621 aa, Homo sapiens
  Payload ID: 11000
  Gene Symbol: NES
  Gene Name: nestin
  Uniprot ID: P48681
  ENSP ID: ENSP00000357206
MEGCMGEESFQMWELNRRLEAYLARVKALEEQNELLSAELGGLRAQSADTSWRAHADDELAALRALVDQRWREKHAAEVARDNLAEELEGVAGRCQQLRLARERTTEEVARNRRAVEAEKCARAWLSSQVAELERELEALRVAHEEERVGLNAQAACAPRCPAPPRGPPAPAPEVEELARRLGEAWRGAVRGYQERVAHMETSLGQARERLGRAVQGAREGRLELQQLQAERGGLLERRAALEQRLEGRWQERLRATEKFQLAVEALEQEKQGLQSQIAQVLEGRQQLAHLKMSLSLEVATYRTLLEAENSRLQTPGGGSKTSLSFQDPKLELQFPRTPEGRRLGSLLPVLSPTSLPSPLPATLETPVPAFLKNQEFLQARTPTLASTPIPPTPQAPSPAVDAEIRAQDAPLSLLQTQGGRKQAPEPLRAEARVAIPASVLPGPEEPGGQRQEASTGQSPEDHASLAPPLSPDHSSLEAKDGESGGSRVFSICRGEGEGQIWGLVEKETAIEGKVVSSLQQEIWEEEDLNRKEIQDSQVPLEKETLKSLGEEIQESLKTLENQSHETLERENQECPRSLEEDLETLKSLEKENKELLKDVEVVRPLEKEAVGQLKPTGKEDTQTLQSLQKENQELMKSLEGNLETFLFPGTENQELVSSLQENLESLTALEKENQEPLRSPEVGDEEALRPLTKENQEPLRSLEDENKEAFRSLEKENQEPLKTLEEEDQSIVRPLETENHKSLRSLEEQDQETLRTLEKETQQRRRSLGEQDQMTLRPPEKVDLEPLKSLDQEIARPLENENQEFLKSLKEESVEAVKSLETEILESLKSAGQENLETLKSPETQAPLWTPEEINQGAMNPLEKEIQEPLESVEVNQETFRLLEEENQESLRSLGAWNLENLRSPEEVDKESQRNLEEEENLGKGEYQESLRSLEEEGQELPQSADVQRWEDTVEKDQELAQESPPGMAGVENEDEAELNLREQDGFTGKEEVVEQGELNATEEVWIPGEGHPESPEPKEQRGLVEGASVKGGAEGLQDPEGQSQQVGAPGLQAPQGLPEAIEPLVEDDVAPGGDQASPEVMLGSEPAMGESAAGAEPGPGQGVGGLGDPGHLTREEVMEPPLEEESLEAKRVQGLEGPRKDLEEAGGLGTEFSELPGKSRDPWEPPREGREESEAEAPRGAEEAFPAETLGHTGSDAPSPWPLGSEEAEEDVPPVLVSPSPTYTPILEDAPGPQPQAEGSQEASWGVQGRAEALGKVESEQEELGSGEIPEGPQEEGEESREESEEDELGETLPDSTPLGFYLRSPTSPRWDPTGEQRPPPQGETGKEGWDPAVLASEGLEAPPSEKEEGEEGEEECGRDSDLSEEFEDLGTEAPFLPGVPGEVAEPLGQVPQLLLDPAAWDRDGESDGFADEEESGEEGEEDQEEGREPGAGRWGPGSSVGSLQALSSSQRGEFLESDSVSVSVPWDDSLRGAVAGAPKTALETESQDSAEPSGSEEESDPVSLEREDKVPGPLEIPSGMEDAGPGADIIGVNGQGPNLEGKSQHVNGGVMNGLEQSEEVGQGMPLVSEGDRGSPFQEEEGSALKTSWAGAPVHLGQGQFLKFTQREGDRESWSSGED

SEQ ID NO: 55904 - protein, 744 aa, Homo sapiens
  Payload ID: 11001
  Gene Symbol: NSF
  Gene Name: N-ethylmaleimide-sensitive factor
  Uniprot ID: P46459
  ENSP ID: ENSP00000381293
MAGRSMQAARCPTDELSLTNCAVVNEKDFQSGQHVIVRTSPNHRYTFTLKTHPSVVPGSIAFSLPQRKWAGLSIGQEIEVSLYTFDKAKQCIGTMTIEIDFLQKKSIDSNPYDTDKMAAEFIQQFNNQAFSVGQQLVFSFNEKLFGLLVKDIEAMDPSILKGEPATGKRQKIEVGLVVGNSQVAFEKAENSSLNLIGKAKTKENRQSIINPDWNFEKMGIGGLDKEFSDIFRRAFASRVFPPEIVEQMGCKHVKGILLYGPPGCGKTLLARQIGKMLNAREPKVVNGPEILNKYVGESEANIRKLFADAEEEQRRLGANSGLHIIIFDEIDAICKQRGSMAGSTGVHDTVVNQLLSKIDGVEQLNNILVIGMTNRPDLIDEALLRPGRLEVKMEIGLPDEKGRLQILHIHTARMRGHQLLSADVDIKELAVETKNFSGAELEGLVRAAQSTAMNRHIKASTKVEVDMEKAESLQVTRGDFLASLENDIKPAFGTNQEDYASYIMNGIIKWGDPVTRVLDDGELLVQQTKNSDRTPLVSVLLEGPPHSGKTALAAKIAEESNFPFIKICSPDKMIGFSETAKCQAMKKIFDDAYKSQLSCVVVDDIERLLDYVPIGPRFSNLVLQALLVLLKKAPPQGRKLLIIGTTSRKDVLQEMEMLNAFSTTIHVPNIATGEQLLEALELLGNFKDKERTTIAQQVKGKKVWIGIKKLLMLIEMSLQMDPEYRVRKFLALLREEGASPLDFD

SEQ ID NO: 55905 - protein, 161 aa, Homo sapiens
  Payload ID: 11001
  Gene Symbol: NSF
  Gene Name: N-ethylmaleimide-sensitive factor
  ENSP ID: ENSP00000458184
MQAARCPTDELSLTNCAVVNEKDFQSGQHVIVRTSPNHRYTFTLKTHPSVVPGSIAFSLPQRKWAGLSIGQEIEVSLYTFDKAKQCIGTMTIEIDFLQKKSIDSNPYDTDKMAAEFIQQFNNQAFSVGQQLVFSFNEKLFGLLVKDIEAMDPSILKGEPAT

SEQ ID NO: 55906 - protein, 739 aa, Homo sapiens
  Payload ID: 11001
  Gene Symbol: NSF
  Gene Name: N-ethylmaleimide-sensitive factor
  ENSP ID: ENSP00000458221
MQAARCPTDELSLTNCAVVNEKDFQSGQHVIVRTSPNHRYTFTLKTHPSVVPGSIAFSLPQRKWAGLSIGQEIEVSLYTFDKAKQCIGTMTIEIDFLQKKSIDSNPYDTDKMAAEFIQQFNNQAFSVGQQLVFSFNEKLFGLLVKDIEAMDPSILKGEPATGKRQKIEVGLVVGNSQVAFEKAENSSLNLIGKAKTKENRQSIINPDWNFEKMGIGGLDKEFSDIFRRAFASRVFPPEIVEQMGCKHVKGILLYGPPGCGKTLLARQIGKMLNAREPKVVNGPEILNKYVGESEANIRKLFADAEEEQRRLGANSGLHIIIFDEIDAICKQRGSMAGSTGVHDTVVNQLLSKIDGVEQLNNILVIGMTNRPDLIDEALLRPGRLEVKMEIGLPDEKGRLQILHIHTARMRGHQLLSADVDIKELAVETKNFSGAELEGLVRAAQSTAMNRHIKASTKVEVDMEKAESLQVTRGDFLASLENDIKPAFGTNQEDYASYIMNGIIKWGDPVTRVLDDGELLVQQTKNSDRTPLVSVLLEGPPHSGKTALAAKIAEESNFPFIKICSPDKMIGFSETAKCQAMKKIFDDAYKSQLSCVVVDDIERLLDYVPIGPRFSNLVLQALLVLLKKAPPQGRKLLIIGTTSRKDVLQEMEMLNAFSTTIHVPNIATGEQLLEALELLGNFKDKERTTIAQQVKGKKVWIGIKKLLMLIEMSLQMDPEYRVRKFLALLREEGASPLDFD

SEQ ID NO: 55907 - protein, 136 aa, Homo sapiens
  Payload ID: 11001
  Gene Symbol: NSF
  Gene Name: N-ethylmaleimide-sensitive factor
  ENSP ID: ENSP00000459646
MIGFSETAKCQAMKKIFDDAYKSQLSCVVVDDIERLLDYVPIGPRFSNLVLQALLVLLKKAPPQGRKLLIIGTTSRKDVLQEMEMLNAFSTTIHVPNIATGEQLLEALELLGNFKDKERTTIAQQVKGKKVWIGIK

SEQ ID NO: 55908 - protein, 44 aa, Homo sapiens
  Payload ID: 11001
  Gene Symbol: NSF
  Gene Name: N-ethylmaleimide-sensitive factor
  ENSP ID: ENSP00000460152
MQAARCPTDELSLTNCAVVNEKDFQSGQHVIVRTSPNHRYTFTL

SEQ ID NO: 55909 - protein, 81 aa, Homo sapiens
  Payload ID: 11001
  Gene Symbol: NSF
  Gene Name: N-ethylmaleimide-sensitive factor
  ENSP ID: ENSP00000461448
MAGRSMQAARCPTDELSLTNCAVVNEKDFQSGQHVIVRTSPNHRYTFTLKTHPSVVPGSIAFSLPQSPYIHLTKPNSVLAQ

SEQ ID NO: 55910 - protein, 180 aa, Homo sapiens
  Payload ID: 11001
  Gene Symbol: NSF
  Gene Name: N-ethylmaleimide-sensitive factor
  ENSP ID: ENSP00000467779
  MOD_RES (1)..(1): Any amino acid
XDAYKSQLSCVVVDDIERLLDYVPIGPRFSNLVLQALLVLLKKAPPQGRKLLIIGTTSRKDVLQEMEMLNAFSTTIHVPNIATGEQLLEALELLGNFKDKERTTIAQQVKGKKVWIGIKKLLMLIEMSLQMDPEYRVRKFLALLREEGASERPSKEVGCTVGLLSLSCFAKLPCHNAGKT

SEQ ID NO: 55911 - protein, 744 aa, Homo sapiens; identical to SEQ ID NO: 55904
  Payload ID: 11001
  Gene Symbol: NSF
  Gene Name: N-ethylmaleimide-sensitive factor
  Uniprot ID: P46459
  ENSP ID: ENSP00000478614

SEQ ID NO: 55912 - protein, 744 aa, Homo sapiens; identical to SEQ ID NO: 55904
  Payload ID: 11001
  Gene Symbol: NSF
  Gene Name: N-ethylmaleimide-sensitive factor
  Uniprot ID: P46459
  ENSP ID: ENSP00000481714

SEQ ID NO: 55913 - protein, 739 aa, Homo sapiens; identical to SEQ ID NO: 55906
  Payload ID: 11001
  Gene Symbol: NSF
  Gene Name: N-ethylmaleimide-sensitive factor
  ENSP ID: ENSP00000486150

SEQ ID NO: 55914 - protein, 136 aa, Homo sapiens; identical to SEQ ID NO: 55907
  Payload ID: 11001
  Gene Symbol: NSF
  Gene Name: N-ethylmaleimide-sensitive factor
  ENSP ID: ENSP00000486400

SEQ ID NO: 55915 - protein, 161 aa, Homo sapiens; identical to SEQ ID NO: 55905
  Payload ID: 11001
  Gene Symbol: NSF
  Gene Name: N-ethylmaleimide-sensitive factor
  ENSP ID: ENSP00000486903

SEQ ID NO: 55916 - protein, 44 aa, Homo sapiens; identical to SEQ ID NO: 55908
  Payload ID: 11001
  Gene Symbol: NSF
  Gene Name: N-ethylmaleimide-sensitive factor
  ENSP ID: ENSP00000487064

SEQ ID NO: 55917 - protein, 81 aa, Homo sapiens; identical to SEQ ID NO: 55909
  Payload ID: 11001
  Gene Symbol: NSF
  Gene Name: N-ethylmaleimide-sensitive factor
  ENSP ID: ENSP00000487474

SEQ ID NO: 55918 - protein, 180 aa, Homo sapiens; identical to SEQ ID NO: 55910
  Payload ID: 11001
  Gene Symbol: NSF
  Gene Name: N-ethylmaleimide-sensitive factor
  ENSP ID: ENSP00000487479
  MOD_RES (1)..(1): Any amino acid

SEQ ID NO: 55919 - protein, 44 aa, Homo sapiens; identical to SEQ ID NO: 55908
  Payload ID: 11001
  Gene Symbol: NSF
  Gene Name: N-ethylmaleimide-sensitive factor
  ENSP ID: ENSP00000487668

SEQ ID NO: 55920 - protein, 739 aa, Homo sapiens; identical to SEQ ID NO: 55906
  Payload ID: 11001
  Gene Symbol: NSF
  Gene Name: N-ethylmaleimide-sensitive factor
  ENSP ID: ENSP00000488015

SEQ ID NO: 55921 - protein, 161 aa, Homo sapiens; identical to SEQ ID NO: 55905
  Payload ID: 11001
  Gene Symbol: NSF
  Gene Name: N-ethylmaleimide-sensitive factor
  ENSP ID: ENSP00000488185

SEQ ID NO: 55922 - protein, 180 aa, Homo sapiens; identical to SEQ ID NO: 55910
  Payload ID: 11001
  Gene Symbol: NSF
  Gene Name: N-ethylmaleimide-sensitive factor
  ENSP ID: ENSP00000488480
  MOD_RES (1)..(1): Any amino acid

SEQ ID NO: 55923 - protein, 81 aa, Homo sapiens; identical to SEQ ID NO: 55909
  Payload ID: 11001
  Gene Symbol: NSF
  Gene Name: N-ethylmaleimide-sensitive factor
  ENSP ID: ENSP00000488517

SEQ ID NO: 55924 - protein, 295 aa, Homo sapiens
  Payload ID: 11002
  Gene Symbol: NAPA
  Gene Name: N-ethylmaleimide-sensitive factor attachment protein, alpha
  Uniprot ID: P54920
  ENSP ID: ENSP00000263354
MDNSGKEAEAMALLAEAERKVKNSQSFFSGLFGGSSKIEEACEIYARAANMFKMAKNWSAAGNAFCQAAQLHLQLQSKHDAATCFVDAGNAFKKADPQEAINCLMRAIEIYTDMGRFTIAAKHHISIAEIYETELVDIEKAIAHYEQSADYYKGEESNSSANKCLLKVAGYAALLEQYQKAIDIYEQVGTNAMDSPLLKYSAKDYFFKAALCHFCIDMLNAKLAVQKYEELFPAFSDSRECKLMKKLLEAHEEQNVDSYTESVKEYDSISRLDQWLTTMLLRIKKTIQGDEEDLR

SEQ ID NO: 55925 - protein, 35 aa, Homo sapiens
  Payload ID: 11002
  Gene Symbol: NAPA
  Gene Name: N-ethylmaleimide-sensitive factor attachment protein, alpha
  ENSP ID: ENSP00000470654
MDNSGKEAEAMALLAEAERKVKNSQSFFSGLFGGH

SEQ ID NO: 55926 - protein, 60 aa, Homo sapiens
  Payload ID: 11002
  Gene Symbol: NAPA
  Gene Name: N-ethylmaleimide-sensitive factor attachment protein, alpha
  ENSP ID: ENSP00000470665
MDNSGKEAEAMALLAEAERKVKNSQSFFSGLFGPHPDPTERIPKCVAVGLWFDEMSTSCG

SEQ ID NO: 55927 - protein, 102 aa, Homo sapiens
  Payload ID: 11002
  Gene Symbol: NAPA
  Gene Name: N-ethylmaleimide-sensitive factor attachment protein, alpha
  ENSP ID: ENSP00000470946
MRAIEIYTDMGRFTIAAKHHISIAEIYETELVDIEKAIAHYEQSADYYKGEESNSSANKCLLKVAGYAALLEQYQKAIDIYEQVGTNAMDSPLLKYSAKDYF

SEQ ID NO: 55928 - protein, 74 aa, Homo sapiens
  Payload ID: 11002
  Gene Symbol: NAPA
  Gene Name: N-ethylmaleimide-sensitive factor attachment protein, alpha
  ENSP ID: ENSP00000470954
MDNSGKEAEAMALLAEAERKVKNSQSFFSGLFGCWKRVLPGCTAAPAAPEQARRSHLLCGRWQRIQESRPPRGH

SEQ ID NO: 55929 - protein, 137 aa, Homo sapiens
  Payload ID: 11002
  Gene Symbol: NAPA
  Gene Name: N-ethylmaleimide-sensitive factor attachment protein, alpha
  ENSP ID: ENSP00000471018
MFKMAKNWSAAGNAFCQAAQLHLQLQSKHDAATCFVDAGNAFKKADPQEAINCLMRAIEIYTDMGRFTIAAKHHISIAEIYETELVDIEKAIAHYEQSADYYKGEESNSSANKCLLKVAGYAALLEQYQKAIDIYEQ

SEQ ID NO: 55930 - protein, 139 aa, Homo sapiens
  Payload ID: 11002
  Gene Symbol: NAPA
  Gene Name: N-ethylmaleimide-sensitive factor attachment protein, alpha
  ENSP ID: ENSP00000471261
  MOD_RES (1)..(1): Any amino acid
XAGNAFCQAAQLHLQLQSKHDAATCFVDAGNAFKKADPQEAINCLMRAIEIYTDMGRFTIAAKHHISIAEIYETELVDIEKVGTNAMDSPLLKYSAKDYFFKAALCHFCIDMLNAKLAVQKYEELFPAFSDSRECKLMK

SEQ ID NO: 55931 - protein, 256 aa, Homo sapiens
  Payload ID: 11002
  Gene Symbol: NAPA
  Gene Name: N-ethylmaleimide-sensitive factor attachment protein, alpha
  ENSP ID: ENSP00000471520
MDNSGKEAEAMALLAEAERKVKNSQSFFSGLFGGSSKIEEACEIYARAANMFKMAKNWSEAINCLMRAIEIYTDMGRFTIAAKHHISIAEIYETELVDIEKAIAHYEQSADYYKGEESNSSANKCLLKVAGYAALLEQYQKAIDIYEQVGTNAMDSPLLKYSAKDYFFKAALCHFCIDMLNAKLAVQKYEELFPAFSDSRECKLMKKLLEAHEEQNVDSYTESVKEYDSISRLDQWLTTMLLRIKKTIQGDEEDLR

SEQ ID NO: 55932 - protein, 83 aa, Homo sapiens
  Payload ID: 11002
  Gene Symbol: NAPA
  Gene Name: N-ethylmaleimide-sensitive factor attachment protein, alpha
  ENSP ID: ENSP00000472235
HFCIDMLNAKLAVQKYEELFPAFSDSRECKLMKKLLEAHEEQNVDSYTESVKEYDSISRLDQWLTTMLLRIKKTIQGDEEDLR

SEQ ID NO: 55933 - protein, 268 aa, Homo sapiens
  Payload ID: 11002
  Gene Symbol: NAPA
  Gene Name: N-ethylmaleimide-sensitive factor attachment protein, alpha
  ENSP ID: ENSP00000472667
MDNSGKEAEAMALLAEAERKVKNSQSFFSGLFGGSSKIEEACEIYARAANMFKMAKNWSGMSSPLELLQAAGNAFCQAAQLHLQLQSKHDAATCFVDAGNAFKKADPQEAINCLMRAIEIYTDMGRFTIAAKHHISIAEIYETELVDIEKAIAHYEQSADYYKGEESNSSANKCLLKVAGYAALLEQYQKAIDIYEQVGTNAMDSPLLKYSAKDYFFKAALCHFCIDMLNAKLAVQKYEELFPAFSDSRECKLMKKLLEAHEEQNVDS

SEQ ID NO: 55934 - protein, 298 aa, Homo sapiens
  Payload ID: 11003
  Gene Symbol: NAPB
  Gene Name: N-ethylmaleimide-sensitive factor attachment protein, beta
  Uniprot ID: Q9H115
  ENSP ID: ENSP00000366225
MDNAGKEREAVQLMAEAEKRVKASHSFLRGLFGGNTRIEEACEMYTRAANMFKMAKNWSAAGNAFCQAAKLHMQLQSKHDSATSFVDAGNAYKKADPQEAINCLNAAIDIYTDMGRFTIAAKHHITIAEIYETELVDIEKAIAHYEQSADYYKGEESNSSANKCLLKVAAYAAQLEQYQKAIEIYEQVGANTMDNPLLKYSAKDYFFKAALCHFIVDELNAKLALEKYEEMFPAFTDSRECKLLKKLLEAHEEQNSEAYTEAVKEFDSISRLDQWLTTMLLRIKKSIQGDGEGDGDLK

SEQ ID NO: 55935 - protein, 204 aa, Homo sapiens
  Payload ID: 11003
  Gene Symbol: NAPB
  Gene Name: N-ethylmaleimide-sensitive factor attachment protein, beta
  Uniprot ID: Q9H115
  ENSP ID: ENSP00000381459
MTLLPALWMLEMLTKRQIPKGRFTIAAKHHITIAEIYETELVDIEKAIAHYEQSADYYKGEESNSSANKCLLKVAAYAAQLEQYQKAIEIYEQVGANTMDNPLLKYSAKDYFFKAALCHFIVDELNAKLALEKYEEMFPAFTDSRECKLLKKLLEAHEEQNSEAYTEAVKEFDSISRLDQWLTTMLLRIKKSIQGDGEGDGDLK

SEQ ID NO: 55936 - protein, 259 aa, Homo sapiens
  Payload ID: 11003
  Gene Symbol: NAPB
  Gene Name: N-ethylmaleimide-sensitive factor attachment protein, beta
  Uniprot ID: Q9H115
  ENSP ID: ENSP00000413600
MDNAGKEREAVQLMAEAEKRVKASHSFLRGLFGGNTRIEEACEMYTRAANMFKMAKNWSEAINCLNAAIDIYTDMGRFTIAAKHHITIAEIYETELVDIEKAIAHYEQSADYYKGEESNSSANKCLLKVAAYAAQLEQYQKAIEIYEQVGANTMDNPLLKYSAKDYFFKAALCHFIVDELNAKLALEKYEEMFPAFTDSRECKLLKKLLEAHEEQNSEAYTEAVKEFDSISRLDQWLTTMLLRIKKSIQGDGEGDGDLK

SEQ ID NO: 55937 - protein, 302 aa, Homo sapiens
  Payload ID: 11003
  Gene Symbol: NAPB
  Gene Name: N-ethylmaleimide-sensitive factor attachment protein, beta
  ENSP ID: ENSP00000482826
MDNAGKEREAVQLMAEAEKRVKASHSFLRGLFGGNTRIEEACEMYTRAANMFKMAKNWSVSSSAAGNAFCQAAKLHMQLQSKHDSATSFVDAGNAYKKADPQEAINCLNAAIDIYTDMGRFTIAAKHHITIAEIYETELVDIEKAIAHYEQSADYYKGEESNSSANKCLLKVAAYAAQLEQYQKAIEIYEQVGANTMDNPLLKYSAKDYFFKAALCHFIVDELNAKLALEKYEEMFPAFTDSRECKLLKKLLEAHEEQNSEAYTEAVKEFDSISRLDQWLTTMLLRIKKSIQGDGEGDGDLK

SEQ ID NO: 55938 - protein, 312 aa, Homo sapiens
  Payload ID: 11004
  Gene Symbol: NAPG
  Gene Name: N-ethylmaleimide-sensitive factor attachment protein, gamma
  Uniprot ID: Q99747
  ENSP ID: ENSP00000324628
MAAQKINEGLEHLAKAEKYLKTGFLKWKPDYDSAASEYGKAAVAFKNAKQFEQAKDACLREAVAHENNRALFHAAKAYEQAGMMLKEMQKLPEAVQLIEKASMMYLENGTPDTAAMALERAGKLIENVDPEKAVQLYQQTANVFENEERLRQAVELLGKASRLLVRGRRFDEAALSIQKEKNIYKEIENYPTCYKKTIAQVLVHLHRNDYVAAERCVRESYSIPGFNGSEDCAALEQLLEGYDQQDQDQVSDVCNSPLFKYMDNDYAKLGLSLVVPGGGIKKKSPATPQAKPDGVTATAADEEEDEYSGGLC

SEQ ID NO: 55939 - protein, 177 aa, Homo sapiens
  Payload ID: 11004
  Gene Symbol: NAPG
  Gene Name: N-ethylmaleimide-sensitive factor attachment protein, gamma
  ENSP ID: ENSP00000463018
MSSGEQHRSVENHRPRRAPCVEGTIGLPQKLLGEPLSSGILLSLWAGTVLRSSFDVYVLPPLVHLKTGFLKWKPDYDSAASEYGKAAVAFKNAKQFEQAKDACLREAVAHENNRALFHAAKAYEQAGMMLKEMQKLPEAVQLIEKASMMYLENGTPDTAAMALERAGKLIENVDPEK

SEQ ID NO: 55940 - protein, 22 aa, Homo sapiens
  Payload ID: 11004
  Gene Symbol: NAPG
  Gene Name: N-ethylmaleimide-sensitive factor attachment protein, gamma
  ENSP ID: ENSP00000463265
MAAQKINEGLEHLAKAEKYCCF

SEQ ID NO: 55941 - protein, 18 aa, Homo sapiens
  Payload ID: 11004
  Gene Symbol: NAPG
  Gene Name: N-ethylmaleimide-sensitive factor attachment protein, gamma
  ENSP ID: ENSP00000464496
MAAQKINEGLEHLAKAEK

SEQ ID NO: 55942 - protein, 604 aa, Homo sapiens
  Payload ID: 11005
  Gene Symbol: NTN1
  Gene Name: netrin 1
  Uniprot ID: O95631
  ENSP ID: ENSP00000173229
MMRAVWEALAALAAVACLVGAVRGGPGLSMFAGQAAQPDPCSDENGHPRRCIPDFVNAAFGKDVRVSSTCGRPPARYCVVSERGEERLRSCHLCNASDPKKAHPPAFLTDLNNPHNLTCWQSENYLQFPHNVTLTLSLGKKFEVTYVSLQFCSPRPESMAIYKSMDYGRTWVPFQFYSTQCRKMYNRPHRAPITKQNEQEAVCTDSHTDMRPLSGGLIAFSTLDGRPSAHDFDNSPVLQDWVTATDIRVAFSRLHTFGDENEDDSELARDSYFYAVSDLQVGGRCKCNGHAARCVRDRDDSLVCDCRHNTAGPECDRCKPFHYDRPWQRATAREANECVACNCNLHARRCRFNMELYKLSGRKSGGVCLNCRHNTAGRHCHYCKEGYYRDMGKPITHRKACKACDCHPVGAAGKTCNQTTGQCPCKDGVTGITCNRCAKGYQQSRSPIAPCIKIPVAPPTTAASSVEEPEDCDSYCKASKGKLKINMKKYCKKDYAVQIHILKADKAGDWWKFTVNIISVYKQGTSRIRRGDQSLWIRSRDIACKCPKIKPLKKYLLLGNAEDSPDQSGIVADKSSLVIQWRDTWARRLRKFQQREKKGKCKKA

SEQ ID NO: 55943 - protein, 153 aa, Homo sapiens
  Payload ID: 11005
  Gene Symbol: NTN1
  Gene Name: netrin 1
  ENSP ID: ENSP00000389375
HYCKEGYYRDMGKPITHRKACKACDCHPVGAAGKTCNQTTGQCPCKDGVTGITCNRCAKGYQQSRSPIAPCIKIPVAPPTTAASSVEEPEAARQPNTFQAEGLSLLPGAAEKEGARCWGYRRRLGHRVAQAECRGPRSWAWGRITSSFSFASN

SEQ ID NO: 55944 - protein, 580 aa, Homo sapiens
  Payload ID: 11006
  Gene Symbol: NTN3
  Gene Name: netrin 3
  Uniprot ID: O00634
  ENSP ID: ENSP00000293973
MPGWPWGLLLTAGTLFAALSPGPPAPADPCHDEGGAPRGCVPGLVNAALGREVLASSTCGRPATRACDASDPRRAHSPALLTSPGGTASPLCWRSESLPRAPLNVTLTVPLGKAFELVFVSLRFCSAPPASVALLKSQDHGRSWAPLGFFSSHCDLDYGRLPAPANGPAGPGPEALCFPAPLAQPDGSGLLAFSMQDSSPPGLDLDSSPVLQDWVTATDVRVVLTRPSTAGDPRDMEAVVPYSYAATDLQVGGRCKCNGHASRCLLDTQGHLICDCRHGTEGPDCGRCKPFYCDRPWQRATARESHACLACSCNGHARRCRFNMELYRLSGRRSGGVCLNCRHNTAGRHCHYCREGFYRDPGRALSDRRACRACDCHPVGAAGKTCNQTTGQCPCKDGVTGLTCNRCAPGFQQSRSPVAPCVKTPIPGPTEDSSPVQPQDCDSHCKPARGSYRISLKKFCKKDYAVQVAVGARGEARGAWTRFPVAVLAVFRSGEERARRGSSALWVPAGDAACGCPRLLPGRRYLLLGGGPGAAAGGAGGRGPGLIAARGSLVLPWRDAWTRRLRRLQRRERRGRCSAA

SEQ ID NO: 55945 - protein, 591 aa, Homo sapiens
  Payload ID: 11007
  Gene Symbol: NTN4
  Gene Name: netrin 4
  Uniprot ID: Q9HB63
  ENSP ID: ENSP00000339436
MGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTCKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 55946 - protein, 628 aa, Homo sapiens
  Payload ID: 11007
  Gene Symbol: NTN4
  Gene Name: netrin 4
  Uniprot ID: Q9HB63
  ENSP ID: ENSP00000340998
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTCKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 55947 - protein, 591 aa, Homo sapiens; identical to SEQ ID NO: 55945
  Payload ID: 11007
  Gene Symbol: NTN4
  Gene Name: netrin 4
  Uniprot ID: Q9HB63
  ENSP ID: ENSP00000444432

SEQ ID NO: 55948 - protein, 605 aa, Homo sapiens
  Payload ID: 11007
  Gene Symbol: NTN4
  Gene Name: netrin 4
  Uniprot ID: Q9HB63
  ENSP ID: ENSP00000447292
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTCKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 55949 - protein, 176 aa, Homo sapiens
  Payload ID: 11007
  Gene Symbol: NTN4
  Gene Name: netrin 4
  ENSP ID: ENSP00000447594
MGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSA

SEQ ID NO: 55950 - protein, 489 aa, Homo sapiens
  Payload ID: 11008
  Gene Symbol: NTN5
  Gene Name: netrin 5
  Uniprot ID: Q8WTR8
  ENSP ID: ENSP00000270235
MPVTFALLLLLGQATADPCYDPQGRPQFCLPPVTQLAAVAASCPQACALSPGNHLGARETCNGSLTLALGGPFLLTSVSLRFCTPGPPALILSAAWASGGPWRLLWHRPAWPGALGGPERVTFHSTPGPKATVAASHLRVEFGGQAGLAAAGLRGRCQCHGHAARCAARARPPRCHCRHHTTGPGCESCRPSHRDWPWRPATPRHPHPCLPCSCNQHARRCRFNSELFRLSGGRSGGVCERCRHHTAGRHCHYCQPGFWRDPSQPIFSRRACRACQCHPIGATGGTCNQTSGQCTCKLGVTGLTCNRCGPGYQQSRSPRMPCQRIPEATTTLATTPGAYSSDPQCQNYCNMSDTRVHMSLRRYCQQDHVLRAQVLASEAAGPAWQRLAVRVLAVYKQRAQPVRRGDQDAWVPRADLTCGCLRLQPGTDYLLLGSAVGDPDPTRLILDRHGLALPWRPRWARPLKRLQQEERAGGCRGVRAPTPSPRPEH

SEQ ID NO: 55951 - protein, 75 aa, Homo sapiens
  Payload ID: 11008
  Gene Symbol: NTN5
  Gene Name: netrin 5
  ENSP ID: ENSP00000469490
MPCQRIPEATTTLATTPGAYSSDPQCQNYCNMSDTRVHMSLRRYCQQDHVLRAQVLASEAAGPAWQRLAVRVLAV

SEQ ID NO: 55952 - protein, 494 aa, Homo sapiens
  Payload ID: 11009
  Gene Symbol: NTNG1
  Gene Name: netrin G1
  Uniprot ID: Q9Y2I2
  ENSP ID: ENSP00000359082
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGNCECFGHSNRCSYIDLLNTVICVSCKHNTRGQHCELCRLGYFRNASAQLDDENVCIANVCDNELLHCQNGGTCHNNVRCLCPAAYTGILCEKLRCEEAGSCGSDSGQGAPPHGSPALLLLTTLLGTASPLVF

SEQ ID NO: 55953 - protein, 480 aa, Homo sapiens
  Payload ID: 11009
  Gene Symbol: NTNG1
  Gene Name: netrin G1
  Uniprot ID: Q9Y2I2
  ENSP ID: ENSP00000359083
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGNPPKFNRIWPNISSLEVSNPKQVAPKLALSTVSSVQVANHKRANVCDNELLHCQNGGTCHNNVRCLCPAAYTGILCEKLRCEEAGSCGSDSGQGAPPHGSPALLLLTTLLGTASPLVF

SEQ ID NO: 55954 - protein, 460 aa, Homo sapiens
  Payload ID: 11009
  Gene Symbol: NTNG1
  Gene Name: netrin G1
  Uniprot ID: Q9Y2I2
  ENSP ID: ENSP00000359084
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGNPPKFNRIWPNISSLEVSNPKQANVCDNELLHCQNGGTCHNNVRCLCPAAYTGILCEKLRCEEAGSCGSDSGQGAPPHGSPALLLLTTLLGTASPLVF

SEQ ID NO: 55955 - protein, 539 aa, Homo sapiens
  Payload ID: 11009
  Gene Symbol: NTNG1
  Gene Name: netrin G1
  Uniprot ID: Q9Y2I2
  ENSP ID: ENSP00000359085
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGNCECFGHSNRCSYIDLLNTVICVSCKHNTRGQHCELCRLGYFRNASAQLDDENVCIECYCNPLGSIHDRCNGSGFCECKTGTTGPKCDECLPGNSWHYGCQPNVCDNELLHCQNGGTCHNNVRCLCPAAYTGILCEKLRCEEAGSCGSDSGQGAPPHGSPALLLLTTLLGTASPLVF

SEQ ID NO: 55956 - protein, 480 aa, Homo sapiens; identical to SEQ ID NO: 55953
  Payload ID: 11009
  Gene Symbol: NTNG1
  Gene Name: netrin G1
  Uniprot ID: Q9Y2I2
  ENSP ID: ENSP00000359088

SEQ ID NO: 55957 - protein, 539 aa, Homo sapiens; identical to SEQ ID NO: 55955
  Payload ID: 11009
  Gene Symbol: NTNG1
  Gene Name: netrin G1
  Uniprot ID: Q9Y2I2
  ENSP ID: ENSP00000359090

SEQ ID NO: 55958 - protein, 438 aa, Homo sapiens
  Payload ID: 11009
  Gene Symbol: NTNG1
  Gene Name: netrin G1
  Uniprot ID: Q9Y2I2
  ENSP ID: ENSP00000359091
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGTNVCDNELLHCQNGGTCHNNVRCLCPAAYTGILCEKLRCEEAGSCGSDSGQGAPPHGSPALLLLTTLLGTASPLVF

SEQ ID NO: 55959 - protein, 422 aa, Homo sapiens
  Payload ID: 11010
  Gene Symbol: NTNG2
  Gene Name: netrin G2
  Uniprot ID: Q96CW9
  ENSP ID: ENSP00000361252
MLHLLALFLHCLPLASGDYDICKSWVTTDEGPTWEFYACQPKVMRLKDYVKVKVEPSGITCGDPPERFCSHENPYLCSNECDASNPDLAHPPRLMFDKEEEGLATYWQSITWSRYPSPLEANITLSWNKTVELTDDVVMTFEYGRPTVMVLEKSLDNGRTWQPYQFYAEDCMEAFGMSARRARDMSSSSAHRVLCTEEYSRWAGSKKEKHVRFEVRDRFAIFAGPDLRNMDNLYTRLESAKGLKEFFTLTDLRMRLLRPALGGTYVQRENLYKYFYAISNIEVIGRCKCNLHANLCSMREGSLQCECEHNTTGPDCGKCKKNFRTRSWRAGSYLPLPHGSPNACATAGSFGTLQTPPPGRSPSALRGSRRGLANVKEPAGSRPQISEMLLGCTVTLHQGSVGPHIPPKLSLPDPGGPWLGSQ

SEQ ID NO: 55960 - protein, 530 aa, Homo sapiens
  Payload ID: 11010
  Gene Symbol: NTNG2
  Gene Name: netrin G2
  Uniprot ID: Q96CW9
  ENSP ID: ENSP00000376921
MLHLLALFLHCLPLASGDYDICKSWVTTDEGPTWEFYACQPKVMRLKDYVKVKVEPSGITCGDPPERFCSHENPYLCSNECDASNPDLAHPPRLMFDKEEEGLATYWQSITWSRYPSPLEANITLSWNKTVELTDDVVMTFEYGRPTVMVLEKSLDNGRTWQPYQFYAEDCMEAFGMSARRARDMSSSSAHRVLCTEEYSRWAGSKKEKHVRFEVRDRFAIFAGPDLRNMDNLYTRLESAKGLKEFFTLTDLRMRLLRPALGGTYVQRENLYKYFYAISNIEVIGRCKCNLHANLCSMREGSLQCECEHNTTGPDCGKCKKNFRTRSWRAGSYLPLPHGSPNACATAGSFGNCECYGHSNRCSYIDFLNVVTCVSCKHNTRGQHCQHCRLGYYRNGSAELDDENVCIECNCNQIGSVHDRCNETGFCECREGAAGPKCDDCLPTHYWRQGCYPNVCDDDQLLCQNGGTCLQNQRCACPRGYTGVRCEQPRCDPADDDGGLDCDRAPGAAPRPATLLGCLLLLGLAARLGR

SEQ ID NO: 55961 - protein, 172 aa, Homo sapiens
  Payload ID: 11011
  Gene Symbol: NENF
  Gene Name: neudesin neurotrophic factor
  Uniprot ID: Q9UMX5
  ENSP ID: ENSP00000355955
MVGPAPRRRLRPLAALALVLALAPGLPTARAGQTPRPAERGPPVRLFTEEELARYGGEEEDQPIYLAVKGVVFDVTSGKEFYGRGAPYNALTGKDSTRGVAKMSLDPADLTHDTTGLTAKELEALDEVFTKVYKAKYPIVGYTARRILNEDGSPNLDFKPEDQPHFDIKDEF

SEQ ID NO: 55962 - protein, 291 aa, Homo sapiens
  Payload ID: 11012
  Gene Symbol: NGRN
  Gene Name: neugrin, neurite outgrowth associated
  Uniprot ID: Q9NPE2
  ENSP ID: ENSP00000368389
MAVTLSLLLGGRVCAAVTRCGFATRGVAGPGPIGREPDPDSDWEPEERELQEVESTLKRQKQAIRFQKIRRQMEAPGAPPRTLTWEAMEQIRYLHEEFPESWSVPRLAEGFDVSTDVIRRVLKSKFLPTLEQKLKQDQKVLKKAGLAHSLQHLRGSGNTSKLLPAGHSVSGSLLMPGHEASSKDPNHSTALKVIESDTHRTNTPRRRKGRNKEIQDLEESFVPVAAPLGHPRELQKYSSDSESPRGTGSGALPSGQKLEELKAEEPDNFSSKVVQRGREFFDSNGNFLYRI

SEQ ID NO: 55963 - protein, 23 aa, Homo sapiens
  Payload ID: 11012
  Gene Symbol: NGRN
  Gene Name: neugrin, neurite outgrowth associated
  ENSP ID: ENSP00000480153
EAPGAPPRTLTWEAMEQIRYLSS

SEQ ID NO: 55964 - protein, 858 aa, Homo sapiens
  Payload ID: 11013
  Gene Symbol: NCAM1
  Gene Name: neural cell adhesion molecule 1
  Uniprot ID: P13591
  ENSP ID: ENSP00000318472
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 55965 - protein, 725 aa, Homo sapiens
  Payload ID: 11013
  Gene Symbol: NCAM1
  Gene Name: neural cell adhesion molecule 1
  ENSP ID: ENSP00000384055
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVREPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPATLGGNSASYTFVSLLFSAVTLLLLC

SEQ ID NO: 55966 - protein, 165 aa, Homo sapiens
  Payload ID: 11013
  Gene Symbol: NCAM1
  Gene Name: neural cell adhesion molecule 1
  ENSP ID: ENSP00000475074
EFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVHSPPPPASASSSTPVPLSPPDTTWPLPALATTEPAKNIAQNHCCNMFQAGLHNALMK

SEQ ID NO: 55967 - protein, 761 aa, Homo sapiens [sequence omitted]

SEQ ID NO: 55968 - protein, 848 aa, Homo sapiens [sequence omitted]

SEQ ID NO: 55969 - protein, 84 aa, Homo sapiens
  Payload ID: 11013
  Gene Symbol: NCAM1
  Gene Name: neural cell adhesion molecule 1
  ENSP ID: ENSP00000478072
  MOD_RES (1)..(1): Any amino acid
XQDDGGSPIRHYLVRYRALSSEWKPEIRLPSGSDHVMLKSLDWNAEYEVYVVAENQQGKSKAAHFVFRTSAQPTAIPVTLLLLC

SEQ ID NO: 55970 - protein, 884 aa, Homo sapiens [sequence omitted]

SEQ ID NO: 55971 - protein, 133 aa, Homo sapiens
  Payload ID: 11013
  Gene Symbol: NCAM1
  Gene Name: neural cell adhesion molecule 1
  ENSP ID: ENSP00000479353
MLQTKDLIWTLFFLGTAAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQ

SEQ ID NO: 55972 - protein, 305 aa, Homo sapiens
  Payload ID: 11013
  Gene Symbol: NCAM1
  Gene Name: neural cell adhesion molecule 1
  ENSP ID: ENSP00000479687
YNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVHSPPPPASASSSTPVPLSPPDTTWPLPALATTEPAREPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPATLGGNSASYTFVSLLFSAVTLLLLC

SEQ ID NO: 55973 - protein, 884 aa, Homo sapiens
  Payload ID: 11013
  Gene Symbol: NCAM1
  Gene Name: neural cell adhesion molecule 1
  ENSP ID: ENSP00000480132
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQEVHAPWNWQVGRQKGQAGSAGFPGSHETLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 55974 - protein, 372 aa, Homo sapiens
  Payload ID: 11013
  Gene Symbol: NCAM1
  Gene Name: neural cell adhesion molecule 1
  ENSP ID: ENSP00000480269
  MOD_RES (1)..(1): Any amino acid
XTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVHSPPPPASASSSTPVPLSPPDKGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 55975 - protein, 761 aa, Homo sapiens
  Payload ID: 11013
  Gene Symbol: NCAM1
  Gene Name: neural cell adhesion molecule 1
  Uniprot ID: P13591
  ENSP ID: ENSP00000480774
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVHSPPPPASASSSTPVPLSPPDTTWPLPALATTEPAKGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPATLGGNSASYTFVSLLFSAVTLLLLC

SEQ ID NO: 55976 - protein, 858 aa, Homo sapiens [sequence omitted]

SEQ ID NO: 55977 - protein, 726 aa, Homo sapiens
  Payload ID: 11013
  Gene Symbol: NCAM1
  Gene Name: neural cell adhesion molecule 1
  Uniprot ID: P13591
  ENSP ID: ENSP00000481083
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPATLGGNSASYTFVSLLFSAVTLLLLC

SEQ ID NO: 55978 - protein, 364 aa, Homo sapiens
  Payload ID: 11013
  Gene Symbol: NCAM1
  Gene Name: neural cell adhesion molecule 1
  Uniprot ID: P13591
  ENSP ID: ENSP00000482205
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKASWTRPEKQEV

SEQ ID NO: 55979 - protein, 135 aa, Homo sapiens
  Payload ID: 11013
  Gene Symbol: NCAM1
  Gene Name: neural cell adhesion molecule 1
  ENSP ID: ENSP00000482852
MLQTKDLIWTLFFLGTAGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGI

SEQ ID NO: 55980 - protein, 228 aa, Homo sapiens
  Payload ID: 11013
  Gene Symbol: NCAM1
  Gene Name: neural cell adhesion molecule 1
  ENSP ID: ENSP00000484481
TISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVHSPPPREPSAPKLEGQMGEDGNSIKVNLIKQDDGGSPIRHYLVRYRALSSEWKPEIRLPSGSDH

SEQ ID NO: 55981 - protein, 848 aa, Homo sapiens
  Payload ID: 11013
  Gene Symbol: NCAM1
  Gene Name: neural cell adhesion molecule 1
  Uniprot ID: P13591
  ENSP ID: ENSP00000484943
MLQTKDLIWTLFFLGTAVSLQVDIVPSQGEISVGESKFFLCQVAGDAKDKDISWFSPNGEKLTPNQQRISVVWNDDSSSTLTIYNANIDDAGIYKCVVTGEDGSESEATVNVKIFQKLMFKNAPTPQEFREGEDAVIVCDVVSSLPPTIIWKHKGRDVILKKDVRFIVLSNNYLQIRGIKKTDEGTYRCEGRILARGEINFKDIQVIVNVPPTIQARQNIVNATANLGQSVTLVCDAEGFPEPTMSWTKDGEQIEQEEDDEKYIFSDDSSQLTIKKVDKNDEAEYICIAENKAGEQDATIHLKVFAKPKITYVENQTAMELEEQVTLTCEASGDPIPSITWRTSTRNISSEEKTLDGHMVVRSHARVSSLTLKSIQYTDAGEYICTASNTIGQDSQSMYLEVQYAPKLQGPVAVYTWEGNQVNITCEVFAYPSATISWFRDGQLLPSSNYSNIKIYNTPSASYLEVTPDSENDFGNYNCTAVNRIGQESLEFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVQGEPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 55982 - protein, 468 aa, Homo sapiens
  Payload ID: 11013
  Gene Symbol: NCAM1
  Gene Name: neural cell adhesion molecule 1
  ENSP ID: ENSP00000486241
  MOD_RES (1)..(1): Any amino acid
XSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPELPADTTATVEDMLPSVTTVTTNSDTITETFATAQNSPTSETTTLTSSIAPPATATPDSNSVPAGQATPSKGPSASAPSPAPASAPKVAPLVDLSDTPTSTPAASNLSSSVLANQGAVLSPSAPAGVGEASKAPPASKPTPAPVPTPTGAASPLAAAAAPATEAPQAKQEAPSTKGPDPEPTQPGAAKSPAEAATALASPKSEAASVSTTNPSQGEDFKMDEGNFKTPDIDLAKDVFAALGSPAPAAGASGQAPELAPSTADSSVSPAPAKTEKGPVEAKPECQETETKPAPAEVKTVPNDATQTKENESKA

SEQ ID NO: 55983 - protein, 357 aa, Homo sapiens
  Payload ID: 11013
  Gene Symbol: NCAM1
  Gene Name: neural cell adhesion molecule 1
  ENSP ID: ENSP00000486406
  MOD_RES (1)..(1): Any amino acid
XFILVQADTPSSPSIDQVEPYSSTAQVQFDEPEATGGVPILKYKAEWRAVGEEVWHSKWYDAKEASMEGIVTIVGLKPETTYAVRLAALNGKGLGEISAASEFKTQPVREPSAPKLEGQMGEDGNSIKVNLIKQDDGGSPIRHYLVRYRALSSEWKPEIRLPSGSDHVMLKSLDWNAEYEVYVVAENQQGKSKAAHFVFRTSAQPTAIPANGSPTSGLSTGAIVGILIVIFVLLLVVVDITCYFLNKCGLFMCIAVNLCGKAGPGAKGKDMEEGKAAFSKDESKEPIVEVRTEEERTPNHDGGKHTEPNETTPLTEPEKGPVEAKPECQETETKPAPAEVKTVPNDATQTKENESKA

SEQ ID NO: 55984 - protein, 819 aa, Homo sapiens
  Payload ID: 11014
  Gene Symbol: NCAM2
  Gene Name: neural cell adhesion molecule 2
  ENSP ID: ENSP00000284894
ALLQVTISLSKVELSVGESKFFTCTAIGEPESIDWYNPQGEKIISTQRVVVQKEGVRSRLTIYNANIEDAGIYRCQATDAKGQTQEATVVLEIYQKLTFREVVSPQEFKQGEDAEVVCRVSSSPAPAVSWLYHNEEVTTISDNRFAMLANNNLQILNINKSDEGIYRCEGRVEARGEIDFRDIIVIVNVPPAISMPQKSFNATAERGEEMTFSCRASGSPEPAISWFRNGKLIEENEKYILKGSNTELTVRNIINSDGGPYVCRATNKAGEDEKQAFLQVFVQPHIIQLKNETTYENGQVTLVCDAEGEPIPEITWKRAVDGFTFTEGDKSLDGRIEVKGQHGSSSLHIKDVKLSDSGRYDCEAASRIGGHQKSMYLDIEYAPKFISNQTIYYSWEGNPINISCDVKSNPPASIHWRRDKLVLPAKNTTNLKTYSTGRKMILEIAPTSDNDFGRYNCTATNHIGTRFQEYILALADVPSSPYGVKIIELSQTTAKVSFNKPDSHGGVPIHHYQVDVKEVASEIWKIVRSHGVQTMVVLNNLEPNTTYEIRVAAVNGKGQGDYSKIEIFQTLPVREPSPPSIHGQPSSGKSFKLSITKQDDGGAPILEYIVKYRSKDKEDQWLEKKVQGNKDHIILEHLQWTMGYEVQITAANRLGYSEPTVYEFSMPPKPNIIKDTLFNGLGLGAVIGLGVAALLLILVVTDVSCFFIRQCGLLMCITRRMCGKKSGSSGKSKELEEGKAAYLKDGSKEPIVEMRTEDERVTNHEDGSPVNEPNETTPLTEPEKLPLKEEDGKEALNPETIEIKVSNDIIQSKEDDSKA

SEQ ID NO: 55985 - protein, 837 aa, Homo sapiens
  Payload ID: 11014
  Gene Symbol: NCAM2
  Gene Name: neural cell adhesion molecule 2
  Uniprot ID: O15394
  ENSP ID: ENSP00000383392
MSLLLSFYLLGLLVSSGQALLQVTISLSKVELSVGESKFFTCTAIGEPESIDWYNPQGEKIISTQRVVVQKEGVRSRLTIYNANIEDAGIYRCQATDAKGQTQEATVVLEIYQKLTFREVVSPQEFKQGEDAEVVCRVSSSPAPAVSWLYHNEEVTTISDNRFAMLANNNLQILNINKSDEGIYRCEGRVEARGEIDFRDIIVIVNVPPAISMPQKSFNATAERGEEMTFSCRASGSPEPAISWFRNGKLIEENEKYILKGSNTELTVRNIINSDGGPYVCRATNKAGEDEKQAFLQVFVQPHIIQLKNETTYENGQVTLVCDAEGEPIPEITWKRAVDGFTFTEGDKSLDGRIEVKGQHGSSSLHIKDVKLSDSGRYDCEAASRIGGHQKSMYLDIEYAPKFISNQTIYYSWEGNPINISCDVKSNPPASIHWRRDKLVLPAKNTTNLKTYSTGRKMILEIAPTSDNDFGRYNCTATNHIGTRFQEYILALADVPSSPYGVKIIELSQTTAKVSFNKPDSHGGVPIHHYQVDVKEVASEIWKIVRSHGVQTMVVLNNLEPNTTYEIRVAAVNGKGQGDYSKIEIFQTLPVREPSPPSIHGQPSSGKSFKLSITKQDDGGAPILEYIVKYRSKDKEDQWLEKKVQGNKDHIILEHLQWTMGYEVQITAANRLGYSEPTVYEFSMPPKPNIIKDTLFNGLGLGAVIGLGVAALLLILVVTDVSCFFIRQCGLLMCITRRMCGKKSGSSGKSKELEEGKAAYLKDGSKEPIVEMRTEDERVTNHEDGSPVNEPNETTPLTEPEKLPLKEEDGKEALNPETIEIKVSNDIIQSKEDDSKA

SEQ ID NO: 55986 - protein, 838 aa, Homo sapiens
  Payload ID: 11015
  Gene Symbol: NELL1
  Gene Name: neural EGFL like 1
  ENSP ID: ENSP00000298925
MPMDLILVVWFCVCTARTAEDMKPPVLSLIWRTRVLKSLLQQSLQGVVGFGMDPDLQMDIVTELDLVNTTLGVAQVSGMHNASKAFLFQDIEREIHAAPHVSEKLIQLFRNKSEFTILATVQQKPSTSGVILSIRELEHSYFELESSGLRDEIRYHYIHNGKPRTEALPYRMADGQWHKVALSVSASHLLLHVDCNRIYERVIDPPDTNLPPGINLWLGQRNQKHGLFKGIIQDGKIIFMPNGYITQCPNLNHTCPTCSDFLSLVQGIMDLQELLAKMTAKLNYAETRLSQLENCHCEKTCQVSGLLYRDQDSWVDGDHCRNCTCKSGAVECRRMSCPPLNCSPDSLPVHIAGQCCKVCRPKCIYGGKVLAEGQRILTKSCRECRGGVLVKITEMCPPLNCSEKDHILPENQCCRVCRGHNFCAEGPKCGENSECKNWNTKATCECKSGYISVQGDSAYCEDIDECAAKMHYCHANTVCVNLPGLYRCDCVPGYIRVDDFSCTEHDECGSGQHNCDENAICTNTVQGHSCTCKPGYVGNGTICRAFCEEGCRYGGTCVAPNKCVCPSGFTGSHCEKDIDECSEGIIECHNHSRCVNLPGWYHCECRSGFHDDGTYSLSGESCIDIDECALRTHTCWNDSACINLAGGFDCLCPSGPSCSGDCPHEGGLKHNGQVWTLKEDRCSVCSCKDGKIFCRRTACDCQNPSADLFCCPECDTRVTSQCLDQNGHKLYRSGDNWTHSCQQCRCLEGEVDCWPLTCPNLSCEYTAILEGECCPRCVSDPCLADNITYDIRKTCLDSYGVSRLSGSVWTMAGSPCTTCKCKNGRVCCSVDFECLQNN

SEQ ID NO: 55987 - protein, 753 aa, Homo sapiens
  Payload ID: 11015
  Gene Symbol: NELL1
  Gene Name: neural EGFL like 1
  ENSP ID: ENSP00000317837
MPMDLILVVWFCVCTARTVVGFGMDPDLQMDIVTELDLVNTTLGVAQVSGMHNASKAFLFQDIEREIHAAPHVSEKLIQLFRNKSEFTILATVQQKPSTSGVILSIRELEHRIYERVIDPPDTNLPPGINLWLGQRNQKHGLFKGIIQDGKIIFMPNGYITQCPNLNHTCPTCSDFLSLVQGIMDLQELLAKMTAKLNYAETRLSQLENCHCEKTCQVSGLLYRDQDSWVDGDHCRNCTCKSGAVECRRMSCPPLNCSPDSLPVHIAGQCCKVCRPKCIYGGKVLAEGQRILTKSCRECRGGVLVKITEMCPPLNCSEKDHILPENQCCRVCRGHNFCAEGPKCGENSECKNWNTKATCECKSGYISVQGDSAYCEDIDECAAKMHYCHANTVCVNLPGLYRCDCVPGYIRVDDFSCTEHDECGSGQHNCDENAICTNTVQGHSCTCKPGYVGNGTICRAFCEEGCRYGGTCVAPNKCVCPSGFTGSHCEKDIDECSEGIIECHNHSRCVNLPGWYHCECRSGFHDDGTYSLSGESCIDIDECALRTHTCWNDSACINLAGGFDCLCPSGPSCSGDCPHEGGLKHNGQVWTLKEDRCSVCSCKDGKIFCRRTACDCQNPSADLFCCPECDTRVTSQCLDQNGHKLYRSGDNWTHSCQQCRCLEGEVDCWPLTCPNLSCEYTAILEGECCPRCVSDPCLADNITYDIRKTCLDSYGVSRLSGSVWTMAGSPCTTCKCKNGRVCCSVDFECLQNN

SEQ ID NO: 55988 - protein, 810 aa, Homo sapiens
  Payload ID: 11015
  Gene Symbol: NELL1
  Gene Name: neural EGFL like 1
  Uniprot ID: Q92832
  ENSP ID: ENSP00000349654
MPMDLILVVWFCVCTARTVVGFGMDPDLQMDIVTELDLVNTTLGVAQVSGMHNASKAFLFQDIEREIHAAPHVSEKLIQLFRNKSEFTILATVQQKPSTSGVILSIRELEHSYFELESSGLRDEIRYHYIHNGKPRTEALPYRMADGQWHKVALSVSASHLLLHVDCNRIYERVIDPPDTNLPPGINLWLGQRNQKHGLFKGIIQDGKIIFMPNGYITQCPNLNHTCPTCSDFLSLVQGIMDLQELLAKMTAKLNYAETRLSQLENCHCEKTCQVSGLLYRDQDSWVDGDHCRNCTCKSGAVECRRMSCPPLNCSPDSLPVHIAGQCCKVCRPKCIYGGKVLAEGQRILTKSCRECRGGVLVKITEMCPPLNCSEKDHILPENQCCRVCRGHNFCAEGPKCGENSECKNWNTKATCECKSGYISVQGDSAYCEDIDECAAKMHYCHANTVCVNLPGLYRCDCVPGYIRVDDFSCTEHDECGSGQHNCDENAICTNTVQGHSCTCKPGYVGNGTICRAFCEEGCRYGGTCVAPNKCVCPSGFTGSHCEKDIDECSEGIIECHNHSRCVNLPGWYHCECRSGFHDDGTYSLSGESCIDIDECALRTHTCWNDSACINLAGGFDCLCPSGPSCSGDCPHEGGLKHNGQVWTLKEDRCSVCSCKDGKIFCRRTACDCQNPSADLFCCPECDTRVTSQCLDQNGHKLYRSGDNWTHSCQQCRCLEGEVDCWPLTCPNLSCEYTAILEGECCPRCVSDPCLADNITYDIRKTCLDSYGVSRLSGSVWTMAGSPCTTCKCKNGRVCCSVDFECLQNN

SEQ ID NO: 55989 - protein, 763 aa, Homo sapiens
  Payload ID: 11015
  Gene Symbol: NELL1
  Gene Name: neural EGFL like 1
  Uniprot ID: Q92832
  ENSP ID: ENSP00000437170
MPMDLILVVWFCVCTARTVVGFGMDPDLQMDIVTELDLVNTTLGVAQVSGMHNASKAFLFQDIEREIHAAPHVSEKLIQLFRNKSEFTILATVQQKPSTSGVILSIRELEHSYFELESSGLRDEIRYHYIHNGKPRTEALPYRMADGQWHKVALSVSASHLLLHVDCNRIYERVIDPPDTNLPPGINLWLGQRNQKHGLFKGIIQDGKIIFMPNGYITQCPNLNHTCPTCSDFLSLVQGIMDLQELLAKMTAKLNYAETRLSQLENCHCEKTCQVSGLLYRDQDSWVDGDHCRNCTCKSGAVECRRMSCPPLNCSPDSLPVHIAGQCCKVCRPKCIYGGKVLAEGQRILTKSCRECRGGVLVKITEMCPPLNCSEKDHILPENQCCRVCRGHNFCAEGPKCGENSECKNWNTKATCECKSGYISVQGDSAYCEDIDECAAKMHYCHANTVCVNLPGLYRCDCVPGYIRVDDFSCTEHDECGSGQHNCDENAICTNTVQGHSCTCKPGYVGNGTICRAFCEEGCRYGGTCVAPNKCVCPSGFTGSHCEKDIDECALRTHTCWNDSACINLAGGFDCLCPSGPSCSGDCPHEGGLKHNGQVWTLKEDRCSVCSCKDGKIFCRRTACDCQNPSADLFCCPECDTRVTSQCLDQNGHKLYRSGDNWTHSCQQCRCLEGEVDCWPLTCPNLSCEYTAILEGECCPRCVSDPCLADNITYDIRKTCLDSYGVSRLSGSVWTMAGSPCTTCKCKNGRVCCSVDFECLQNN

SEQ ID NO: 55990 - protein, 570 aa, Homo sapiens
  Payload ID: 11015
  Gene Symbol: NELL1
  Gene Name: neural EGFL like 1
  ENSP ID: ENSP00000479479
MDLQELLAKMTAKLNYAETRLSQLENCHCEKTCQVSGLLYRDQDSWVDGDHCRNCTCKSGAVECRRMSCPPLNCSPDSLPVHIAGQCCKVCRPKCIYGGKVLAEGQRILTKSCRECRGGVLVKITEMCPPLNCSEKDHILPENQCCRVCRGHNFCAEGPKCGENSECKNWNTKATCECKSGYISVQGDSAYCEDIDECAAKMHYCHANTVCVNLPGLYRCDCVPGYIRVDDFSCTEHDECGSGQHNCDENAICTNTVQGHSCTCKPGYVGNGTICRAFCEEGCRYGGTCVAPNKCVCPSGFTGSHCEKDIDECSEGIIECHNHSRCVNLPGWYHCECRSGFHDDGTYSLSGESCIDIDECALRTHTCWNDSACINLAGGFDCLCPSGPSCSGDCPHEGGLKHNGQVWTLKEDRCSVCSCKDGKIFCRRTACDCQNPSADLFCCPECDTRVTSQCLDQNGHKLYRSGDNWTHSCQQCRCLEGEVDCWPLTCPNLSCEYTAILEGECCPRCVSDPCLADNITYDIRKTCLDSYGVSRLSGSVWTMAGSPCTTCKCKNGRVCCSVDFECLQNN

SEQ ID NO: 55991 - protein, 839 aa, Homo sapiens
  Payload ID: 11016
  Gene Symbol: NELL2
  Gene Name: neural EGFL like 2
  Uniprot ID: Q99435
  ENSP ID: ENSP00000327988
MSIRRLLILILKIGRRWTELIRTMESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 55992 - protein, 815 aa, Homo sapiens
  Payload ID: 11016
  Gene Symbol: NELL2
  Gene Name: neural EGFL like 2
  Uniprot ID: Q99435
  ENSP ID: ENSP00000378866
METGLGAPLFKAWLLISVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 55993 - protein, 816 aa, Homo sapiens
  Payload ID: 11016
  Gene Symbol: NELL2
  Gene Name: neural EGFL like 2
  Uniprot ID: Q99435
  ENSP ID: ENSP00000390680
MESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 55994 - protein, 816 aa, Homo sapiens; identical to SEQ ID NO: 55993
  Payload ID: 11016
  Gene Symbol: NELL2
  Gene Name: neural EGFL like 2
  Uniprot ID: Q99435
  ENSP ID: ENSP00000394612

SEQ ID NO: 55995 - protein, 866 aa, Homo sapiens
  Payload ID: 11016
  Gene Symbol: NELL2
  Gene Name: neural EGFL like 2
  Uniprot ID: Q99435
  ENSP ID: ENSP00000416341
MGFPPLLKGQASATRSSLASCSWVVFFLSCLSRHAPEIEGGRRWTELIRTMESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 55996 - protein, 22 aa, Homo sapiens
  Payload ID: 11016
  Gene Symbol: NELL2
  Gene Name: neural EGFL like 2
  ENSP ID: ENSP00000446961
MESRVLLRTFCLIFGLGAVWGL

SEQ ID NO: 55997 - protein, 321 aa, Homo sapiens
  Payload ID: 11016
  Gene Symbol: NELL2
  Gene Name: neural EGFL like 2
  ENSP ID: ENSP00000447085
MESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAY

SEQ ID NO: 55998 - protein, 166 aa, Homo sapiens
  Payload ID: 11016
  Gene Symbol: NELL2
  Gene Name: neural EGFL like 2
  ENSP ID: ENSP00000447384
MELFLFLSPTSYPSPVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCN

SEQ ID NO: 55999 - protein, 815 aa, Homo sapiens; identical to SEQ ID NO: 55992
  Payload ID: 11016
  Gene Symbol: NELL2
  Gene Name: neural EGFL like 2
  Uniprot ID: Q99435
  ENSP ID: ENSP00000447927

SEQ ID NO: 56000 - protein, 86 aa, Homo sapiens
  Payload ID: 11016
  Gene Symbol: NELL2
  Gene Name: neural EGFL like 2
  ENSP ID: ENSP00000448107
  MOD_RES (1)..(1): Any amino acid
XDNGMFSPSGESCEDIDECGTGRHSCANDTICFNLDGGYDCRCPHGKNCTGDCIHDGKVKHNGQIWVLENDRCSVCSCQVGINEKL

SEQ ID NO: 56001 - protein, 245 aa, Homo sapiens
  Payload ID: 11016
  Gene Symbol: NELL2
  Gene Name: neural EGFL like 2
  ENSP ID: ENSP00000448407
  MOD_RES (1)..(1): Any amino acid
XAKLSRAEQRMNRLDQCYCERTCTMKGTTYREFESWIDGCKNCTCLNGTIQCETLICPNPDCPLKSALAYVDGKCSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFN

SEQ ID NO: 56002 - protein, 112 aa, Homo sapiens
  Payload ID: 11016
  Gene Symbol: NELL2
  Gene Name: neural EGFL like 2
  ENSP ID: ENSP00000448635
MESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHR

SEQ ID NO: 56003 - protein, 110 aa, Homo sapiens
  Payload ID: 11016
  Gene Symbol: NELL2
  Gene Name: neural EGFL like 2
  ENSP ID: ENSP00000449068
METGLGAPLFKAWLLISVWGLGVDPSLQIDVLTELELGESTTGVRQVPGLHNGTKAFLFQDTPRSIKASTATAEQFFQKLRNKHEFTILVTLKQTHLNSGVILSIHHLDH

SEQ ID NO: 56004 - protein, 768 aa, Homo sapiens
  Payload ID: 11016
  Gene Symbol: NELL2
  Gene Name: neural EGFL like 2
  ENSP ID: ENSP00000449332
METGLGAPLFKAWLLISVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 56005 - protein, 122 aa, Homo sapiens
  Payload ID: 11016
  Gene Symbol: NELL2
  Gene Name: neural EGFL like 2
  ENSP ID: ENSP00000450102
CPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKCEHNFYDEYFLWKNKALY

SEQ ID NO: 56006 - protein, 660 aa, Homo sapiens
  Payload ID: 11017
  Gene Symbol: NEDD1
  Gene Name: neural precursor cell expressed, developmentally down-regulated 1
  Uniprot ID: Q8NHV4
  ENSP ID: ENSP00000266742
MQENLRFASSGDDIKIWDASSMTLVDKFNPHTSPHGISSICWSSNNNFLVTASSSGDKIVVSSCKCKPVPLLELAEGQKQTCVNLNSTSMYLVSGGLNNTVNIWDLKSKRVHRSLKDHKDQVTCVTYNWNDCYIASGSLSGEIILHSVTTNLSSTPFGHGSNQSVRHLKYSLFKKSLLGSVSDNGIVTLWDVNSQSPYHNFDSVHKAPASGICFSPVNELLFVTIGLDKRIILYDTSSKKLVKTLVADTPLTAVDFMPDGATLAIGSSRGKIYQYDLRMLKSPVKTISAHKTSVQCIAFQYSTVLTKSSLNKGCSNKPTTVNKRSVNVNAASGGVQNSGIVREAPATSIATVLPQPMTSAMGKGTVAVQEKAGLPRSINTDTLSKETDSGKNQDFSSFDDTGKSSLGDMFSPIRDDAVVNKGSDESIGKGDGFDFLPQLNSVFPPRKNPVTSSTSVLHSSPLNVFMGSPGKEENENRDLTAESKKIYMGKQESKDSFKQLAKLVTSGAESGNLNTSPSSNQTRNSEKFEKPENEIEAQLICEPPINGSSTPNPKIASSVTAGVASSLSEKIADSIGNNRQNAPLTSIQIRFIQNMIQETLDDFREACHRDIVNLQVEMIKQFHMQLNEMHSLLERYSVNEGLVAEIERLREENKRLRAHF

SEQ ID NO: 56007 - protein, 660 aa, Homo sapiens; identical to SEQ ID NO: 56006
  Payload ID: 11017
  Gene Symbol: NEDD1
  Gene Name: neural precursor cell expressed, developmentally down-regulated 1
  Uniprot ID: Q8NHV4
  ENSP ID: ENSP00000404978

SEQ ID NO: 56008 - protein, 571 aa, Homo sapiens
  Payload ID: 11017
  Gene Symbol: NEDD1
  Gene Name: neural precursor cell expressed, developmentally down-regulated 1
  Uniprot ID: Q8NHV4
  ENSP ID: ENSP00000407964
MYLVSGGLNNTVNIWDLKSKRVHRSLKDHKDQVTCVTYNWNDCYIASGSLSGEIILHSVTTNLSSTPFGHGSNQSVRHLKYSLFKKSLLGSVSDNGIVTLWDVNSQSPYHNFDSVHKAPASGICFSPVNELLFVTIGLDKRIILYDTSSKKLVKTLVADTPLTAVDFMPDGATLAIGSSRGKIYQYDLRMLKSPVKTISAHKTSVQCIAFQYSTVLTKSSLNKGCSNKPTTVNKRSVNVNAASGGVQNSGIVREAPATSIATVLPQPMTSAMGKGTVAVQEKAGLPRSINTDTLSKETDSGKNQDFSSFDDTGKSSLGDMFSPIRDDAVVNKGSDESIGKGDGFDFLPQLNSVFPPRKNPVTSSTSVLHSSPLNVFMGSPGKEENENRDLTAESKKIYMGKQESKDSFKQLAKLVTSGAESGNLNTSPSSNQTRNSEKFEKPENEIEAQLICEPPINGSSTPNPKIASSVTAGVASSLSEKIADSIGNNRQNAPLTSIQIRFIQNMIQETLDDFREACHRDIVNLQVEMIKQFHMQLNEMHSLLERYSVNEGLVAEIERLREENKRLRAHF

SEQ ID NO: 56009 - protein, 571 aa, Homo sapiens; identical to SEQ ID NO: 56008
  Payload ID: 11017
  Gene Symbol: NEDD1
  Gene Name: neural precursor cell expressed, developmentally down-regulated 1
  Uniprot ID: Q8NHV4
  ENSP ID: ENSP00000411307

SEQ ID NO: 56010 - protein, 100 aa, Homo sapiens
  Payload ID: 11017
  Gene Symbol: NEDD1
  Gene Name: neural precursor cell expressed, developmentally down-regulated 1
  ENSP ID: ENSP00000450757
MQENLRFASSGDDIKIWDASSMTLVDKFNPHTSPHGISSICWSSNNNFLVTASSSGDKIVVSSCKCKPVPLLELAEGQKQTCVNLNSTSMYLVSGGLNNT

SEQ ID NO: 56011 - protein, 81 aa, Homo sapiens
  Payload ID: 11017
  Gene Symbol: NEDD1
  Gene Name: neural precursor cell expressed, developmentally down-regulated 1
  ENSP ID: ENSP00000450828
MYLVSGGLNNTVNIWDLKSKRVHRSLKDHKDQVTCVTYNWNDCYIASGSLSGEIILHSVTTNLSSTPFGHGSNQALQSSVE

SEQ ID NO: 56012 - protein, 167 aa, Homo sapiens
  Payload ID: 11017
  Gene Symbol: NEDD1
  Gene Name: neural precursor cell expressed, developmentally down-regulated 1
  ENSP ID: ENSP00000450881
MHFTGAVMQENLRFASSGDDIKIWDASSMTLVDKFNPHTSPHGISSICWSSNNNFLVTASSSGDKIVVSSCKCKPVPLLELAEGQKQTCVNLNSTSMYLVSGGLNNTVNIWDLKSKRVHRSLKDHKDQVTCVTYNWNDCYIASGSLSGEIILHSVTTNLSSTPFGHG

SEQ ID NO: 56013 - protein, 667 aa, Homo sapiens
  Payload ID: 11017
  Gene Symbol: NEDD1
  Gene Name: neural precursor cell expressed, developmentally down-regulated 1
  Uniprot ID: Q8NHV4
  ENSP ID: ENSP00000451211
MHFTGAVMQENLRFASSGDDIKIWDASSMTLVDKFNPHTSPHGISSICWSSNNNFLVTASSSGDKIVVSSCKCKPVPLLELAEGQKQTCVNLNSTSMYLVSGGLNNTVNIWDLKSKRVHRSLKDHKDQVTCVTYNWNDCYIASGSLSGEIILHSVTTNLSSTPFGHGSNQSVRHLKYSLFKKSLLGSVSDNGIVTLWDVNSQSPYHNFDSVHKAPASGICFSPVNELLFVTIGLDKRIILYDTSSKKLVKTLVADTPLTAVDFMPDGATLAIGSSRGKIYQYDLRMLKSPVKTISAHKTSVQCIAFQYSTVLTKSSLNKGCSNKPTTVNKRSVNVNAASGGVQNSGIVREAPATSIATVLPQPMTSAMGKGTVAVQEKAGLPRSINTDTLSKETDSGKNQDFSSFDDTGKSSLGDMFSPIRDDAVVNKGSDESIGKGDGFDFLPQLNSVFPPRKNPVTSSTSVLHSSPLNVFMGSPGKEENENRDLTAESKKIYMGKQESKDSFKQLAKLVTSGAESGNLNTSPSSNQTRNSEKFEKPENEIEAQLICEPPINGSSTPNPKIASSVTAGVASSLSEKIADSIGNNRQNAPLTSIQIRFIQNMIQETLDDFREACHRDIVNLQVEMIKQFHMQLNEMHSLLERYSVNEGLVAEIERLREENKRLRAHF

SEQ ID NO: 56014 - protein, 160 aa, Homo sapiens
  Payload ID: 11017
  Gene Symbol: NEDD1
  Gene Name: neural precursor cell expressed, developmentally down-regulated 1
  ENSP ID: ENSP00000451830
MYLVSGGLNNTVNIWDLKSKRVHRSLKDHKDQVTCVTYNWNDCYIASGSLSGEIILHSVTTNLSSTPFGHGSNQSVRHLKYSLFKKSLLGSVSDNGIVTLWDVNSQSPYHNFDSVHKAPASGICFSPVNELLFVTIGLDKRIILYDTSSKKLVKTLVADT

SEQ ID NO: 56015 - protein, 164 aa, Homo sapiens
  Payload ID: 11017
  Gene Symbol: NEDD1
  Gene Name: neural precursor cell expressed, developmentally down-regulated 1
  ENSP ID: ENSP00000451869
MQENLRFASSGDDIKIWDASSMTLVDKFNPHTSPHGISSICWSSNNNFLVTASSSGDKIVVSSCKCKPVPLLELAEGQKQTCVNLNSTSMYLVSGGLNNTVNIWDLKSKRVHRSLKDHKDQVTCVTYNWNDCYIASGSLSGEIILHSVTTNLSSTPFGHGSNQS

SEQ ID NO: 56016 - protein, 1247 aa, Homo sapiens
  Payload ID: 11018
  Gene Symbol: NEDD4
  Gene Name: neural precursor cell expressed, developmentally down-regulated 4, E3 ubiquitin protein ligase
  Uniprot ID: P46934
  ENSP ID: ENSP00000345530
MAQSLRLHFAARRSNTYPLSETSGDDLDSHVHMCFKRPTRISTSNVVQMKLTPRQTALAPLIKENVQSQERSSVPSSENVNKKSSCLQISLQPTRYSGYLQSSNVLADSDDASFTCILKDGIYSSAVVDNELNAVNDGHLVSSPAICSGSLSNFSTSDNGSYSSNGSDFGSCASITSGGSYTNSVISDSSSYTFPPSDDTFLGGNLPSDSTSNRSVPNRNTTPCEIFSRSTSTDPFVQDDLEHGLEIMKLPVSRNTKIPLKRYSSLVIFPRSPSTTRPTSPTSLCTLLSKGSYQTSHQFIISPSEIAHNEDGTSAKGFLSTAVNGLRLSKTICTPGEVRDIRPLHRKGSLQKKIVLSNNTPRQTVCEKSSEGYSCVSVHFTQRKAATLDCETTNGDCKPEMSEIKLNSDSEYIKLMHRTSACLPSSQNVDCQININGELERPHSQMNKNHGILRRSISLGGAYPNISCLSSLKHNCSKGGPSQLLIKFASGNEGKVDNLSRDSNRDCTNELSNSCKPGWVVLDQPDAACHLQQQQEPSPLPPGWEERQDILGRTYYVNHESRRTQWKRPTPQDNLTDAENGNIQLQAQRAFTTRRQISEETESVDNRESSENWEIIREDEATMYSNQAFPSPPPSSNLDVPTHLAEELNARLTIFGNSAVSQPASSSNHSSRRGSLQAYTFEEQPTLPVLLPTSSGLPPGWEEKQDERGRSYYVDHNSRTTTWTKPTVQATVETSQLTSSQSSAGPQSQASTSDSGQQVTQPSEIEQGFLPKGWEVRHAPNGRPFFIDHNTKTTTWEDPRLKIPAHLRGKTSLDTSNDLGPLPPGWEERTHTDGRIFYINHNIKRTQWEDPRLENVAITGPAVPYSRDYKRKYEFFRRKLKKQNDIPNKFEMKLRRATVLEDSYRRIMGVKRADFLKARLWIEFDGEKGLDYGGVAREWFFLISKEMFNPYYGLFEYSATDNYTLQINPNSGLCNEDHLSYFKFIGRVAGMAVYHGKLLDGFFIRPFYKMMLHKPITLHDMESVDSEYYNSLRWILENDPTELDLRFIIDEELFGQTHQHELKNGGSEIVVTNKNKKEYIYLVIQWRFVNRIQKQMAAFKEGFFELIPQDLIKIFDENELELLMCGLGDVDVNDWREHTKYKNGYSANHQVIQWFWKAVLMMDSEKRIRLLQFVTGTSRVPMNGFAELYGSNGPQSFTVEQWGTPEKLPRAHTCFNRLDLPPYESFEELWDKLQMAIENTQGFDGVD

SEQ ID NO: 56017 - protein, 900 aa, Homo sapiens
  Payload ID: 11018
  Gene Symbol: NEDD4
  Gene Name: neural precursor cell expressed, developmentally down-regulated 4, E3 ubiquitin protein ligase
  Uniprot ID: P46934
  ENSP ID: ENSP00000410613
MATCAVEVFGLLEDEENSRIVRVRVIAGIGLAKKDILGASDPYVRVTLYDPMNGVLTSVQTKTIKKSLNPKWNEEILFRVHPQQHRLLFEVFDENRLTRDDFLGQVDVPLYPLPTENPRLERPYTFKDFVLHPRSHKSRVKGYLRLKMTYLPKTSGSEDDNAEQAEELEPGWVVLDQPDAACHLQQQQEPSPLPPGWEERQDILGRTYYVNHESRRTQWKRPTPQDNLTDAENGNIQLQAQRAFTTRRQISEETESVDNRESSENWEIIREDEATMYSNQAFPSPPPSSNLDVPTHLAEELNARLTIFGNSAVSQPASSSNHSSRRGSLQAYTFEEQPTLPVLLPTSSGLPPGWEEKQDERGRSYYVDHNSRTTTWTKPTVQATVETSQLTSSQSSAGPQSQASTSDSGQQVTQPSEIEQGFLPKGWEVRHAPNGRPFFIDHNTKTTTWEDPRLKIPAHLRGKTSLDTSNDLGPLPPGWEERTHTDGRIFYINHNIKRTQWEDPRLENVAITGPAVPYSRDYKRKYEFFRRKLKKQNDIPNKFEMKLRRATVLEDSYRRIMGVKRADFLKARLWIEFDGEKGLDYGGVAREWFFLISKEMFNPYYGLFEYSATDNYTLQINPNSGLCNEDHLSYFKFIGRVAGMAVYHGKLLDGFFIRPFYKMMLHKPITLHDMESVDSEYYNSLRWILENDPTELDLRFIIDEELFGQTHQHELKNGGSEIVVTNKNKKEYIYLVIQWRFVNRIQKQMAAFKEGFFELIPQDLIKIFDENELELLMCGLGDVDVNDWREHTKYKNGYSANHQVIQWFWKAVLMMDSEKRIRLLQFVTGTSRVPMNGFAELYGSNGPQSFTVEQWGTPEKLPRAHTCFNRLDLPPYESFEELWDKLQMAIENTQGFDGVD

SEQ ID NO: 56018 - protein, 35 aa, Homo sapiens
  Payload ID: 11018
  Gene Symbol: NEDD4
  Gene Name: neural precursor cell expressed, developmentally down-regulated 4, E3 ubiquitin protein ligase
  ENSP ID: ENSP00000421047
  MOD_RES (1)..(1): Any amino acid
XWNEEILFRVHPQQHRLLFEVFDENRLPWLVTNQE

SEQ ID NO: 56019 - protein, 910 aa, Homo sapiens
  Payload ID: 11018
  Gene Symbol: NEDD4
  Gene Name: neural precursor cell expressed, developmentally down-regulated 4, E3 ubiquitin protein ligase
  ENSP ID: ENSP00000422455
  MOD_RES (1)..(1): Any amino acid
XNGDCKPEMSEIKLNSDSEYIKLMHRTSACLPSSQNVDCQININGELERPHSQMNKNHGILRRSISLGGAYPNISCLSSLKHNCSKGGPSQLLIKFASGNEGKVDNLSRDSNRDCTNELSNSCKTENPRLERPYTFKDFVLHPRSHKSRVKGYLRLKMTYLPKTSGSEDDNAEQAEELEPGWVVLDQPDAACHLQQQQEPSPLPPGWEERQDILGRTYYVNHESRRTQWKRPTPQDNLTDAENGNIQLQAQRAFTTRRQISEETESVDNRESSENWEIIREDEATMYSNQAFPSPPPSSNLDVPTHLAEELNARLTIFGNSAVSQPASSSNHSSRRGSLQAYTFEEQPTLPVLLPTSSGLPPGWEEKQDERGRSYYVDHNSRTTTWTKPTVQATVETSQLTSSQSSAGPQSQASTSDSGQQVTQPSEIEQGFLPKGWEVRHAPNGRPFFIDHNTKTTTWEDPRLKIPAHLRGKTSLDTSNDLGPLPPGWEERTHTDGRIFYINHNIKRTQWEDPRLENVAITGPAVPYSRDYKRKYEFFRRKLKKQNDIPNKFEMKLRRATVLEDSYRRIMGVKRADFLKARLWIEFDGEKGLDYGGVAREWFFLISKEMFNPYYGLFEYSATDNYTLQINPNSGLCNEDHLSYFKFIGRVAGMAVYHGKLLDGFFIRPFYKMMLHKPITLHDMESVDSEYYNSLRWILENDPTELDLRFIIDEELFGQTHQHELKNGGSEIVVTNKNKKEYIYLVIQWRFVNRIQKQMAAFKEGFFELIPQDLIKIFDENELELLMCGLGDVDVNDWREHTKYKNGYSANHQVIQWFWKAVLMMDSEKRIRLLQFVTGTSRVPMNGFAELYGSNGPQSFTVEQWGTPEKLPRAHTCFNRLDLPPYESFEELWDKLQMAIENTQGFDGVD

SEQ ID NO: 56020 - protein, 1303 aa, Homo sapiens
  Payload ID: 11018
  Gene Symbol: NEDD4
  Gene Name: neural precursor cell expressed, developmentally down-regulated 4, E3 ubiquitin protein ligase
  Uniprot ID: P46934
  ENSP ID: ENSP00000422705
MAQSLRLHFAARRSNTYPLSETSGDDLDSHVHMCFKRPTRISTSNVVQMKLTPRQTALAPLIKENVQSQERSSVPSSENVNKKSSCLQISLQPTRYSGYLQSSNVLADSDDASFTCILKDGIYSSAVVDNELNAVNDGHLVSSPAICSGSLSNFSTSDNGSYSSNGSDFGSCASITSGGSYTNSVISDSSSYTFPPSDDTFLGGNLPSDSTSNRSVPNRNTTPCEIFSRSTSTDPFVQDDLEHGLEIMKLPVSRNTKIPLKRYSSLVIFPRSPSTTRPTSPTSLCTLLSKGSYQTSHQFIISPSEIAHNEDGTSAKGFLSTAVNGLRLSKTICTPGEVRDIRPLHRKGSLQKKIVLSNNTPRQTVCEKSSEGYSCVSVHFTQRKAATLDCETTNGDCKPEMSEIKLNSDSEYIKLMHRTSACLPSSQNVDCQININGELERPHSQMNKNHGILRRSISLGGAYPNISCLSSLKHNCSKGGPSQLLIKFASGNEGKVDNLSRDSNRDCTNELSNSCKTRDDFLGQVDVPLYPLPTENPRLERPYTFKDFVLHPRSHKSRVKGYLRLKMTYLPKTSGSEDDNAEQAEELEQQQEPSPLPPGWEERQDILGRTYYVNHESRRTQWKRPTPQDNLTDAENGNIQLQAQRAFTTRRQISEETESVDNRESSENWEIIREDEATMYSNQAFPSPPPSSNLDVPTHLAEELNARLTIFGNSAVSQPASSSNHSSRRGSLQAYTFEEQPTLPVLLPTSSGLPPGWEEKQDERGRSYYVDHNSRTTTWTKPTVQATVETSQLTSSQSSAGPQSQASTSDSGQQVTQPSEIEQGFLPKGWEVRHAPNGRPFFIDHNTKTTTWEDPRLKIPAHLRGKTSLDTSNDLGPLPPGWEERTHTDGRIFYINHNIKRTQWEDPRLENVAITGPAVPYSRDYKRKYEFFRRKLKKQNDIPNKFEMKLRRATVLEDSYRRIMGVKRADFLKARLWIEFDGEKGLDYGGVAREWFFLISKEMFNPYYGLFEYSATDNYTLQINPNSGLCNEDHLSYFKFIGRVAGMAVYHGKLLDGFFIRPFYKMMLHKPITLHDMESVDSEYYNSLRWILENDPTELDLRFIIDEELFGQTHQHELKNGGSEIVVTNKNKKEYIYLVIQWRFVNRIQKQMAAFKEGFFELIPQDLIKIFDENELELLMCGLGDVDVNDWREHTKYKNGYSANHQVIQWFWKAVLMMDSEKRIRLLQFVTGTSRVPMNGFAELYGSNGPQSFTVEQWGTPEKLPRAHTCFNRLDLPPYESFEELWDKLQMAIENTQGFDGVD

SEQ ID NO: 56021 - protein, 39 aa, Homo sapiens
  Payload ID: 11018
  Gene Symbol: NEDD4
  Gene Name: neural precursor cell expressed, developmentally down-regulated 4, E3 ubiquitin protein ligase
  ENSP ID: ENSP00000424471
  MOD_RES (1)..(1): Any amino acid
XCAVEVFGLLEDEENSRIVRVRVIAGIGLAKKDILGARV

SEQ ID NO: 56022 - protein, 1319 aa, Homo sapiens
  Payload ID: 11018
  Gene Symbol: NEDD4
  Gene Name: neural precursor cell expressed, developmentally down-regulated 4, E3 ubiquitin protein ligase
  Uniprot ID: P46934
  ENSP ID: ENSP00000424827
MAQSLRLHFAARRSNTYPLSETSGDDLDSHVHMCFKRPTRISTSNVVQMKLTPRQTALAPLIKENVQSQERSSVPSSENVNKKSSCLQISLQPTRYSGYLQSSNVLADSDDASFTCILKDGIYSSAVVDNELNAVNDGHLVSSPAICSGSLSNFSTSDNGSYSSNGSDFGSCASITSGGSYTNSVISDSSSYTFPPSDDTFLGGNLPSDSTSNRSVPNRNTTPCEIFSRSTSTDPFVQDDLEHGLEIMKLPVSRNTKIPLKRYSSLVIFPRSPSTTRPTSPTSLCTLLSKGSYQTSHQFIISPSEIAHNEDGTSAKGFLSTAVNGLRLSKTICTPGEVRDIRPLHRKGSLQKKIVLSNNTPRQTVCEKSSEGYSCVSVHFTQRKAATLDCETTNGDCKPEMSEIKLNSDSEYIKLMHRTSACLPSSQNVDCQININGELERPHSQMNKNHGILRRSISLGGAYPNISCLSSLKHNCSKGGPSQLLIKFASGNEGKVDNLSRDSNRDCTNELSNSCKTRDDFLGQVDVPLYPLPTENPRLERPYTFKDFVLHPRSHKSRVKGYLRLKMTYLPKTSGSEDDNAEQAEELEPGWVVLDQPDAACHLQQQQEPSPLPPGWEERQDILGRTYYVNHESRRTQWKRPTPQDNLTDAENGNIQLQAQRAFTTRRQISEETESVDNRESSENWEIIREDEATMYSNQAFPSPPPSSNLDVPTHLAEELNARLTIFGNSAVSQPASSSNHSSRRGSLQAYTFEEQPTLPVLLPTSSGLPPGWEEKQDERGRSYYVDHNSRTTTWTKPTVQATVETSQLTSSQSSAGPQSQASTSDSGQQVTQPSEIEQGFLPKGWEVRHAPNGRPFFIDHNTKTTTWEDPRLKIPAHLRGKTSLDTSNDLGPLPPGWEERTHTDGRIFYINHNIKRTQWEDPRLENVAITGPAVPYSRDYKRKYEFFRRKLKKQNDIPNKFEMKLRRATVLEDSYRRIMGVKRADFLKARLWIEFDGEKGLDYGGVAREWFFLISKEMFNPYYGLFEYSATDNYTLQINPNSGLCNEDHLSYFKFIGRVAGMAVYHGKLLDGFFIRPFYKMMLHKPITLHDMESVDSEYYNSLRWILENDPTELDLRFIIDEELFGQTHQHELKNGGSEIVVTNKNKKEYIYLVIQWRFVNRIQKQMAAFKEGFFELIPQDLIKIFDENELELLMCGLGDVDVNDWREHTKYKNGYSANHQVIQWFWKAVLMMDSEKRIRLLQFVTGTSRVPMNGFAELYGSNGPQSFTVEQWGTPEKLPRAHTCFNRLDLPPYESFEELWDKLQMAIENTQGFDGVD

SEQ ID NO: 56023 - protein, 401 aa, Homo sapiens
  Payload ID: 11018
  Gene Symbol: NEDD4
  Gene Name: neural precursor cell expressed, developmentally down-regulated 4, E3 ubiquitin protein ligase
  ENSP ID: ENSP00000426051
  MOD_RES (1)..(1): Any amino acid
XIYSSAVVDNELNAVNDGHLVSSPAICSGSLSNFSTSDNGSYSSNGSDFGSCASITSGGSYTNSVISDSSSYTFPPSDDTFLGGNLPSDSTSNRSVPNRNTTPCEIFSRSTSTDPFVQDDLEHGLEIMKLPVSRNTKIPLKRYSSLVIFPRSPSTTRPTSPTSLCTLLSKGSYQTSHQFIISPSEIAHNEDGTSAKGFLSTAVNGLRLSKTICTPGEVRDIRPLHRKGSLQKKIVLSNNTPRQTVCEKSSEGYSCVSVHFTQRKAATLDCETTNGDCKPEMSEIKLNSDSEYIKLMHRTSACLPSSQNVDCQININGELERPHSQMNKNHGILRRSISLGGAYPNISCLSSLKHNCSKGGPSQLLIKFASGNEGKVDNLSRDSNRDCTNELSNSCKSQIKS

SEQ ID NO: 56024 - protein, 871 aa, Homo sapiens
  Payload ID: 11019
  Gene Symbol: NEDD4L
  Gene Name: neural precursor cell expressed, developmentally down-regulated 4-like, E3 ubiquitin protein ligase
  Uniprot ID: Q96PU5
  ENSP ID: ENSP00000256830
MATGLGEPVYGLSEDEGESRILRVKVVSGIDLAKKDIFGASDPYVKLSLYVADENRELALVQTKTIKKTLNPKWNEEFYFRVNPSNHRLLFEVFDENRLTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 56025 - protein, 911 aa, Homo sapiens
  Payload ID: 11019
  Gene Symbol: NEDD4L
  Gene Name: neural precursor cell expressed, developmentally down-regulated 4-like, E3 ubiquitin protein ligase
  Uniprot ID: Q96PU5
  ENSP ID: ENSP00000348847
MATGLGEPVYGLSEDEGESRILRVKVVSGIDLAKKDIFGASDPYVKLSLYVADENRELALVQTKTIKKTLNPKWNEEFYFRVNPSNHRLLFEVFDENRLTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 56026 - protein, 967 aa, Homo sapiens
  Payload ID: 11019
  Gene Symbol: NEDD4L
  Gene Name: neural precursor cell expressed, developmentally down-regulated 4-like, E3 ubiquitin protein ligase
  Uniprot ID: Q96PU5
  ENSP ID: ENSP00000350569
MRRLAFEQGESRILRVKVVSGIDLAKKDIFGASDPYVKLSLYVADENRELALVQTKTIKKTLNPKWNEEFYFRVNPSNHRLLFEVFDENRLTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSAPAGRARSSTVTGGEEPTPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 56027 - protein, 955 aa, Homo sapiens
  Payload ID: 11019
  Gene Symbol: NEDD4L
  Gene Name: neural precursor cell expressed, developmentally down-regulated 4-like, E3 ubiquitin protein ligase
  Uniprot ID: Q96PU5
  ENSP ID: ENSP00000372301
MATGLGEPVYGLSEDEGESRILRVKVVSGIDLAKKDIFGASDPYVKLSLYVADENRELALVQTKTIKKTLNPKWNEEFYFRVNPSNHRLLFEVFDENRLTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 56028 - protein, 975 aa, Homo sapiens
  Payload ID: 11019
  Gene Symbol: NEDD4L
  Gene Name: neural precursor cell expressed, developmentally down-regulated 4-like, E3 ubiquitin protein ligase
  Uniprot ID: Q96PU5
  ENSP ID: ENSP00000383199
MATGLGEPVYGLSEDEGESRILRVKVVSGIDLAKKDIFGASDPYVKLSLYVADENRELALVQTKTIKKTLNPKWNEEFYFRVNPSNHRLLFEVFDENRLTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSAPAGRARSSTVTGGEEPTPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 56029 - protein, 854 aa, Homo sapiens
  Payload ID: 11019
  Gene Symbol: NEDD4L
  Gene Name: neural precursor cell expressed, developmentally down-regulated 4-like, E3 ubiquitin protein ligase
  Uniprot ID: Q96PU5
  ENSP ID: ENSP00000389406
MERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSAPAGRARSSTVTGGEEPTPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 56030 - protein, 834 aa, Homo sapiens
  Payload ID: 11019
  Gene Symbol: NEDD4L
  Gene Name: neural precursor cell expressed, developmentally down-regulated 4-like, E3 ubiquitin protein ligase
  Uniprot ID: Q96PU5
  ENSP ID: ENSP00000393395
MERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 56031 - protein, 834 aa, Homo sapiens; identical to SEQ ID NO: 56030
  Payload ID: 11019
  Gene Symbol: NEDD4L
  Gene Name: neural precursor cell expressed, developmentally down-regulated 4-like, E3 ubiquitin protein ligase
  Uniprot ID: Q96PU5
  ENSP ID: ENSP00000405440

SEQ ID NO: 56032 - protein, 854 aa, Homo sapiens; identical to SEQ ID NO: 56029
  Payload ID: 11019
  Gene Symbol: NEDD4L
  Gene Name: neural precursor cell expressed, developmentally down-regulated 4-like, E3 ubiquitin protein ligase
  Uniprot ID: Q96PU5
  ENSP ID: ENSP00000411947

SEQ ID NO: 56033 - protein, 106 aa, Homo sapiens
  Payload ID: 11019
  Gene Symbol: NEDD4L
  Gene Name: neural precursor cell expressed, developmentally down-regulated 4-like, E3 ubiquitin protein ligase
  ENSP ID: ENSP00000465669
MATGLGEPVYGLSEDEAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 56034 - protein, 10 aa, Homo sapiens
  Payload ID: 11019
  Gene Symbol: NEDD4L
  Gene Name: neural precursor cell expressed, developmentally down-regulated 4-like, E3 ubiquitin protein ligase
  ENSP ID: ENSP00000466776
MERPYTFKDF

SEQ ID NO: 56035 - protein, 35 aa, Homo sapiens
  Payload ID: 11019
  Gene Symbol: NEDD4L
  Gene Name: neural precursor cell expressed, developmentally down-regulated 4-like, E3 ubiquitin protein ligase
  ENSP ID: ENSP00000466789
MERPYTFKDFLLRPRSHKSRVKGFLRLKMAYMPKN

SEQ ID NO: 56036 - protein, 150 aa, Homo sapiens
  Payload ID: 11019
  Gene Symbol: NEDD4L
  Gene Name: neural precursor cell expressed, developmentally down-regulated 4-like, E3 ubiquitin protein ligase
  ENSP ID: ENSP00000467072
MERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPE

SEQ ID NO: 56037 - protein, 15 aa, Homo sapiens
  Payload ID: 11019
  Gene Symbol: NEDD4L
  Gene Name: neural precursor cell expressed, developmentally down-regulated 4-like, E3 ubiquitin protein ligase
  ENSP ID: ENSP00000467768
MERPYTFKDFLLRPR

SEQ ID NO: 56038 - protein, 639 aa, Homo sapiens
  Payload ID: 11019
  Gene Symbol: NEDD4L
  Gene Name: neural precursor cell expressed, developmentally down-regulated 4-like, E3 ubiquitin protein ligase
  ENSP ID: ENSP00000468332
RDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 56039 - protein, 947 aa, Homo sapiens
  Payload ID: 11019
  Gene Symbol: NEDD4L
  Gene Name: neural precursor cell expressed, developmentally down-regulated 4-like, E3 ubiquitin protein ligase
  Uniprot ID: Q96PU5
  ENSP ID: ENSP00000468546
MRRLAFEQGESRILRVKVVSGIDLAKKDIFGASDPYVKLSLYVADENRELALVQTKTIKKTLNPKWNEEFYFRVNPSNHRLLFEVFDENRLTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 56040 - protein, 20 aa, Homo sapiens
  Payload ID: 11019
  Gene Symbol: NEDD4L
  Gene Name: neural precursor cell expressed, developmentally down-regulated 4-like, E3 ubiquitin protein ligase
  ENSP ID: ENSP00000479462
MATGLGEPVYGLSEDEPGSP

SEQ ID NO: 56041 - protein, 81 aa, Homo sapiens
  Payload ID: 11020
  Gene Symbol: NEDD8
  Gene Name: neural precursor cell expressed, developmentally down-regulated 8
  Uniprot ID: Q15843
  ENSP ID: ENSP00000250495
MLIKVKTLTGKEIEIDIEPTDKVERIKERVEEKEGIPPQQQRLIYSGKQMNDEKTAADYKILGGSVLHLVLALRGGGGLRQ

SEQ ID NO: 56042 - protein, 50 aa, Homo sapiens
  Payload ID: 11020
  Gene Symbol: NEDD8
  Gene Name: neural precursor cell expressed, developmentally down-regulated 8
  ENSP ID: ENSP00000380040
MLIKVKTLTGKEIEIDIEPTDKVERIKERVEEKEGIPPQQQRLIYSGKQM

SEQ ID NO: 56043 - protein, 50 aa, Homo sapiens; identical to SEQ ID NO: 56042
  Payload ID: 11020
  Gene Symbol: NEDD8
  Gene Name: neural precursor cell expressed, developmentally down-regulated 8
  ENSP ID: ENSP00000448192

SEQ ID NO: 56044 - protein, 174 aa, Homo sapiens
  Payload ID: 11021
  Gene Symbol: NEDD9
  Gene Name: neural precursor cell expressed, developmentally down-regulated 9
  Uniprot ID: Q14511
  ENSP ID: ENSP00000368745
MKYKNLMARALYDNVPECAEELAFRKGDILTVIEQNTGGLEGWWLCSLHGRQGIVPGNRVKLLIGPMQETASSHEQPASGLMQQTFGQQKLYQVPNPQAAPRDTIYQVPPSYQNQGIYQVPTGHGTQEQEVYQVPPSVQRSIGGTSGPHVGKKVFQRDGQVSYFLVRASKQTSL

SEQ ID NO: 56045 - protein, 834 aa, Homo sapiens
  Payload ID: 11021
  Gene Symbol: NEDD9
  Gene Name: neural precursor cell expressed, developmentally down-regulated 9
  Uniprot ID: Q14511
  ENSP ID: ENSP00000368759
MKYKNLMARALYDNVPECAEELAFRKGDILTVIEQNTGGLEGWWLCSLHGRQGIVPGNRVKLLIGPMQETASSHEQPASGLMQQTFGQQKLYQVPNPQAAPRDTIYQVPPSYQNQGIYQVPTGHGTQEQEVYQVPPSVQRSIGGTSGPHVGKKVITPVRTGHGYVYEYPSRYQKDVYDIPPSHTTQGVYDIPPSSAKGPVFSVPVGEIKPQGVYDIPPTKGVYAIPPSACRDEAGLREKDYDFPPPMRQAGRPDLRPEGVYDIPPTCTKPAGKDLHVKYNCDIPGAAEPVARRHQSLSPNHPPPQLGQSVGSQNDAYDVPRGVQFLEPPAETSEKANPQERDGVYDVPLHNPPDAKGSRDLVDGINRLSFSSTGSTRSNMSTSSTSSKESSLSASPAQDKRLFLDPDTAIERLQRLQQALEMGVSSLMALVTTDWRCYGYMERHINEIRTAVDKVELFLKEYLHFVKGAVANAACLPELILHNKMKRELQRVEDSHQILSQTSHDLNECSWSLNILAINKPQNKCDDLDRFVMVAKTVPDDAKQLTTTINTNAEALFRPGPGSLHLKNGPESIMNSTEYPHGGSQGQLLHPGDHKAQAHNKALPPGLSKEQAPDCSSSDGSERSWMDDYDYVHLQGKEEFERQQKELLEKENIMKQNKMQLEHHQLSQFQLLEQEITKPVENDISKWKPSQSLPTTNSGVSAQDRQLLCFYYDQCETHFISLLNAIDALFSCVSSAQPPRIFVAHSKFVILSAHKLVFIGDTLTRQVTAQDIRNKVMNSSNQLCEQLKTIVMATKMAALHYPSTTALQEMVHQVTDLSRNAQLFKRSLLEMATF

SEQ ID NO: 56046 - protein, 32 aa, Homo sapiens
  Payload ID: 11021
  Gene Symbol: NEDD9
  Gene Name: neural precursor cell expressed, developmentally down-regulated 9
  ENSP ID: ENSP00000380534
MWTRNLMARALYDNVPECAEELAFRKGDILTV

SEQ ID NO: 56047 - protein, 43 aa, Homo sapiens
  Payload ID: 11021
  Gene Symbol: NEDD9
  Gene Name: neural precursor cell expressed, developmentally down-regulated 9
  ENSP ID: ENSP00000395237
MWTRRINHQLHTNKKALGTVSSQEQPNLLSGQTFQESYGKGLI

SEQ ID NO: 56048 - protein, 29 aa, Homo sapiens
  Payload ID: 11021
  Gene Symbol: NEDD9
  Gene Name: neural precursor cell expressed, developmentally down-regulated 9
  ENSP ID: ENSP00000421282
MARALYDNVPECAEELAFRKGDILTVIEQ

SEQ ID NO: 56049 - protein, 834 aa, Homo sapiens
  Payload ID: 11021
  Gene Symbol: NEDD9
  Gene Name: neural precursor cell expressed, developmentally down-regulated 9
  Uniprot ID: Q14511
  ENSP ID: ENSP00000422871
MWTRNLMARALYDNVPECAEELAFRKGDILTVIEQNTGGLEGWWLCSLHGRQGIVPGNRVKLLIGPMQETASSHEQPASGLMQQTFGQQKLYQVPNPQAAPRDTIYQVPPSYQNQGIYQVPTGHGTQEQEVYQVPPSVQRSIGGTSGPHVGKKVITPVRTGHGYVYEYPSRYQKDVYDIPPSHTTQGVYDIPPSSAKGPVFSVPVGEIKPQGVYDIPPTKGVYAIPPSACRDEAGLREKDYDFPPPMRQAGRPDLRPEGVYDIPPTCTKPAGKDLHVKYNCDIPGAAEPVARRHQSLSPNHPPPQLGQSVGSQNDAYDVPRGVQFLEPPAETSEKANPQERDGVYDVPLHNPPDAKGSRDLVDGINRLSFSSTGSTRSNMSTSSTSSKESSLSASPAQDKRLFLDPDTAIERLQRLQQALEMGVSSLMALVTTDWRCYGYMERHINEIRTAVDKVELFLKEYLHFVKGAVANAACLPELILHNKMKRELQRVEDSHQILSQTSHDLNECSWSLNILAINKPQNKCDDLDRFVMVAKTVPDDAKQLTTTINTNAEALFRPGPGSLHLKNGPESIMNSTEYPHGGSQGQLLHPGDHKAQAHNKALPPGLSKEQAPDCSSSDGSERSWMDDYDYVHLQGKEEFERQQKELLEKENIMKQNKMQLEHHQLSQFQLLEQEITKPVENDISKWKPSQSLPTTNSGVSAQDRQLLCFYYDQCETHFISLLNAIDALFSCVSSAQPPRIFVAHSKFVILSAHKLVFIGDTLTRQVTAQDIRNKVMNSSNQLCEQLKTIVMATKMAALHYPSTTALQEMVHQVTDLSRNAQLFKRSLLEMATF

SEQ ID NO: 56050 - protein, 22 aa, Homo sapiens
  Payload ID: 11021
  Gene Symbol: NEDD9
  Gene Name: neural precursor cell expressed, developmentally down-regulated 9
  ENSP ID: ENSP00000424975
MRPTNIMKGNLLYSKSIGLNNL

SEQ ID NO: 56051 - protein, 685 aa, Homo sapiens
  Payload ID: 11021
  Gene Symbol: NEDD9
  Gene Name: neural precursor cell expressed, developmentally down-regulated 9
  ENSP ID: ENSP00000478563
MKYKVITPVRTGHGYVYEYPSRYQKDVYDIPPSHTTQGVYDIPPSSAKGPVFSVPVGEIKPQGVYDIPPTKGVYAIPPSACRDEAGLREKDYDFPPPMRQAGRPDLRPEGVYDIPPTCTKPAGKDLHVKYNCDIPGAAEPVARRHQSLSPNHPPPQLGQSVGSQNDAYDVPRGVQFLEPPAETSEKANPQERDGVYDVPLHNPPDAKGSRDLVDGINRLSFSSTGSTRSNMSTSSTSSKESSLSASPAQDKRLFLDPDTAIERLQRLQQALEMGVSSLMALVTTDWRCYGYMERHINEIRTAVDKVELFLKEYLHFVKGAVANAACLPELILHNKMKRELQRVEDSHQILSQTSHDLNECSWSLNILAINKPQNKCDDLDRFVMVAKTVPDDAKQLTTTINTNAEALFRPGPGSLHLKNGPESIMNSTEYPHGGSQGQLLHPGDHKAQAHNKALPPGLSKEQAPDCSSSDGSERSWMDDYDYVHLQGKEEFERQQKELLEKENIMKQNKMQLEHHQLSQFQLLEQEITKPVENDISKWKPSQSLPTTNSGVSAQDRQLLCFYYDQCETHFISLLNAIDALFSCVSSAQPPRIFVAHSKFVILSAHKLVFIGDTLTRQVTAQDIRNKVMNSSNQLCEQLKTIVMATKMAALHYPSTTALQEMVHQVTDLSRNAQLFKRSLLEMATF

SEQ ID NO: 56052 - protein, 403 aa, Homo sapiens
  Payload ID: 11022
  Gene Symbol: NPDC1
  Gene Name: neural proliferation, differentiation and control, 1
  ENSP ID: ENSP00000360659
MLRPEAGLVGLHGPAQENSALPGRRDSASELRALSGLEVDPGEGWGRVVLISPRTVRFRVLSPGVREEGHVQNNGQNQARPARGVTGAGGWGSAAVCRGRALRGREPALPSASFPDVAACPGSLDCALKRRARCPPGAHACGPCLQPFQEDQQGLCVPRMRRPPGGGRPQPRLEDEIDFLAQELARKESGHSTPPLPKDRQRLPEPATLGFSARGQGLELGLPSTPGTPTPTPHTSLGSPVSSDPVHMSPLEPRGGQGDGLALVLILAFCVAGAAALSVASLCWCRLQREIRLTQKADYATAKAPGSPAAPRISPGDQRLAQSAEMYHYQHQRQQMLCLERHKEPPKELDTASSDEENEDGDFTVYECPGLAPTGEMEVRNPLFDHAALSAPLPAPSSPPALP

SEQ ID NO: 56053 - protein, 325 aa, Homo sapiens
  Payload ID: 11022
  Gene Symbol: NPDC1
  Gene Name: neural proliferation, differentiation and control, 1
  Uniprot ID: Q9NQX5
  ENSP ID: ENSP00000360660
MATPLPPPSPRHLRLLRLLLSGLVLGAALRGAAAGHPDVAACPGSLDCALKRRARCPPGAHACGPCLQPFQEDQQGLCVPRMRRPPGGGRPQPRLEDEIDFLAQELARKESGHSTPPLPKDRQRLPEPATLGFSARGQGLELGLPSTPGTPTPTPHTSLGSPVSSDPVHMSPLEPRGGQGDGLALVLILAFCVAGAAALSVASLCWCRLQREIRLTQKADYATAKAPGSPAAPRISPGDQRLAQSAEMYHYQHQRQQMLCLERHKEPPKELDTASSDEENEDGDFTVYECPGLAPTGEMEVRNPLFDHAALSAPLPAPSSPPALP

SEQ ID NO: 56054 - protein, 28 aa, Homo sapiens
  Payload ID: 11022
  Gene Symbol: NPDC1
  Gene Name: neural proliferation, differentiation and control, 1
  ENSP ID: ENSP00000481901
  MOD_RES (1)..(1): Any amino acid
XQMLCLERLGHWHLEGMGRTQRSPPTQA

SEQ ID NO: 56055 - protein, 98 aa, Homo sapiens
  Payload ID: 11023
  Gene Symbol: NRL
  Gene Name: neural retina leucine zipper
  Uniprot ID: P54845
  ENSP ID: ENSP00000380191
MSVRELNRQLRGCGRDEALRLKQRRRTLKNRGYAQACRSKRLQQRRGLEAERARLAAQLDALRAEVARLARERDLYKARCDRLTSSGPGSGDPSHLFL

SEQ ID NO: 56056 - protein, 237 aa, Homo sapiens
  Payload ID: 11023
  Gene Symbol: NRL
  Gene Name: neural retina leucine zipper
  Uniprot ID: P54845
  ENSP ID: ENSP00000380193
MALPPSPLAMEYVNDFDLMKFEVKREPSEGRPGPPTASLGSTPYSSVPPSPTFSEPGMVGATEGTRPGLEELYWLATLQQQLGAGEALGLSPEEAMELLQGQGPVPVDGPHGYYPGSPEETGAQHVQLAERFSDAALVSMSVRELNRQLRGCGRDEALRLKQRRRTLKNRGYAQACRSKRLQQRRGLEAERARLAAQLDALRAEVARLARERDLYKARCDRLTSSGPGSGDPSHLFL

SEQ ID NO: 56057 - protein, 237 aa, Homo sapiens; identical to SEQ ID NO: 56056
  Payload ID: 11023
  Gene Symbol: NRL
  Gene Name: neural retina leucine zipper
  Uniprot ID: P54845
  ENSP ID: ENSP00000380197

SEQ ID NO: 56058 - protein, 98 aa, Homo sapiens; identical to SEQ ID NO: 56055
  Payload ID: 11023
  Gene Symbol: NRL
  Gene Name: neural retina leucine zipper
  Uniprot ID: P54845
  ENSP ID: ENSP00000452966

SEQ ID NO: 56059 - protein, 237 aa, Homo sapiens; identical to SEQ ID NO: 56056
  Payload ID: 11023
  Gene Symbol: NRL
  Gene Name: neural retina leucine zipper
  Uniprot ID: P54845
  ENSP ID: ENSP00000454062

SEQ ID NO: 56060 - protein, 65 aa, Homo sapiens
  Payload ID: 11023
  Gene Symbol: NRL
  Gene Name: neural retina leucine zipper
  ENSP ID: ENSP00000454180
MALPPSPLAMEYVNDFDLMKFEVKREPSEGRPGPPTASLGSTPYSSVPPSPTFSEPGMVGATEGT

SEQ ID NO: 56061 - protein, 574 aa, Homo sapiens
  Payload ID: 11024
  Gene Symbol: NEURL1
  Gene Name: neuralized E3 ubiquitin protein ligase 1
  Uniprot ID: O76050
  ENSP ID: ENSP00000358795
MGNNFSSIPSLPRGNPSRAPRGHPQNLKDSIGGPFPVTSHRCHHKQKHCPAVLPSGGLPATPLLFHPHTKGSQILMDLSHKAVKRQASFCNAITFSNRPVLIYEQVRLKITKKQCCWSGALRLGFTSKDPSRIHPDSLPKYACPDLVSQSGFWAKALPEEFANEGNIIAFWVDKKGRVFHRINDSAVMLFFSGVRTADPLWALVDVYGLTRGVQLLDSELVLPDCLRPRSFTALRRPSLRREADDARLSVSLCDLNVPGADGDEAAPAAGCPIPQNSLNSQHSRALPAQLDGDLRFHALRAGAHVRILDEQTVARVEHGRDERALVFTSRPVRVAETIFVKVTRSGGARPGALSFGVTTCDPGTLRPADLPFSPEALVDRKEFWAVCRVPGPLHSGDILGLVVNADGELHLSHNGAAAGMQLCVDASQPLWMLFGLHGTITQIRILGSTILAERGIPSLPCSPASTPTSPSALGSRLSDPLLSTCSSGPLGSSAGGTAPNSPVSLPESPVTPGLGQWSDECTICYEHAVDTVIYTCGHMCLCYACGLRLKKALHACCPICRRPIKDIIKTYRSS

SEQ ID NO: 56062 - protein, 108 aa, Homo sapiens
  Payload ID: 11024
  Gene Symbol: NEURL1
  Gene Name: neuralized E3 ubiquitin protein ligase 1
  ENSP ID: ENSP00000387714
MDLSHKAVKRQASFCNAITFSNRPVLIYEQVRLKITKKQCCWSGALRLGFTSKDPSRIHPDSLPKYACPDLVSQSGFWAKALPEEFANEGNIIAFWVDKKGRVFHRIN

SEQ ID NO: 56063 - protein, 199 aa, Homo sapiens
  Payload ID: 11024
  Gene Symbol: NEURL1
  Gene Name: neuralized E3 ubiquitin protein ligase 1
  ENSP ID: ENSP00000416709
MGGQITRSTLHDSIGGPFPVTSHRCHHKQKHCPAVLPSGGLPATPLLFHPHTKGSQILMDLSHKAVKRQASFCNAITFSNRPVLIYEQVRLKITKKQCCWSGALRLGFTSKDPSRIHPDSLPKYACPDLVSQSGFWAKALPEEFANEGNIIAFWVDKKGRVFHRINDSAVMLFFSGVRTADPLWALVDVYGLTRGVQLL

SEQ ID NO: 56064 - protein, 555 aa, Homo sapiens
  Payload ID: 11025
  Gene Symbol: NEURL1B
  Gene Name: neuralized E3 ubiquitin protein ligase 1B
  Uniprot ID: A8MQ27
  ENSP ID: ENSP00000358815
MGNTVHRTLPDPSPPARLLATRPCCGPGPERRPVLGEAPRFHAQAKGKNVRLDGHSRRATRRNSFCNGVTFTQRPIRLYEQVRLRLVAVRPGWSGALRFGFTAHDPSLMSAQDIPKYACPDLVTRPGYWAKALPENLALRDTVLAYWADRHGRVFYSVNDGEPVLFHCGVAVGGPLWALIDVYGITDEVQLLESAFADTLTPARLSQARFSACLPPSSHDAANFDNNELENNQVVAKLGHLALGRAPGPPPADAAAAAIPCGPRERPRPASSPALLEADLRFHATRGPDVSLSADRKVACAPRPDGGRTLVFSERPLRPGESLFVEVGRPGLAAPGALAFGITSCDPGVLRPNELPADPDALLDRKEYWVVARAGPVPSGGDALSFTLRPGGDVLLGINGRPRGRLLCVDTTQALWAFFAVRGGVAGQLRLLGTLQSSPATTTPSGSLSGSQDDSDSDMTFSVNQSSSASESSLVTAPSSPLSPPVSPVFSPPEPAGIKNGECTVCFDGEVDTVIYTCGHMCLCHSCGLRLKRQARACCPICRRPIKDVIKIYRP

SEQ ID NO: 56065 - protein, 315 aa, Homo sapiens
  Payload ID: 11025
  Gene Symbol: NEURL1B
  Gene Name: neuralized E3 ubiquitin protein ligase 1B
  Uniprot ID: A8MQ27
  ENSP ID: ENSP00000429797
MGNTVHRTLPDPSPPARLLATRPCCGPGPERRPVLGEAPRFHAQAKGKNVRLDGHSRRATRRNSFCNGVTFTQRPIRLYEQVRLRLVAVRPGWSGALRFGFTAHDPSLMSAQDIPKYACPDLVTRPGYWAKALPENLALRDTVLAYWADRHGRVFYSVNDGEPVLFHCGVAVGGPLWALIDVYGITDEVQLLGTLQSSPATTTPSGSLSGSQDDSDSDMTFSVNQSSSASESSLVTAPSSPLSPPVSPVFSPPEPAGIKNGECTVCFDGEVDTVIYTCGHMCLCHSCGLRLKRQARACCPICRRPIKDVIKIYRP

SEQ ID NO: 56066 - protein, 373 aa, Homo sapiens
  Payload ID: 11025
  Gene Symbol: NEURL1B
  Gene Name: neuralized E3 ubiquitin protein ligase 1B
  Uniprot ID: A8MQ27
  ENSP ID: ENSP00000430001
MGNTVHRTLPESAFADTLTPARLSQARFSACLPPSSHDAANFDNNELENNQVVAKLGHLALGRAPGPPPADAAAAAIPCGPRERPRPASSPALLEADLRFHATRGPDVSLSADRKVACAPRPDGGRTLVFSERPLRPGESLFVEVGRPGLAAPGALAFGITSCDPGVLRPNELPADPDALLDRKEYWVVARAGPVPSGGDALSFTLRPGGDVLLGINGRPRGRLLCVDTTQALWAFFAVRGGVAGQLRLLGTLQSSPATTTPSGSLSGSQDDSDSDMTFSVNQSSSASESSLVTAPSSPLSPPVSPVFSPPEPAGIKNGECTVCFDGEVDTVIYTCGHMCLCHSCGLRLKRQARACCPICRRPIKDVIKIYRP

SEQ ID NO: 56067 - protein, 285 aa, Homo sapiens
  Payload ID: 11026
  Gene Symbol: NEURL2
  Gene Name: neuralized E3 ubiquitin protein ligase 2
  Uniprot ID: Q9BR09
  ENSP ID: ENSP00000361596
MAAASEPVDSGALWGLERPEPPPTRFHRVHGANIRVDPSGTRATRVESFAHGVCFSREPLAPGQVFLVEIEEKELGWCGHLRLGLTALDPASLAPVPEFSLPDLVNLGHTWVFAITRHHNRVPREGRPEAEAAAPSRPPTLLVEPYLRIEQFRIPRDRLVGRSRPGLYSHLLDQLYELNVLPPTARRSRLGVLFCPRPDGTADMHIIINGEDMGPSARGLPAAQPLYAVVDVFASTKSVRLVQLEYGLPSLQTLCRLVIQRSMVHRLAIDGLHLPKELKDFCKYE

SEQ ID NO: 56068 - protein, 90 aa, Homo sapiens
  Payload ID: 11026
  Gene Symbol: NEURL2
  Gene Name: neuralized E3 ubiquitin protein ligase 2
  ENSP ID: ENSP00000442383
  MOD_RES (1)..(1): Any amino acid
XDQLYELNVLPPTARRSRLGVLFCPRPDGTADMHIIINGEDMGPSARGLPAAQPLYAVVDVFASTKSVRLVQLEYGFFFPQCHPCRLCAA

SEQ ID NO: 56069 - protein, 262 aa, Homo sapiens
  Payload ID: 11027
  Gene Symbol: NEURL3
  Gene Name: neuralized E3 ubiquitin protein ligase 3
  Uniprot ID: Q96EH8
  ENSP ID: ENSP00000478591
MGAQLCFEANAKAPREALRFHAEAKGAQVRLDTRGCIAHRRTTFHDGIVFSQRPVRLGERVALRVLREESGWCGGLRVGFTRLDPACVSVPSLPPFLCPDLEEQSPTWAAVLPEGCALTGDLVRFWVDRRGCLFAKVNAGCRLLLREGVPVGAPLWAVMDVYGTTKAIELLDPTASRLPTPMPWDLSNKAVPEPKATPGEECAICFYHAANTRLVPCGHTYFCRYCAWRVFSDTAKCPVCRWQIEAVAPAQGPPALRVEEGS

SEQ ID NO: 56070 - protein, 128 aa, Homo sapiens
  Payload ID: 11027
  Gene Symbol: NEURL3
  Gene Name: neuralized E3 ubiquitin protein ligase 3
  ENSP ID: ENSP00000479456
MDVYGTTKAIELLDPTASRLPTPMPWDLSNKAVPEPKGFGPKDLALPTGNLKATWHLCLREHLPTLHTRRGVCHLLLSRCQHPPCALRPHILLQILCLAGLQRYGQVPCVPLADRGGSPCAGPSCSEG

SEQ ID NO: 56071 - protein, 104 aa, Homo sapiens
  Payload ID: 11027
  Gene Symbol: NEURL3
  Gene Name: neuralized E3 ubiquitin protein ligase 3
  ENSP ID: ENSP00000480933
MDVYGTTKAIELLDPTASRLPTPMPWDLSNKAVPEPKATPGEECAICFYHAANTRLVPCGHTYFCRYCAWRVFSDTAKCPVCRWQIEAVAPAQGPPALRVEEGS

SEQ ID NO: 56072 - protein, 1560 aa, Homo sapiens
  Payload ID: 11028
  Gene Symbol: NEURL4
  Gene Name: neuralized E3 ubiquitin protein ligase 4
  Uniprot ID: Q96JN8
  ENSP ID: ENSP00000319826
MAAGSGGSGGSGGGPGPGPGGGGGPSGSGSGPGSNGGLGSGGELHPRTGRLVSLSACGRTARRQQPGQEFNHGLVLSREPLRDGRVFTVRIDRKVNSWSGSIEIGVTALDPSVLDFPSSATGLKGGSWVVSGCSVLRDGRSVLEEYGQDLDQLGEGDRVGVERTVAGELRLWVNGRDCGVAATGLPPRVWAVVDLYGKCTQITVLPPEPGFSPPTPIPTPPLEPLAPTEDSALAEQGTSADEAFMVSPAQARPETFPNSLESHNDFANMELSEVVSNTILSAYNGGLLNVNLSSPPAGEGLGSSGAATSPILTSNDALLFHEKCGTLIKLSNNNKTAERRRPLDEFNNGVVMTNRPLRDNEMFEIRIDKLVDKWSGSIEIGVTTHNPNSLEYPATMTNLQSGTIMMSGCGILTNGKGTRREYCEFSLDELQEGDHIGLTRKSNSALHFFINGIDQGVATPLTPPVVYGVVDLYGMAVKVTIVHNNNHSDRLRRNNAILRALSPEGALRRAAPAAQAEPERLLFHPNCGQKAAITHEGRTALRPHATDDFNHGVVLSSRALRDGEVFQVRIDKMVDKWAGSIEIGVTTHNPAYLQLPSTMTNLRSGTWMMTGNGVMHNGTTILDEYGHNLDRLKAGDTVGVVRREDGTLHFFVNGMTQGPAAWNVPPGVYAVVDLYGQAAQATIVDDVEVAPVPEPLPEGNNQVSPSSPSSGAGGSDLRFHQLHGSNAVITNGGRTALRHNCRSEFNDAIVISNRALRDGELFEIVIQKMVDRWSGSIEAGVTAIRPEDLEFPNTMTDIDYDTWMLSGTAIMQDGNTMRNNYGCDLDALGTGARIGMMRTAKGDLHYFINGQDQGAACSGLPPEVYAVVDLYGQCVQVSITNATGPMDNSLATSNTATEKSFPLHSPVAGVAHRFHSTCGKNVTLEEDGTRAVRAAGYAHGLVFSTKELRAEEVFEVKVEELDEKWAGSLRLGLTTLAPGEMGPGAGGGGPGLPPSLPELRTKTTWMVSSCEVRRDGQLQRMNYGRNLERLGVGSRVGVRRGADDTMHILVDGEDMGPAATGIAKNVWAVLDLYGPVRGVSIVSSTRLEESEGTQPPSPSSDTGSEGEEDDEGEEHGLGGQNEVGIIPTTLEFLENHGKNILLSNGNRTATRVASYNQGIVVINQPLVPQLLVQVRIDFLNRQWTSSLVLGVITCAPERLNFPASACALKRAAWLLRGRGVFHNGLKICEKFGPNLDTCPEGTILGLRLDSSGGLHLHVNGVDQGVAVPDVPQPCHALVDLYGQCEQVTIVNPEPGAASGKSAGTQGDMEKADMVDGIKESVCWGPPPAASPLKSCEYHALCSRFQELLLLPEDYFMPPPKRSLCYCESCRKLRGDEAHRRRGEPPREYALPFGWCRFNLRVNPRLEAGTLTKKWHMAYHGSNVAAVRRVLDRGELGAGTASILSCRPLKGEPGVGFEEPGENCAPPREEQPPPVLLSPSLQYAGAETLASKVQFRDPKSQRTHQAQVAFQVCVRPGSYTPGPPSAALGEPPDPHFSPAELEWVTKEKGATLLCALLVRVE

SEQ ID NO: 56073 - protein, 1562 aa, Homo sapiens
  Payload ID: 11028
  Gene Symbol: NEURL4
  Gene Name: neuralized E3 ubiquitin protein ligase 4
  Uniprot ID: Q96JN8
  ENSP ID: ENSP00000382390
MAAGSGGSGGSGGGPGPGPGGGGGPSGSGSGPGSNGGLGSGGELHPRTGRLVSLSACGRTARRQQPGQEFNHGLVLSREPLRDGRVFTVRIDRKVNSWSGSIEIGVTALDPSVLDFPSSATGLKGGSWVVSGCSVLRDGRSVLEEYGQDLDQLGEGDRVGVERTVAGELRLWVNGRDCGVAATGLPPRVWAVVDLYGKCTQITVLPPEPGFSPPTPIPTPPLEPLAPTEDSALAEQGTSADEAFMVSPAQARPETFPNSLESHNDFANMELSEVVSNTILSAYNGGLLNVNLSSPPAGEGLGSSGAATSPILTSNDALLFHEKCGTLIKLSNNNKTAERRRPLDEFNNGVVMTNRPLRDNEMFEIRIDKLVDKWSGSIEIGVTTHNPNSLEYPATMTNLQSGTIMMSGCGILTNGKGTRREYCEFSLDELQEGDHIGLTRKSNSALHFFINGIDQGVATPLTPPVVYGVVDLYGMAVKVTIVHNNNHSDRLRRNNAILRALSPEGALRRAAPAAQAEPERLLFHPNCGQKAAITHEGRTALRPHATDDFNHGVVLSSRALRDGEVFQVRIDKMVDKWAGSIEIGVTTHNPAYLQLPSTMTNLRSGTWMMTGNGVMHNGTTILDEYGHNLDRLKAGDTVGVVRREDGTLHFFVNGMTQGPAAWNVPPGVYAVVDLYGQAAQATIVDDVEVAPVPEPLPEGNNQVSPSSPSSGAGGSDLRFHQLHGSNAVITNGGRTALRHNCRSEFNDAIVISNRALRDGELFEIVIQKMVDRWSGSIEAGVTAIRPEDLEFPNTMTDIDYDTWMLSGTAIMQDGNTMRNNYGCDLDALGTGARIGMMRTAKGDLHYFINGQDQGAACSGLPPGKEVYAVVDLYGQCVQVSITNATGPMDNSLATSNTATEKSFPLHSPVAGVAHRFHSTCGKNVTLEEDGTRAVRAAGYAHGLVFSTKELRAEEVFEVKVEELDEKWAGSLRLGLTTLAPGEMGPGAGGGGPGLPPSLPELRTKTTWMVSSCEVRRDGQLQRMNYGRNLERLGVGSRVGVRRGADDTMHILVDGEDMGPAATGIAKNVWAVLDLYGPVRGVSIVSSTRLEESEGTQPPSPSSDTGSEGEEDDEGEEHGLGGQNEVGIIPTTLEFLENHGKNILLSNGNRTATRVASYNQGIVVINQPLVPQLLVQVRIDFLNRQWTSSLVLGVITCAPERLNFPASACALKRAAWLLRGRGVFHNGLKICEKFGPNLDTCPEGTILGLRLDSSGGLHLHVNGVDQGVAVPDVPQPCHALVDLYGQCEQVTIVNPEPGAASGKSAGTQGDMEKADMVDGIKESVCWGPPPAASPLKSCEYHALCSRFQELLLLPEDYFMPPPKRSLCYCESCRKLRGDEAHRRRGEPPREYALPFGWCRFNLRVNPRLEAGTLTKKWHMAYHGSNVAAVRRVLDRGELGAGTASILSCRPLKGEPGVGFEEPGENCAPPREEQPPPVLLSPSLQYAGAETLASKVQFRDPKSQRTHQAQVAFQVCVRPGSYTPGPPSAALGEPPDPHFSPAELEWVTKEKGATLLCALLVRVE

SEQ ID NO: 56074 - protein, 1430 aa, Homo sapiens
  Payload ID: 11028
  Gene Symbol: NEURL4
  Gene Name: neuralized E3 ubiquitin protein ligase 4
  ENSP ID: ENSP00000458469
  MOD_RES (1)..(1): Any amino acid
XPGPGGGGGPSGSGSGPGSNGGLGSGGELHPRTGRLVSLSACGRTARRQQPGQEFNHGLVLSREPLRDGRVFTVRIDRKVNSWSGSIEIGVTALDPSVLDFPSSATGLKGGSWVVSGCSVLRDGRSVLEEYGQDLDQLGEGDRVGVERTVAGELRLWVNGRDCGVAATGLPPRVWAVVDLYGKCTQITVLPPEPGFSPPTPIPTPPLEPLAPTEDSALAEQGTSADEDFANMELSEVVSNTILSAYNGGLLNVNLSSPPAGEGLGSSGAATSPILTSNDALLFHEKCGTLIKLSNNNKTAERRRPLDEFNNGVVMTNRPLRDNEMFEIRIDKLVDKWSGSIEIGVTTHNPNSLEYPATMTNLQSGTIMMSGCGILTNGKGTRREYCEFSLDELQEGDHIGLTRKSNSALHFFINGIDQGVATPLTPPVVYGVVDLYGMAVKVTIVHNNNHSDRLRRNNAILRALSPEGALRRAAPAAQAEPERLLFHPNCGQKAAITHEGRTALRPHATDDFNHGVVLSSRALRDGEVFQVRIDKMVDKWAGSIEIGVTTHNPAYLQLPSTMTNLRSGTWMMTGNGVMHNGTTILDEYGHNLDRLKAGDTVGVVRREDGTLHFFVNGMTQGPAAWNVPPGVYAVVDLYGQAAQATIVDDVEVAPVPEPLPEGNNQVSPSSPSSGAGGSDLRFHQLHGSNAVITNGGRTALRHNCRSEFNDAIVISNRALRDGELFEIVIQKMVDRWSGSIEAGVTAIRPEDLEFPNTMTDIDYDTWMLSGTAIMQDGNTMRNNYGCDLDALGTGARIGMMRTAKGDLHYFINGQDQGAACSGLPPGKEVYAVVDLYGQCVQVSITNATGPMDNSLATSNTATEKSFPLHSPVAGVAHRFHSTCGKNVTLEEDGTRAVRAAGYAHGLVFSTKELRAEEVFEVKVEELDEKWAGSLRLGLTTLAPGEMGPGAGGGGPGLPPSLPELRTKTTWMVSSCEVRRDGQLQRMNYGRNLERLGVGSRVGVRRGADDTMHILVDGEDMGPAATGIAKNVWAVLDLYGPVRGVSIVSSTRLEESEGTQPPSPSSDTGSEGEEDDEGEEHGLGGQNEVGIIPTTLEFLENHGKNILLSNGNRTATRVASYNQGIVVINQPLVPQLLVQVRIDFLNRQWTSSLVLGVITCAPERLNFPASACALKRAAWLLRGRGVFHNGLKICEKFGPNLDTCPEGTILGLRLDSSGGLHLHVNGVDQGVAVPDVPQPCHALVDLYGQCEQVTIVNPEPGAASGKSAGTQGDMEKADMVDGIKESVCWGPPPAASPLKSCEYHALCSRFQELLLLPEDYFMPPPKRSLCYCESCRKLRGDEAHRRRGEPPREYALPFGWCRFNLRVNPRLEAGTLTKKWHMAYHGSNVAAVRRVLDRGELGAGTASILSCRPLKGEPGVGFEEPGENCAP

SEQ ID NO: 56075 - protein, 1538 aa, Homo sapiens
  Payload ID: 11028
  Gene Symbol: NEURL4
  Gene Name: neuralized E3 ubiquitin protein ligase 4
  ENSP ID: ENSP00000459978
MAAGSGGSGGSGGGPGPGPGGGGGPSGSGSGPGSNGGLGSGGELHPRTGRLVSLSACGRTARRQQPGQEFNHGLVLSREPLRDGRVFTVRIDRKVNSWSGSIEIGVTALDPSVLDFPSSATGLKGGSWVVSGCSVLRDGRSVLEEYGQDLDQLGEGDRVGVERTVAGELRLWVNGRDCGVAATGLPPRVWAVVDLYGKCTQITVLPPEPGFSPPTPIPTPPLEPLAPTEDSALAEQGTSADEDFANMELSEVVSNTILSAYNGGLLNVNLSSPPAGEGLGSSGAATSPILTSNDALLFHEKCGTLIKLSNNNKTAERRRPLDEFNNGVVMTNRPLRDNEMFEIRIDKLVDKWSGSIEIGVTTHNPNSLEYPATMTNLQSGTIMMSGCGILTNGKGTRREYCEFSLDELQEGDHIGLTRKSNSALHFFINGIDQGVATPLTPPVVYGVVDLYGMAVKVTIVHNNNHSDRLRRNNAILRALSPEGALRRAAPAAQAEPERLLFHPNCGQKAAITHEGRTALRPHATDDFNHGVVLSSRALRDGEVFQVRIDKMVDKWAGSIEIGVTTHNPAYLQLPSTMTNLRSGTWMMTGNGVMHNGTTILDEYGHNLDRLKAGDTVGVVRREDGTLHFFVNGMTQGPAAWNVPPGVYAVVDLYGQAAQATIVDDVEVAPVPEPLPEGNNQVSPSSPSSGAGGSDLRFHQLHGSNAVITNGGRTALRHNCRSEFNDAIVISNRALRDGELFEIVIQKMVDRWSGSIEAGVTAIRPEDLEFPNTMTDIDYDTWMLSGTAIMQDGNTMRNNYGCDLDALGTGARIGMMRTAKGDLHYFINGQDQGAACSGLPPEVYAVVDLYGQCVQVSITNATGPMDNSLATSNTATEKSFPLHSPVAGVAHRFHSTCGKNVTLEEDGTRAVRAAGYAHGLVFSTKELRAEEVFEVKVEELDEKWAGSLRLGLTTLAPGEMGPGAGGGGPGLPPSLPELRTKTTWMVSSCEVRRDGQLQRMNYGRNLERLGVGSRVGVRRGADDTMHILVDGEDMGPAATGIAKNVWAVLDLYGPVRGVSIVSSTRLEESEGTQPPSPSSDTGSEGEEDDEGEEHGLGGQNEVGIIPTTLEFLENHGKNILLSNGNRTATRVASYNQGIVVINQPLVPQLLVQVRIDFLNRQWTSSLVLGVITCAPERLNFPASACALKRAAWLLRGRGVFHNGLKICEKFGPNLDTCPEGTILGLRLDSSGGLHLHVNGVDQGVAVPDVPQPCHALVDLYGQCEQVTIVNPEPGAASGKSAGTQGDMEKADMVDGIKESVCWGPPPAASPLKSCEYHALCSRFQELLLLPEDYFMPPPKRSLCYCESCRKLRGDEAHRRRGEPPREYALPFGWCRFNLRVNPRLEAGTLTKKWHMAYHGSNVAAVRRVLDRGELGAGTASILSCRPLKGEPGVGFEEPGENCAPPREEQPPPVLLSPSLQYAGAETLASKVQFRDPKSQRTHQAQVAFQVCVRPGSYTPGPPSAALGEPPDPHFSPAELEWVTKEKGATLLCALLVRVE

SEQ ID NO: 56076 - protein, 1017 aa, Homo sapiens
  Payload ID: 11028
  Gene Symbol: NEURL4
  Gene Name: neuralized E3 ubiquitin protein ligase 4
  ENSP ID: ENSP00000460062
EPLAPTEDSALAEQGTSADEAFMVSPAQARPETFPNSLESHNGEGLGSSGAATSPILTSNDALLFHEKCGTLIKLSNNNKTAERRRPLDEFNNGVVMTNRPLRDNEMFEIRIDKLVDKWSGSIEIGVTTHNPNSLEYPATMTNLQSGTIMMSGCGILTNGKGTRREYCEFSLDELQEGDHIGLTRKSNSALHFFINGIDQGVATPLTPPVVYGVVDLYGMAVKVTIVHNNNHSDRLRRNNAILRALSPEGALRRAAPAAQAEPERLLFHPNCGQKAAITHEGRTALRPHATDDFNHGVVLSSRALRDGEVFQVRIDKMVDKWAGSIEIGVTTHNPAYLQLPSTMTNLRSGTWMMTGNGVMHNGTTILDEYGHNLDRLKAGDTVGVVRREDGTLHFFVNGMTQGPAAWNVPPGVYAVVDLYGQAAQATIVDDVEVAPVPEPLPEGNNQVSPSSPSSGAGGSDLRFHQLHGSNAVITNGGRTALRHNCRSEFNDAIVISNRALRDGELFEIVIQKMVDRWSGSIEAGVTAIRPEDLEFPNTMTDIDYDTWMLSGTAIMQDGNTMRNNYGCDLDALGTGARIGMMRTAKGDLHYFINGQDQGAACSGLPPGKEVYAVVDLYGQCVQVSITNATGPMDNSLATSNTATEKSFPLHSPVAGVAHRFHSTCGKNVTLEEDGTRAVRAAGYAHGLVFSTKELRAEEVFEVKVEELDEKWAGSLRLGLTTLAPGEMGPGAGGGGPGLPPSLPELRTKTTWMVSSCEVRRDGQLQRMNYGRNLERLGVGSRVGVRRGADDTMHILVDGEDMGPAATGIAKNVWAVLDLYGPVRGVSIVSSTRLEESEGTQPPSPSSDTGSEGEEDDEGEEHGLGGQNEVGIIPTTLEFLENHGKNILLSNGNRTATRVASYNQGIVVINQPLVPQLLVQVRIDFLNRQWTSSLVLGVITCAPERLNFPASACALKRAAWLLRGRGVFHNGLKPVSPPRSARSLGPIWTRALKAPSWDCGWTALGGCIFMLMGWTRG

SEQ ID NO: 56077 - protein, 249 aa, Homo sapiens
  Payload ID: 11028
  Gene Symbol: NEURL4
  Gene Name: neuralized E3 ubiquitin protein ligase 4
  ENSP ID: ENSP00000467514
EKCGTLIKLSNNNKTAERRRPLDEFNNGVVMTNRPLRDNEMFEIRIDKLVDKWSGSIEIGVTTHNPNSLEYPATMTNLQSGTIMMSGCGILTNGKGTRREYCEFSLDELQEGDHIGLTRKSNSALHFFINGIDQGVATPLTPPVVYGVVDLYGMAVKVTIVHNNNHSDRLRRNNAILRALSPEGALRRAAPAAQAEPERLLFHPNCGQKAAITHEGRTALRPHATDDFNHGVVLSSRALRDGEVFQGPG

SEQ ID NO: 56078 - protein, 645 aa, Homo sapiens
  Payload ID: 11029
  Gene Symbol: NRG1
  Gene Name: neuregulin 1
  Uniprot ID: Q02297
  ENSP ID: ENSP00000287842
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 56079 - protein, 637 aa, Homo sapiens
  Payload ID: 11029
  Gene Symbol: NRG1
  Gene Name: neuregulin 1
  Uniprot ID: Q02297
  ENSP ID: ENSP00000349275
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 56080 - protein, 640 aa, Homo sapiens
  Payload ID: 11029
  Gene Symbol: NRG1
  Gene Name: neuregulin 1
  Uniprot ID: Q02297
  ENSP ID: ENSP00000384620
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 56081 - protein, 135 aa, Homo sapiens
  Payload ID: 11029
  Gene Symbol: NRG1
  Gene Name: neuregulin 1
  ENSP ID: ENSP00000428411
MQIPKHISIEDITATSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNI

SEQ ID NO: 56082 - protein, 101 aa, Homo sapiens
  Payload ID: 11029
  Gene Symbol: NRG1
  Gene Name: neuregulin 1
  ENSP ID: ENSP00000428546
MQIPKHISIEDITATSTSTTGTSHLVKCAEKEKTFCVNGGECFMVKDLSNPSRYLCKCPNEFTGDRCQNYVMASFYKHLGIEFMEAEELYQKRVLTITGIC

SEQ ID NO: 56083 - protein, 462 aa, Homo sapiens
  Payload ID: 11029
  Gene Symbol: NRG1
  Gene Name: neuregulin 1
  Uniprot ID: Q02297
  ENSP ID: ENSP00000428828
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRSSSIPHLGFIL

SEQ ID NO: 56084 - protein, 713 aa, Homo sapiens
  Payload ID: 11029
  Gene Symbol: NRG1
  Gene Name: neuregulin 1
  ENSP ID: ENSP00000429067
VPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 56085 - protein, 590 aa, Homo sapiens
  Payload ID: 11029
  Gene Symbol: NRG1
  Gene Name: neuregulin 1
  Uniprot ID: Q02297
  ENSP ID: ENSP00000429582
MGKGRAGRVGTTALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPASPLRIVEDEEYETTQEYEPAQEPVKKLANSRRAKRTKPNGHIANRLEVDSNTSSQSSNSESETEDERVGEDTPFLGIQNPLAASLEATPAFRLADSRTNPAGRFSTQEEIQARLSSVIANQDPIAV

SEQ ID NO: 56086 - protein, 481 aa, Homo sapiens
  Payload ID: 11029
  Gene Symbol: NRG1
  Gene Name: neuregulin 1
  ENSP ID: ENSP00000430053
MGKGRAGRVGTTALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSATSTSTTGTSHLVKCAEKEKTFCVNGGECFMVKDLSNPSRYLCKCPNEFTGDRCQNYVMASFYKHLGIEFMEAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERYVSAMTTPARMSPVDFHTPSSPKSPPSEMSPPVSSMTVSMPSMAVSPFMEEERPLLLVTPPRLREKKFDHHPQQFSSFHHNPAHDSNSLPA

SEQ ID NO: 56087 - protein, 420 aa, Homo sapiens
  Payload ID: 11029
  Gene Symbol: NRG1
  Gene Name: neuregulin 1
  Uniprot ID: Q02297
  ENSP ID: ENSP00000430120
MSERKEGRGKGKGKKKERGSGKKPESAAGSQSPALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLCKCPNEFTGDRCQNYVMASFYKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSER

SEQ ID NO: 56088 - protein, 128 aa, Homo sapiens
  Payload ID: 11029
  Gene Symbol: NRG1
  Gene Name: neuregulin 1
  ENSP ID: ENSP00000430862
MQIPKHISIEDITATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSL

SEQ ID NO: 56089 - protein, 126 aa, Homo sapiens
  Payload ID: 11029
  Gene Symbol: NRG1
  Gene Name: neuregulin 1
  ENSP ID: ENSP00000432052
  MOD_RES (1)..(1): Any amino acid
XASANITIVESNEIITGMPASTEGAYVSSESPIRISVSTEGANTSSSTSTSTTGTSHLVKCAEKEKTFCVNGGECFMVKDLSNPSRYLCKCQPGFTGARCTENVPMKVQNQESAQMSLLVIAAKTT

SEQ ID NO: 56090 - protein, 296 aa, Homo sapiens
  Payload ID: 11029
  Gene Symbol: NRG1
  Gene Name: neuregulin 1
  Uniprot ID: Q02297
  ENSP ID: ENSP00000433289
MEIYSPDMSEVAAERSSSPSTQLSADPSLDGLPAAEDMPEPQTEDGRTPGLVGLAVPCCACLEAERLRGCLNSEKICIVPILACLVSLCLCIAGLKWVFVDKIFEYDSPTHLDPGGLGQDPIISLDATAASAVWVSSEAYTSPVSRAQSESEVQVTVQGDKAVVSFEPSAAPTPKNRIFAFSFLPSTAPSFPSPTRNPEVRTPKSATQPQTTETNLQTAPKLSTSTSTTGTSHLVKCAEKEKTFCVNGGECFMVKDLSNPSRYLCKCPNEFTGDRCQNYVMASFYSTSTPFLSLPE

SEQ ID NO: 56091 - protein, 196 aa, Homo sapiens
  Payload ID: 11029
  Gene Symbol: NRG1
  Gene Name: neuregulin 1
  ENSP ID: ENSP00000433350
PQTEDGRTPGLVGLAVPCCACLEAERLRGCLNSEKICIVPILACLVSLCLCIAGLKWVFVDKIFEYDSPTHLDPGGLGQDPIISLDATAASAVWVSSEAYTSPVSRAQSESEVQVTVQGDKAVVSFEPSAAPTPKNRIFAFSFLPSTAPSFPSPTRNPEVRTPKSATQPQTTETNLQTAPKLCAQMSLLVIAAKTT

SEQ ID NO: 56092 - protein, 422 aa, Homo sapiens
  Payload ID: 11029
  Gene Symbol: NRG1
  Gene Name: neuregulin 1
  Uniprot ID: Q02297
  ENSP ID: ENSP00000434640
MRWRRAPRRSGRPGPRAQRPGSAARSSPPLPLLPLLLLLGTAALAPGAAAGNEAAPAGASVCYSSPPSVGSVQELAQRAAVVIEGKVHPQRRQQGALDRKAAAAAGEAGAWGGDREPPAAGPRALGPPAEEPLLAANGTVPSWPTAPVPSAGEPGEEAPYLVKVHQVWAVKAGGLKKDSLLTVRLGTWGHPAFPSCGRLKEDSRYIFFMEPDANSTSRAPAAFRASFPPLETGRNLKKEVSRVLCKRCALPPRLKEMKSQESAAGSKLVLRCETSSEYSSLRFKWFKNGNELNRKNKPQNIKIQKKPGKSELRINKASLADSGEYMCKVISKLGNDSASANITIVESNATSTSTTGTSHLVKCAEKEKTFCVNGGECFMVKDLSNPSRYLCKCPNEFTGDRCQNYVMASFYSTSTPFLSLPE

SEQ ID NO: 56093 - protein, 308 aa, Homo sapiens
  Payload ID: 11029
  Gene Symbol: NRG1
  Gene Name: neuregulin 1
  ENSP ID: ENSP00000439276
MQIPKHISIEDITATSTSTTGTSHLVKCAEKEKTFCVNGGECFMVKDLSNPSRYLCKCQPGFTGARCTENVPMKVQNQEKAEELYQKRVLTITGICIALLVVGIMCVVAYCKTKKQRKKLHDRLRQSLRSERNNMMNIANGPHHPNPPPENVQLVNQYVSKNVISSEHIVEREAETSFSTSHYTSTAHHSTTVTQTPSHSWSNGHTESILSESHSVIVMSSVENSRHSSPTGGPRGRLNGTGGPRECNSFLRHARETPDSYRDSPHSERHNLIAELRRNKAHRSKCMQIQLSATHLRSSSIPHLGFIL

SEQ ID NO: 56094 - protein, 254 aa, Homo sapiens [sequence omitted]

SEQ ID NO: 56095 - protein, 193 aa, Homo sapiens
  Payload ID: 11029
  Gene Symbol: NRG1
  Gene Name: neuregulin 1
  ENSP ID: ENSP00000486375
MKKRNEMIFLATLKNKALPPRLKEMKSQESAAGSKLVLRCETSSEYSSLRFKWFKNGNELNRKNKPQNIKIQKKPGKSELRINKASLADSGEYMCKVISKLGNDSASANITIVESNEIITGMPASTEGAYVSSESPIRISVSTEGANTSSSTSTSTTGTSHLVKCAEKEKTFCVNGGECFMVKDLSNPSRYLC

SEQ ID NO: 56096 - protein, 844 aa, Homo sapiens
  Payload ID: 11030
  Gene Symbol: NRG2
  Gene Name: neuregulin 2
  Uniprot ID: O14511
  ENSP ID: ENSP00000289409
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPVGYTGDRCQQFAMVNFSKAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 56097 - protein, 858 aa, Homo sapiens
  Payload ID: 11030
  Gene Symbol: NRG2
  Gene Name: neuregulin 2
  Uniprot ID: O14511
  ENSP ID: ENSP00000289422
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPNGFFGQRCLEKLPLRLYMPDPKQKHLGFELKEAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 56098 - protein, 647 aa, Homo sapiens
  Payload ID: 11030
  Gene Symbol: NRG2
  Gene Name: neuregulin 2
  Uniprot ID: O14511
  ENSP ID: ENSP00000342660
MSESRRRGRGRGKKHPEGRKREREPDPGEKATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPNGFFGQRCLEKLPLRLYMPDPKQKAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 56099 - protein, 852 aa, Homo sapiens
  Payload ID: 11030
  Gene Symbol: NRG2
  Gene Name: neuregulin 2
  Uniprot ID: O14511
  ENSP ID: ENSP00000351323
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPVGYTGDRCQQFAMVNFSKHLGFELKEAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 56100 - protein, 850 aa, Homo sapiens
  Payload ID: 11030
  Gene Symbol: NRG2
  Gene Name: neuregulin 2
  Uniprot ID: O14511
  ENSP ID: ENSP00000354910
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPNGFFGQRCLEKLPLRLYMPDPKQKAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 56101 - protein, 426 aa, Homo sapiens
  Payload ID: 11030
  Gene Symbol: NRG2
  Gene Name: neuregulin 2
  Uniprot ID: O14511
  ENSP ID: ENSP00000367483
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPNGFFGQRCLEKLPLRLYMPDPKQSVLWDTPGTGVSSSQWSTSPKPRSCTRRGS

SEQ ID NO: 56102 - protein, 784 aa, Homo sapiens
  Payload ID: 11030
  Gene Symbol: NRG2
  Gene Name: neuregulin 2
  ENSP ID: ENSP00000444235
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSEAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 56103 - protein, 696 aa, Homo sapiens
  Payload ID: 11031
  Gene Symbol: NRG3
  Gene Name: neuregulin 3
  Uniprot ID: P56975
  ENSP ID: ENSP00000361214
MSEGAAAASPPGAASAAAASAEEGTAAAAAAAAAGGGPDGGGEGAAEPPRELRCSDCIVWNRQQTWLCVVPLFIGFIGLGLSLMLLKWIVVGSVKEYVPTDLVDSKGMGQDPFFLSKPSSFPKAMETTTTTTSTTSPATPSAGGAASSRTPNRISTRLTTITRAPTRFPGHRVPIRASPRSTTARNTAAPATVPSTTAPFFSSSTLGSRPPVPGTPSTQAMPSWPTAAYATSSYLHDSTPSWTLSPFQDAASSSSSSSSSATTTTPETSTSPKFHTTTYSTERSEHFKPCRDKDLAYCLNDGECFVIETLTGSHKHCRCKEGYQGVRCDQFLPKTDSILSDPTDHLGIEFMESEEVYQRQVLSISCIIFGIVIVGMFCAAFYFKSKKQAKQIQEQLKVPQNGKSYSLKASSTMAKSENLVKSHVQLQNYSKVERHPVTALEKMMESSFVGPQSFPEVPSPDRGSQSVKHHRSLSSCCSPGQRSGMLHRNAFRRTPPSPRSRLGGIVGPAYQQLEESRIPDQDTIPCQGYSSSGLKTQRNTSINMQLPSRETNPYFNSLEQKDLVGYSSTRASSVPIIPSVGLEETCLQMPGISEVKSIKWCKNSYSADVVNVSIPVSDCLIAEQQEVKILLETVQEQIRILTDARRSEDYELASVETEDSASENTAFLPLSPTAKSEREAQFVLRNEIQRDSALTK

SEQ ID NO: 56104 - protein, 499 aa, Homo sapiens
  Payload ID: 11031
  Gene Symbol: NRG3
  Gene Name: neuregulin 3
  Uniprot ID: P56975
  ENSP ID: ENSP00000361215
MECGIPPTLVCVGRGGGLHTINIIIWYYFPSAWRTCFNISSSVGLLLTNSYKFYTTTYSTERSEHFKPCRDKDLAYCLNDGECFVIETLTGSHKHCRCKEGYQGVRCDQFLPKTDSILSDPTDHLGIEFMESEEVYQRQVLSISCIIFGIVIVGMFCAAFYFKSKKQAKQIQEQLKVPQNGKSYSLKASSTMAKSENLVKSHVQLQNYSKVERHPVTALEKMMESSFVGPQSFPEVPSPDRGSQSVKHHRSLSSCCSPGQRSGMLHRNAFRRTPPSPRSRLGGIVGPAYQQLEESRIPDQDTIPCQGIEVRKTISHLPIQLWCVERPLDLKYSSSGLKTQRNTSINMQLPSRETNPYFNSLEQKDLVGYSSTRASSVPIIPSVGLEETCLQMPGISEVKSIKWCKNSYSADVVNVSIPVSDCLIAEQQEVKILLETVQEQIRILTDARRSEDYELASVETEDSASENTAFLPLSPTAKSEREAQFVLRNEIQRDSALTK

SEQ ID NO: 56105 - protein, 720 aa, Homo sapiens
  Payload ID: 11031
  Gene Symbol: NRG3
  Gene Name: neuregulin 3
  Uniprot ID: P56975
  ENSP ID: ENSP00000384796
MSEGAAAASPPGAASAAAASAEEGTAAAAAAAAAGGGPDGGGEGAAEPPRELRCSDCIVWNRQQTWLCVVPLFIGFIGLGLSLMLLKWIVVGSVKEYVPTDLVDSKGMGQDPFFLSKPSSFPKAMETTTTTTSTTSPATPSAGGAASSRTPNRISTRLTTITRAPTRFPGHRVPIRASPRSTTARNTAAPATVPSTTAPFFSSSTLGSRPPVPGTPSTQAMPSWPTAAYATSSYLHDSTPSWTLSPFQDAASSSSSSSSSATTTTPETSTSPKFHTTTYSTERSEHFKPCRDKDLAYCLNDGECFVIETLTGSHKHCRCKEGYQGVRCDQFLPKTDSILSDPTDHLGIEFMESEEVYQRQVLSISCIIFGIVIVGMFCAAFYFKSKKQAKQIQEQLKVPQNGKSYSLKASSTMAKSENLVKSHVQLQNYSKVERHPVTALEKMMESSFVGPQSFPEVPSPDRGSQSVKHHRSLSSCCSPGQRSGMLHRNAFRRTPPSPRSRLGGIVGPAYQQLEESRIPDQDTIPCQGIEVRKTISHLPIQLWCVERPLDLKYSSSGLKTQRNTSINMQLPSRETNPYFNSLEQKDLVGYSSTRASSVPIIPSVGLEETCLQMPGISEVKSIKWCKNSYSADVVNVSIPVSDCLIAEQQEVKILLETVQEQIRILTDARRSEDYELASVETEDSASENTAFLPLSPTAKSEREAQFVLRNEIQRDSALTK

SEQ ID NO: 56106 - protein, 500 aa, Homo sapiens
  Payload ID: 11031
  Gene Symbol: NRG3
  Gene Name: neuregulin 3
  ENSP ID: ENSP00000385804
MECGIPPTLVCVGRGGGLHTVGVFHVLSQLISLCTIPEVFKEKPKINIIIWYYFPSAWRTCFNISSSVGLLLTNSYKFYTTTYSTERSEHFKPCRDKDLAYCLNDGECFVIETLTGSHKHCRCKEGYQGVRCDQFLPKTDSILSDPTDHLGIEFMESEEVYQRQVLSISCIIFGIVIVGMFCAAFYFKSKKQAKQIQEQLKVPQNGKSYSLKASSTMAKSENLVKSHVQLQNYSKVERHPVTALEKMMESSFVGPQSFPEVPSPDRGSQSVKHHRSLSSCCSPGQRSGMLHRNAFRRTPPSPRSRLGGIVGPAYQQLEESRIPDQDTIPCQGYSSSGLKTQRNTSINMQLPSRETNPYFNSLEQKDLVGYSSTRASSVPIIPSVGLEETCLQMPGISEVKSIKWCKNSYSADVVNVSIPVSDCLIAEQQEVKILLETVQEQIRILTDARRSEDYELASVETEDSASENTAFLPLSPTAKSEREAQFVLRNEIQRDSALTK

SEQ ID NO: 56107 - protein, 346 aa, Homo sapiens
  Payload ID: 11031
  Gene Symbol: NRG3
  Gene Name: neuregulin 3
  ENSP ID: ENSP00000440377
MESEEVYQRQVLSISCIIFGIVIVGMFCAAFYFKSKKQAKQIQEQLKVPQNGKSYSLKASSTMAKSENLVKSHVQLQNYSKVERHPVTALEKMMESSFVGPQSFPEVPSPDRGSQSVKHHRSLSSCCSPGQRSGMLHRNAFRRTPPSPRSRLGGIVGPAYQQLEESRIPDQDTIPCQGYSSSGLKTQRNTSINMQLPSRETNPYFNSLEQKDLVGYSSTRASSVPIIPSVGLEETCLQMPGISEVKSIKWCKNSYSADVVNVSIPVSDCLIAEQQEVKILLETVQEQIRILTDARRSEDYELASVETEDSASENTAFLPLSPTAKSEREAQFVLRNEIQRDSALTK

SEQ ID NO: 56108 - protein, 346 aa, Homo sapiens; identical to SEQ ID NO: 56107
  Payload ID: 11031
  Gene Symbol: NRG3
  Gene Name: neuregulin 3
  ENSP ID: ENSP00000441201

SEQ ID NO: 56109 - protein, 526 aa, Homo sapiens
  Payload ID: 11031
  Gene Symbol: NRG3
  Gene Name: neuregulin 3
  ENSP ID: ENSP00000451376
MECGIPPTLVCVGRGGGLHTVGVFHVLSQLISLCTIPEVFKEKPKINIIIWYYFPSAWRTCFNISSSVGLLLTNSYKFCPRDRRHAIHGNMGKTRVVRRQKQEQDTTTYSTERSEHFKPCRDKDLAYCLNDGECFVIETLTGSHKHCRCKEGYQGVRCDQFLPKTDSILSDPTDHLGIEFMESEEVYQRQVLSISCIIFGIVIVGMFCAAFYFKSKKQAKQIQEQLKVPQNGKSYSLKASSTMAKSENLVKSHVQLQNYSKVERHPVTALEKMMESSFVGPQSFPEVPSPDRGSQSVKHHRSLSSCCSPGQRSGMLHRNAFRRTPPSPRSRLGGIVGPAYQQLEESRIPDQDTIPCQGYSSSGLKTQRNTSINMQLPSRETNPYFNSLEQKDLVGYSSTRASSVPIIPSVGLEETCLQMPGISEVKSIKWCKNSYSADVVNVSIPVSDCLIAEQQEVKILLETVQEQIRILTDARRSEDYELASVETEDSASENTAFLPLSPTAKSEREAQFVLRNEIQRDSALTK

SEQ ID NO: 56110 - protein, 76 aa, Homo sapiens
  Payload ID: 11031
  Gene Symbol: NRG3
  Gene Name: neuregulin 3
  ENSP ID: ENSP00000451858
MECGIPPTLVCVGRGGGLHTVGVFHVLSQLISLCTIPEVFKEKPKIRRHIPQSDPSTSNPAETRTLHTVSMMASAL

SEQ ID NO: 56111 - protein, 54 aa, Homo sapiens
  Payload ID: 11031
  Gene Symbol: NRG3
  Gene Name: neuregulin 3
  ENSP ID: ENSP00000473669
MECGIPPTLVCVGRGGGLHTVFQRQKLLYELIATSPFWFHLRSSLQKPLSTFWN

SEQ ID NO: 56112 - protein, 115 aa, Homo sapiens
  Payload ID: 11032
  Gene Symbol: NRG4
  Gene Name: neuregulin 4
  Uniprot ID: Q8WWG1
  ENSP ID: ENSP00000378367
MPTDHEEPCGPSHKSFCLNGGLCYVIPTIPSPFCRCVENYTGARCEEVFLPGSSIQTKSNLFEAFVALAVLVTLIIGAFYFLCRKGHFQRASSVQYDINLVETSSTSAHHSHEQH

SEQ ID NO: 56113 - protein, 35 aa, Homo sapiens
  Payload ID: 11032
  Gene Symbol: NRG4
  Gene Name: neuregulin 4
  ENSP ID: ENSP00000431810
MPTDHEEPCGPSHKSFCLNGGLCYVIPTIPSPFCS

SEQ ID NO: 56114 - protein, 36 aa, Homo sapiens
  Payload ID: 11032
  Gene Symbol: NRG4
  Gene Name: neuregulin 4
  ENSP ID: ENSP00000432751
MPTDHEEPCGPSHKSFCLNGGLCYVIPTIPSPFCRK

SEQ ID NO: 56115 - protein, 36 aa, Homo sapiens; identical to SEQ ID NO: 56114
  Payload ID: 11032
  Gene Symbol: NRG4
  Gene Name: neuregulin 4
  ENSP ID: ENSP00000436832

SEQ ID NO: 56116 - protein, 36 aa, Homo sapiens; identical to SEQ ID NO: 56114
  Payload ID: 11032
  Gene Symbol: NRG4
  Gene Name: neuregulin 4
  ENSP ID: ENSP00000454895

SEQ ID NO: 56117 - protein, 110 aa, Homo sapiens
  Payload ID: 11032
  Gene Symbol: NRG4
  Gene Name: neuregulin 4
  ENSP ID: ENSP00000455167
MPTDHEEPCGPSHKSFCLNGGLCYVIPTIPSPFCRCVENYTGARCEEVFLPGSSIQTKSNLFEAFVALAVLVTLIIGAFYFLCRKGHFQRASSVQYDINLVETSSTSAHH

SEQ ID NO: 56118 - protein, 90 aa, Homo sapiens
  Payload ID: 11032
  Gene Symbol: NRG4
  Gene Name: neuregulin 4
  ENSP ID: ENSP00000455314
MPTDHEEPCGPSHKSFCLNGGLCYVIPTIPSPFCRCVENYTGARCEEVFLPGSSIQTKSNLFEAFVALAVLVTLIIGAFYFLCRCGNTCM

SEQ ID NO: 56119 - protein, 36 aa, Homo sapiens; identical to SEQ ID NO: 56114
  Payload ID: 11032
  Gene Symbol: NRG4
  Gene Name: neuregulin 4
  ENSP ID: ENSP00000456029

SEQ ID NO: 56120 - protein, 36 aa, Homo sapiens; identical to SEQ ID NO: 56114
  Payload ID: 11032
  Gene Symbol: NRG4
  Gene Name: neuregulin 4
  ENSP ID: ENSP00000456778

SEQ ID NO: 56121 - protein, 115 aa, Homo sapiens; identical to SEQ ID NO: 56112
  Payload ID: 11032
  Gene Symbol: NRG4
  Gene Name: neuregulin 4
  Uniprot ID: Q8WWG1
  ENSP ID: ENSP00000457335

SEQ ID NO: 56122 - protein, 36 aa, Homo sapiens; identical to SEQ ID NO: 56114
  Payload ID: 11032
  Gene Symbol: NRG4
  Gene Name: neuregulin 4
  ENSP ID: ENSP00000457626

SEQ ID NO: 56123 - protein, 35 aa, Homo sapiens; identical to SEQ ID NO: 56113
  Payload ID: 11032
  Gene Symbol: NRG4
  Gene Name: neuregulin 4
  ENSP ID: ENSP00000457838

SEQ ID NO: 56124 - protein, 146 aa, Homo sapiens
  Payload ID: 11033
  Gene Symbol: NRSN1
  Gene Name: neurensin 1
  ENSP ID: ENSP00000367736
MSSCSNVCGSRQAQAAAEGGYQRYGVRSYLHQFYEDCTASIWEYEDDFQIQRSPNRWSSVFWKQELGFHTSSHSQEWNRKLQHKNCPRCCFGSLSPPGEALLCRHWDWPYHPKAPGCSAEPGGGPFQSIPTLLCGPKRGCFASSEL

SEQ ID NO: 56125 - protein, 172 aa, Homo sapiens
  Payload ID: 11033
  Gene Symbol: NRSN1
  Gene Name: neurensin 1
  ENSP ID: ENSP00000367738
MSSCSNVCGSRQAQAAAEGGYQRYGVRSYLHQFYEDCTASIWEYEDDFQIQRSPNRWSSVFWKVGLISGTVFVILGLTVLAVGFLVPPKIEAFGEADFVVVDTHAVQFNSALDMYKLAGAVLFCIGGTSMAGCLLMSVFVKSYSKEEKFLQQKFKERIADIKAHTQPVTKAP

SEQ ID NO: 56126 - protein, 195 aa, Homo sapiens
  Payload ID: 11033
  Gene Symbol: NRSN1
  Gene Name: neurensin 1
  Uniprot ID: Q8IZ57
  ENSP ID: ENSP00000367739
MSSCSNVCGSRQAQAAAEGGYQRYGVRSYLHQFYEDCTASIWEYEDDFQIQRSPNRWSSVFWKVGLISGTVFVILGLTVLAVGFLVPPKIEAFGEADFVVVDTHAVQFNSALDMYKLAGAVLFCIGGTSMAGCLLMSVFVKSYSKEEKFLQQKFKERIADIKAHTQPVTKAPGPGETKIPVTLSRVQNVQPLLAT

SEQ ID NO: 56127 - protein, 195 aa, Homo sapiens; identical to SEQ ID NO: 56126
  Payload ID: 11033
  Gene Symbol: NRSN1
  Gene Name: neurensin 1
  Uniprot ID: Q8IZ57
  ENSP ID: ENSP00000367752

SEQ ID NO: 56128 - protein, 204 aa, Homo sapiens
  Payload ID: 11034
  Gene Symbol: NRSN2
  Gene Name: neurensin 2
  Uniprot ID: Q9GZP1
  ENSP ID: ENSP00000371722
MMPSCNRSCSCSRGPSVEDGKWYGVRSYLHLFYEDCAGTALSDDPEGPPVLCPRRPWPSLCWKISLSSGTLLLLLGVAALTTGYAVPPKLEGIGEGEFLVLDQRAADYNQALGTCRLAGTALCVAAGVLLAICLFWAMIGWLSQDTKAEPLDPEADSHVEVFGDEPEQQLSPIFRNASGQSWFSPPASPFGQSSVQTIQPKRDS

SEQ ID NO: 56129 - protein, 204 aa, Homo sapiens; identical to SEQ ID NO: 56128
  Payload ID: 11034
  Gene Symbol: NRSN2
  Gene Name: neurensin 2
  Uniprot ID: Q9GZP1
  ENSP ID: ENSP00000371728

SEQ ID NO: 56130 - protein, 69 aa, Homo sapiens
  Payload ID: 11034
  Gene Symbol: NRSN2
  Gene Name: neurensin 2
  ENSP ID: ENSP00000476543
  MOD_RES (1)..(1): Any amino acid
XLHLFYEDCAGTALSDDPEGPPVLCPRRPWPSLCWKISLSSGTLLLLLGVAALTTGYAVPPKLEGIGEG

SEQ ID NO: 56131 - protein, 161 aa, Homo sapiens
  Payload ID: 11034
  Gene Symbol: NRSN2
  Gene Name: neurensin 2
  ENSP ID: ENSP00000476925
MMPSCNRSCSCSRGPSVEDGKWYGVRSYLHLFYEDCAGTALSDDPEGPPVLCPRRPWPSLCWKISLSSGTLLLLLGVAALTTGYAVPPKLEGIGEGEFLVLDQRAADYNQALGTCRLAGTALCVAAGVLLAICLFWAMIGWLSQDTKAEPLDPEADSHVEV

SEQ ID NO: 56132 - protein, 113 aa, Homo sapiens
  Payload ID: 11034
  Gene Symbol: NRSN2
  Gene Name: neurensin 2
  ENSP ID: ENSP00000477135
MMPSCNRSCSCSRGPSVEDGKWYGVRSYLHLFYEDCAGTALSDDPEGPPVLCPRRPWPSLCWKISLSSGTLLLLLGVAALTTGYAVPPKLEGIGEGWLSQDTKAEPLDPEADS

SEQ ID NO: 56133 - protein, 82 aa, Homo sapiens
  Payload ID: 11034
  Gene Symbol: NRSN2
  Gene Name: neurensin 2
  ENSP ID: ENSP00000477183
MMPSCNRSCSCSRGPSVEDGKWYGVRSYLHLFYEDCAGTALSDDPEGPPVLCPRRPWPSLCWKEMELNFSPLECGLDSATCF

SEQ ID NO: 56134 - protein, 116 aa, Homo sapiens
  Payload ID: 11034
  Gene Symbol: NRSN2
  Gene Name: neurensin 2
  ENSP ID: ENSP00000477349
MMPSCNRSCSCSRGPSVEDGKWYGVRSYLHLFYEDCAGTALSDDPEGPPVLCPRRPWPSLCWKISLSSGTLLLLLGVAALTTGYAVPPKLEGIGEGWLSQDTKAEPLDPEADSHVE

SEQ ID NO: 56135 - protein, 65 aa, Homo sapiens
  Payload ID: 11034
  Gene Symbol: NRSN2
  Gene Name: neurensin 2
  ENSP ID: ENSP00000479642
MMPSCNRSCSCSRGPSVEDGKWYGVRSYLHLFYEDCAGTALSDDPEGPPVLCPRRPWPSLCWKMR

SEQ ID NO: 56136 - protein, 204 aa, Homo sapiens; identical to SEQ ID NO: 56128
  Payload ID: 11034
  Gene Symbol: NRSN2
  Gene Name: neurensin 2
  Uniprot ID: Q9GZP1
  ENSP ID: ENSP00000482706

SEQ ID NO: 56137 - protein, 442 aa, Homo sapiens
  Payload ID: 11035
  Gene Symbol: NRXN1
  Gene Name: neurexin 1
  Uniprot ID: P58400
  ENSP ID: ENSP00000341184
MYQRMLRCGAELGSPGGGGGGGGGGGAGGRLALLWIVPLTLSGLLGVAWGASSLGAHHIHHFHGSSKHHSVPIAIYRSPASLRGGHAGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 56138 - protein, 142 aa, Homo sapiens
  Payload ID: 11035
  Gene Symbol: NRXN1
  Gene Name: neurexin 1
  ENSP ID: ENSP00000367510
MDMRWHCENLQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 56139 - protein, 1477 aa, Homo sapiens
  Payload ID: 11035
  Gene Symbol: NRXN1
  Gene Name: neurexin 1
  Uniprot ID: Q9ULB1
  ENSP ID: ENSP00000384311
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 56140 - protein, 1507 aa, Homo sapiens
  Payload ID: 11035
  Gene Symbol: NRXN1
  Gene Name: neurexin 1
  ENSP ID: ENSP00000385017
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 56141 - protein, 1547 aa, Homo sapiens
  Payload ID: 11035
  Gene Symbol: NRXN1
  Gene Name: neurexin 1
  Uniprot ID: Q9ULB1
  ENSP ID: ENSP00000385142
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEIKFGLQCVLPVLLHDNDQGKYCCINTAKPLTEKDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVNKLHCSVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 56142 - protein, 278 aa, Homo sapiens
  Payload ID: 11035
  Gene Symbol: NRXN1
  Gene Name: neurexin 1
  ENSP ID: ENSP00000385310
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKD

SEQ ID NO: 56143 - protein, 836 aa, Homo sapiens
  Payload ID: 11035
  Gene Symbol: NRXN1
  Gene Name: neurexin 1
  ENSP ID: ENSP00000385434
GKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCND

SEQ ID NO: 56144 - protein, 472 aa, Homo sapiens
  Payload ID: 11035
  Gene Symbol: NRXN1
  Gene Name: neurexin 1
  ENSP ID: ENSP00000385580
MYQRMLRCGAELGSPGGGGGGGGGGGAGGRLALLWIVPLTLSGLLGVAWGASSLGAHHIHHFHGSSKHHSVPIAIYRSPASLRGGHAGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 56145 - protein, 851 aa, Homo sapiens
  Payload ID: 11035
  Gene Symbol: NRXN1
  Gene Name: neurexin 1
  ENSP ID: ENSP00000385681
GKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVNKLHCSVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCND

SEQ ID NO: 56146 - protein, 139 aa, Homo sapiens
  Payload ID: 11035
  Gene Symbol: NRXN1
  Gene Name: neurexin 1
  ENSP ID: ENSP00000396738
MDMRWHCENLQTTDDILVASAECPSDDEDIDPCEPSSANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 56147 - protein, 1495 aa, Homo sapiens
  Payload ID: 11035
  Gene Symbol: NRXN1
  Gene Name: neurexin 1
  ENSP ID: ENSP00000434015
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 56148 - protein, 198 aa, Homo sapiens
  Payload ID: 11035
  Gene Symbol: NRXN1
  Gene Name: neurexin 1
  ENSP ID: ENSP00000483634
MAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 56149 - protein, 87 aa, Homo sapiens
  Payload ID: 11035
  Gene Symbol: NRXN1
  Gene Name: neurexin 1
  ENSP ID: ENSP00000485723
PVNGKFNDNAWHDVKVTRNLRQVTISVDGILTTTGYTQEDYTMLGSDDFFYVGGSPSTADLPGSPVSNNFMGCLKEIKEKKGNHSTY

SEQ ID NO: 56150 - protein, 469 aa, Homo sapiens
  Payload ID: 11035
  Gene Symbol: NRXN1
  Gene Name: neurexin 1
  ENSP ID: ENSP00000485815
MYQRMLRCGAELGSPGGGGGGGGGGGAGGRLALLWIVPLTLSGLLGVAWGASSLGAHHIHHFHGSSKHHSVPIAIYRSPASLRGGHAGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 56151 - protein, 1496 aa, Homo sapiens
  Payload ID: 11035
  Gene Symbol: NRXN1
  Gene Name: neurexin 1
  ENSP ID: ENSP00000485887
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 56152 - protein, 277 aa, Homo sapiens
  Payload ID: 11035
  Gene Symbol: NRXN1
  Gene Name: neurexin 1
  ENSP ID: ENSP00000485912
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQDNNVEGLAHLMMGDQGKSKD

SEQ ID NO: 56153 - protein, 169 aa, Homo sapiens
  Payload ID: 11035
  Gene Symbol: NRXN1
  Gene Name: neurexin 1
  ENSP ID: ENSP00000486185
  MOD_RES (1)..(1): Any amino acid
XSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGQMAGDHTRLEF

SEQ ID NO: 56154 - protein, 213 aa, Homo sapiens
  Payload ID: 11035
  Gene Symbol: NRXN1
  Gene Name: neurexin 1
  ENSP ID: ENSP00000486253
DLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEVALMKADLQGPSTTCQEDSCSNQGVCLQQWDGFSCDCSMTSFSGPLCNDPGTTYIFSKGGGQITYKWPPNDRPSTRADRLAIGFSTVQKEAVLVRVDS

SEQ ID NO: 56155 - protein, 459 aa, Homo sapiens
  Payload ID: 11035
  Gene Symbol: NRXN1
  Gene Name: neurexin 1
  ENSP ID: ENSP00000486544
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPVSNNFMGCLKEVNIVAIRIIPNSWSHHFRSSMKAPLLKTRCSRVKRHNFKFNILLLFM

SEQ ID NO: 56156 - protein, 1499 aa, Homo sapiens
  Payload ID: 11035
  Gene Symbol: NRXN1
  Gene Name: neurexin 1
  Uniprot ID: Q9ULB1
  ENSP ID: ENSP00000486879
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 56157 - protein, 75 aa, Homo sapiens
  Payload ID: 11035
  Gene Symbol: NRXN1
  Gene Name: neurexin 1
  ENSP ID: ENSP00000486993
MVVGIVAAAALCILILLYAMYKYRNRDEGSYHVDESRNYISNSAQSNGAVVKEKQPSSAKSSNKNKKNKDKEYYV

SEQ ID NO: 56158 - protein, 126 aa, Homo sapiens
  Payload ID: 11035
  Gene Symbol: NRXN1
  Gene Name: neurexin 1
  ENSP ID: ENSP00000487165
  MOD_RES (1)..(1): Any amino acid
XPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQGLAHLMMGDQGMGSVPFPLCFQCFLVL

SEQ ID NO: 56159 - protein, 136 aa, Homo sapiens
  Payload ID: 11035
  Gene Symbol: NRXN1
  Gene Name: neurexin 1
  ENSP ID: ENSP00000487268
SSQVLPVDSGEVKLDDEPPNSGGGSPCEAGEEGEGGVCLNGGVCSVVDDQAVCDCSRTGFRGKDCSQEIKFGLQCVLPVLLHDNDQGKYCCINTAKPLTEKDNNVEGLAHLMMGDQGKSKEKLEIFRWIRKDFTNF

SEQ ID NO: 56160 - protein, 176 aa, Homo sapiens
  Payload ID: 11035
  Gene Symbol: NRXN1
  Gene Name: neurexin 1
  ENSP ID: ENSP00000489108
MTSGSKCPSTDSGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPIQHESTFAEDPMFQSQTAQL

SEQ ID NO: 56161 - protein, 62 aa, Homo sapiens
  Payload ID: 11035
  Gene Symbol: NRXN1
  Gene Name: neurexin 1
  ENSP ID: ENSP00000489258
MDMRWHCENLQTTDDILVASAECPSDDEDIDPCEPSSGTKQTMWKTSRDHRILPNARRERKD

SEQ ID NO: 56162 - protein, 903 aa, Homo sapiens
  Payload ID: 11035
  Gene Symbol: NRXN1
  Gene Name: neurexin 1
  ENSP ID: ENSP00000489573
MTSGSKCPSTDSGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLGKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHITLQ

SEQ ID NO: 56163 - protein, 1712 aa, Homo sapiens
  Payload ID: 11036
  Gene Symbol: NRXN2
  Gene Name: neurexin 2
  Uniprot ID: Q9P2S2
  ENSP ID: ENSP00000265459
MASGSRWRPTPPPLLLLLLLALAARADGLEFGGGPGQWARYARWAGAASSGELSFSLRTNATRALLLYLDDGGDCDFLELLLVDGRLRLRFTLSCAEPATLQLDTPVADDRWHMVLLTRDARRTALAVDGEARAAEVRSKRREMQVASDLFVGGIPPDVRLSALTLSTVKYEPPFRGLLANLKLGERPPALLGSQGLRGATADPLCAPARNPCANGGLCTVLAPGEVGCDCSHTGFGGKFCSEEEHPMEGPAHLTLNSEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQHAGIGHAMVNKLHYLVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGRRAGGGAGSHSSAQRADYFAMELLDGHLYLLLDMGSGGIKLRASSRKVNDGEWCHVDFQRDGRKGSISVNSRSTPFLATGDSEILDLESELYLGGLPEGGRVDLPLPPEVWTAALRAGYVGCVRDLFIDGRSRDLRGLAEAQGAVGVAPFCSRETLKQCASAPCRNGGVCREGWNRFICDCIGTGFLGRVCEREATVLSYDGSMYMKIMLPNAMHTEAEDVSLRFMSQRAYGLMMATTSRESADTLRLELDGGQMKLTVNLDCLRVGCAPSKGPETLFAGHKLNDNEWHTVRVVRRGKSLQLSVDNVTVEGQMAGAHMRLEFHNIETGIMTERRFISVVPSNFIGHLSGLVFNGQPYMDQCKDGDITYCELNARFGLRAIVADPVTFKSRSSYLALATLQAYASMHLFFQFKTTAPDGLLLFNSGNGNDFIVIELVKGYIHYVFDLGNGPSLMKGNSDKPVNDNQWHNVVVSRDPGNVHTLKIDSRTVTQHSNGARNLDLKGELYIGGLSKNMFSNLPKLVASRDGFQGCLASVDLNGRLPDLIADALHRIGQVERGCDGPSTTCTEESCANQGVCLQQWDGFTCDCTMTSYGGPVCNDPGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGNFDNERLAIARQRIPYRLGRVVDEWLLDKGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 56164 - protein, 666 aa, Homo sapiens
  Payload ID: 11036
  Gene Symbol: NRXN2
  Gene Name: neurexin 2
  Uniprot ID: P58401
  ENSP ID: ENSP00000301894
MPPGGSGPGGCPRRPPALAGPLPPPPPPPPPPLLPLLPLLLLLLLGAAEGARVSSSLSTTHHVHHFHSKHGTVPIAINRMPFLTRGGHAGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGNFDNERLAIARQRIPYRLGRVVDEWLLDKGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 56165 - protein, 1712 aa, Homo sapiens; identical to SEQ ID NO: 56163
  Payload ID: 11036
  Gene Symbol: NRXN2
  Gene Name: neurexin 2
  Uniprot ID: Q9P2S2
  ENSP ID: ENSP00000366774

SEQ ID NO: 56166 - protein, 1642 aa, Homo sapiens
  Payload ID: 11036
  Gene Symbol: NRXN2
  Gene Name: neurexin 2
  Uniprot ID: Q9P2S2
  ENSP ID: ENSP00000366782
MASGSRWRPTPPPLLLLLLLALAARADGLEFGGGPGQWARYARWAGAASSGELSFSLRTNATRALLLYLDDGGDCDFLELLLVDGRLRLRFTLSCAEPATLQLDTPVADDRWHMVLLTRDARRTALAVDGEARAAEVRSKRREMQVASDLFVGGIPPDVRLSALTLSTVKYEPPFRGLLANLKLGERPPALLGSQGLRGATADPLCAPARNPCANGGLCTVLAPGEVGCDCSHTGFGGKFCSEEEHPMEGPAHLTLNSEGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQHAGIGHAMVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGRRAGGGAGSHSSAQRADYFAMELLDGHLYLLLDMGSGGIKLRASSRKVNDGEWCHVDFQRDGRKGSISVNSRSTPFLATGDSEILDLESELYLGGLPEGGRVDLPLPPEVWTAALRAGYVGCVRDLFIDGRSRDLRGLAEAQGAVGVAPFCSRETLKQCASAPCRNGGVCREGWNRFICDCIGTGFLGRVCEREATVLSYDGSMYMKIMLPNAMHTEAEDVSLRFMSQRAYGLMMATTSRESADTLRLELDGGQMKLTVNLGKGPETLFAGHKLNDNEWHTVRVVRRGKSLQLSVDNVTVEGQMAGAHMRLEFHNIETGIMTERRFISVVPSNFIGHLSGLVFNGQPYMDQCKDGDITYCELNARFGLRAIVADPVTFKSRSSYLALATLQAYASMHLFFQFKTTAPDGLLLFNSGNGNDFIVIELVKGYIHYVFDLGNGPSLMKGNSDKPVNDNQWHNVVVSRDPGNVHTLKIDSRTVTQHSNGARNLDLKGELYIGGLSKNMFSNLPKLVASRDGFQGCLASVDLNGRLPDLIADALHRIGQVERGCDGPSTTCTEESCANQGVCLQQWDGFTCDCTMTSYGGPVCNDPGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 56167 - protein, 1705 aa, Homo sapiens
  Payload ID: 11036
  Gene Symbol: NRXN2
  Gene Name: neurexin 2
  ENSP ID: ENSP00000386416
MASGSRWRPTPPPLLLLLLLALAARADGLEFGGGPGQWARYARWAGAASSGELSFSLRTNATRALLLYLDDGGDCDFLELLLVDGRLRLRFTLSCAEPATLQLDTPVADDRWHMVLLTRDARRTALAVDGEARAAEVRSKRREMQVASDLFVGGIPPDVRLSALTLSTVKYEPPFRGLLANLKLGERPPALLGSQGLRGATADPLCAPARNPCANGGLCTVLAPGEVGCDCSHTGFGGKFCSEEEHPMEGPAHLTLNSEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQHAGIGHAMVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGRRAGGGAGSHSSAQRADYFAMELLDGHLYLLLDMGSGGIKLRASSRKVNDGEWCHVDFQRDGRKGSISVNSRSTPFLATGDSEILDLESELYLGGLPEGGRVDLPLPPEVWTAALRAGYVGCVRDLFIDGRSRDLRGLAEAQGAVGVAPFCSRETLKQCASAPCRNGGVCREGWNRFICDCIGTGFLGRVCEREATVLSYDGSMYMKIMLPNAMHTEAEDVSLRFMSQRAYGLMMATTSRESADTLRLELDGGQMKLTVNLDCLRVGCAPSKGPETLFAGHKLNDNEWHTVRVVRRGKSLQLSVDNVTVEGQMAGAHMRLEFHNIETGIMTERRFISVVPSNFIGHLSGLVFNGQPYMDQCKDGDITYCELNARFGLRAIVADPVTFKSRSSYLALATLQAYASMHLFFQFKTTAPDGLLLFNSGNGNDFIVIELVKGYIHYVFDLGNGPSLMKGNSDKPVNDNQWHNVVVSRDPGNVHTLKIDSRTVTQHSNGARNLDLKGELYIGGLSKNMFSNLPKLVASRDGFQGCLASVDLNGRLPDLIADALHRIGQVERGCDGPSTTCTEESCANQGVCLQQWDGFTCDCTMTSYGGPVCNDPGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGNFDNERLAIARQRIPYRLGRVVDEWLLDKGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 56168 - protein, 292 aa, Homo sapiens
  Payload ID: 11036
  Gene Symbol: NRXN2
  Gene Name: neurexin 2
  ENSP ID: ENSP00000388971
SVSPAATCGQPVWSEEHPMEGPAHLTLNSEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGR

SEQ ID NO: 56169 - protein, 276 aa, Homo sapiens
  Payload ID: 11036
  Gene Symbol: NRXN2
  Gene Name: neurexin 2
  ENSP ID: ENSP00000407374
LLLLLLGAAEGARVSSSLSTTHHVHHFHSKHGTVPIAINRMPFLTRGGHAGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQ

SEQ ID NO: 56170 - protein, 206 aa, Homo sapiens
  Payload ID: 11036
  Gene Symbol: NRXN2
  Gene Name: neurexin 2
  ENSP ID: ENSP00000411271
  MOD_RES (1)..(1): Any amino acid
XCSEEEHPMEGPAHLTLNSEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQVTISVDGILTTTGYTQEDYTMLGSDDFFYIGGSPNTADLPGSPVSNNFMGCLKDVVYKNND

SEQ ID NO: 56171 - protein, 215 aa, Homo sapiens
  Payload ID: 11036
  Gene Symbol: NRXN2
  Gene Name: neurexin 2
  ENSP ID: ENSP00000412211
  MOD_RES (1)..(1): Any amino acid
XADPLCAPARNPCANGGLCTVLAPGEVGCDCSHTGFGGKFCSEEEHPMEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQVTISVDGILTTTGYTQEDYTMLGSDDFFYIGGSPNTADLPG

SEQ ID NO: 56172 - protein, 432 aa, Homo sapiens
  Payload ID: 11037
  Gene Symbol: NRXN3
  Gene Name: neurexin 3
  Uniprot ID: Q9HDB5
  ENSP ID: ENSP00000281127
MHLRIHARRSPPRRPAWTLGIWFLFWGCIVSSVWSSSNVASSSSTSSSPGSHSQHEHHFHGSKHHSVPISIYRSPVSLRGGHAGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTGRSANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 56173 - protein, 879 aa, Homo sapiens
  Payload ID: 11037
  Gene Symbol: NRXN3
  Gene Name: neurexin 3
  ENSP ID: ENSP00000338349
MHPSTHFHRDLDEAREENVATFRGSEYLCYDLSQNPIQSSSDEITLSFKTWQRNGLILHTGKSADYVNLALKDGAVSLVINLGSGAFEAIVEPVNGKFNDNAWHDVKVTRNLRQVTISVDGILTTTGYTQEDYTMLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDLEGDMYLGGLPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSFRFMSQRAYGLLVATTSRDSADTLRLELDGGRVKLMVNLDCIRINCNSSKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIERGCEGPSTTCQEDSCANQGVCMQQWEGFTCDCSMTSYSGNQCNDRKYNNLSYWNFVKMFGDLENLKGQYVKGWLF

SEQ ID NO: 56174 - protein, 459 aa, Homo sapiens
  Payload ID: 11037
  Gene Symbol: NRXN3
  Gene Name: neurexin 3
  Uniprot ID: Q9HDB5
  ENSP ID: ENSP00000394426
MHLRIHARRSPPRRPAWTLGIWFLFWGCIVSSVWSSSNVASSSSTSSSPGSHSQHEHHFHGSKHHSVPISIYRSPVSLRGGHAGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGNTDNERFQMVKQKIPFKYNRPVEEWLQEKGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 56175 - protein, 119 aa, Homo sapiens
  Payload ID: 11037
  Gene Symbol: NRXN3
  Gene Name: neurexin 3
  ENSP ID: ENSP00000450462
MKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQ

SEQ ID NO: 56176 - protein, 1392 aa, Homo sapiens
  Payload ID: 11037
  Gene Symbol: NRXN3
  Gene Name: neurexin 3
  Uniprot ID: Q9Y4C0
  ENSP ID: ENSP00000450683
MSSTLHSVFFTLKVSILLGSLLGLCLGLEFMGLPNQWARYLRWDASTRSDLSFQFKTNVSTGLLLYLDDGGVCDFLCLSLVDGRVQLRFSMDCAETAVLSNKQVNDSSWHFLMVSRDRLRTVLMLDGEGQSGELQPQRPYMDVVSDLFLGGVPTDIRPSALTLDGVQAMPGFKGLILDLKYGNSEPRLLGSRGVQMDAEGPCGERPCENGGICFLLDGHPTCDCSTTGYGGKLCSEGLSHLMMSEQGRSKAREENVATFRGSEYLCYDLSQNPIQSSSDEITLSFKTWQRNGLILHTGKSADYVNLALKDGAVSLVINLGSGAFEAIVEPVNGKFNDNAWHDVKVTRNLRQVTISVDGILTTTGYTQEDYTMLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDLEGDMYLGGLPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSFRFMSQRAYGLLVATTSRDSADTLRLELDGGRVKLMVNLGKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIERGCEGPSTTCQEDSCANQGVCMQQWEGFTCDCSMTSYSGNQCNDPGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGNTDNERFQMVKQKIPFKYNRPVEEWLQEKGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTGRSARSSNAARSLRAALTWTWRLTYTFTPIIFISCVVHS

SEQ ID NO: 56177 - protein, 398 aa, Homo sapiens
  Payload ID: 11037
  Gene Symbol: NRXN3
  Gene Name: neurexin 3
  ENSP ID: ENSP00000451393
MHLRIHARRSPPRRPAWTLGIWFLFWGCIVSSVWSSSNVASSSSTSSSPGSHSQHEHHFHGSKHHSVPISIYRSPVSLRGGHAGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGNTDNERFQMVKQKIPFKYNRPVEEWLQEKGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTGRSARSSNAARSLRAALTWTWRLTYTFTPIIFISCVVHS

SEQ ID NO: 56178 - protein, 1061 aa, Homo sapiens
  Payload ID: 11037
  Gene Symbol: NRXN3
  Gene Name: neurexin 3
  Uniprot ID: Q9Y4C0
  ENSP ID: ENSP00000451648
MLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDLEGDMYLGGLPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSFRFMSQRAYGLLVATTSRDSADTLRLELDGGRVKLMVNLDCIRINCNSSKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIERGCEGPSTTCQEDSCANQGVCMQQWEGFTCDCSMTSYSGNQCNDPGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 56179 - protein, 637 aa, Homo sapiens
  Payload ID: 11037
  Gene Symbol: NRXN3
  Gene Name: neurexin 3
  Uniprot ID: Q9HDB5
  ENSP ID: ENSP00000451672
MHLRIHARRSPPRRPAWTLGIWFLFWGCIVSSVWSSSNVASSSSTSSSPGSHSQHEHHFHGSKHHSVPISIYRSPVSLRGGHAGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTGGELVIPLLVEDPLATPPIATRAPSITLPPTFRPLLTIIETTKDSLSMTSEAGLPCLSDQGSDGCDDDGLVISGYGSGETFDSNLPPTDDEDFYTTFSLVTDKSLSTSIFEGGYKAHAPKWESKDFRPNKVSETSRTTTTSLSPELIRFTASSSSGMVPKLPAGKMNNRDLKPQPDIVLLPLPTAYELDSTKLKSPLITSPMFRNVPTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 56180 - protein, 175 aa, Homo sapiens
  Payload ID: 11037
  Gene Symbol: NRXN3
  Gene Name: neurexin 3
  ENSP ID: ENSP00000451754
  MOD_RES (1)..(1): Any amino acid
XDVSQDPGLSHLMMSEQAREENVATFRGSEYLCYDLSQNPIQSSSDEITLSFKTWQRNGLILHTGKSADYVNLALKDGAVSLVINLGSGAFEAIVEPVNGKFNDNAWHDVKVTRNLRQHSGIGHAMVTISVDGILTTTGYTQEDYTMLGSDDFFYVGGSPSTADLPGSPVSNNFM

SEQ ID NO: 56181 - protein, 75 aa, Homo sapiens
  Payload ID: 11037
  Gene Symbol: NRXN3
  Gene Name: neurexin 3
  ENSP ID: ENSP00000451947
MKIYGEVVFKCENVATLDPINFETPEAYISLPKWNTKRMGSISFDFRTTEPNGLILFTHGKPQERKDARSQKNTK

SEQ ID NO: 56182 - protein, 1664 aa, Homo sapiens
  Payload ID: 11037
  Gene Symbol: NRXN3
  Gene Name: neurexin 3
  ENSP ID: ENSP00000488920
MSSTLHSVFFTLKVSILLGSLLGLCLGLEFMGLPNQWARYLRWDASTRSDLSFQFKTNVSTGLLLYLDDGGVCDFLCLSLVDGRVQLRFSMDCAETAVLSNKQVNDSSWHFLMVSRDRLRTVLMLDGEGQSGELQPQRPYMDVVSDLFLGGVPTDIRPSALTLDGVQAMPGFKGLILDLKYGNSEPRLLGSRGVQMDAEGPCGERPCENGGICFLLDGHPTCDCSTTGYGGKLCSEGLSHLMMSEQGRSKAREENVATFRGSEYLCYDLSQNPIQSSSDEITLSFKTWQRNGLILHTGKSADYVNLALKDGAVSLVINLGSGAFEAIVEPVNGKFNDNAWHDVKVTRNLRQVTISVDGILTTTGYTQEDYTMLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDLEGDMYLGGLPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSFRFMSQRAYGLLVATTSRDSADTLRLELDGGRVKLMVNLGKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIERGCEGPSTTCQEDSCANQGVCMQQWEGFTCDCSMTSYSGNQCNDPGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGNTDNERFQMVKQKIPFKYNRPVEEWLQEKGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTGRSGGELVIPLLVEDPLATPPIATRAPSITLPPTFRPLLTIIETTKDSLSMTSEAGLPCLSDQGSDGCDDDGLVISGYGSGETFDSNLPPTDDEDFYTTFSLVTDKSLSTSIFEGGYKAHAPKWESKDFRPNKVSETSRTTTTSLSPELIRFTASSSSGMVPKLPAGKMNNRDLKPQPDIVLLPLPTAYELDSTKLKSPLITSPMFRNVPTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 56183 - protein, 1571 aa, Homo sapiens
  Payload ID: 11037
  Gene Symbol: NRXN3
  Gene Name: neurexin 3
  ENSP ID: ENSP00000489551
MSSTLHSVFFTLKVSILLGSLLGLCLGLEFMGLPNQWARYLRWDASTRSDLSFQFKTNVSTGLLLYLDDGGVCDFLCLSLVDGRVQLRFSMDCAETAVLSNKQVNDSSWHFLMVSRDRLRTVLMLDGEGQSGELQPQRPYMDVVSDLFLGGVPTDIRPSALTLDGVQAMPGFKGLILDLKYGNSEPRLLGSRGVQMDAEGPCGERPCENGGICFLLDGHPTCDCSTTGYGGKLCSEDVSQDPGLSHLMMSEQAREENVATFRGSEYLCYDLSQNPIQSSSDEITLSFKTWQRNGLILHTGKSADYVNLALKDGAVSLVINLGSGAFEAIVEPVNGKFNDNAWHDVKVTRNLRQVTISVDGILTTTGYTQEDYTMLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDLEGDMYLGGLPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSFRFMSQRAYGLLVATTSRDSADTLRLELDGGRVKLMVNLDCIRINCNSSKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIERGCEGPSTTCQEDSCANQGVCMQQWEGFTCDCSMTSYSGNQCNDPGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGNTDNERFQMVKQKIPFKYNRPVEEWLQEKGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTDKSLSTSIFEGGYKAHAPKWESKDFRPNKVSETSRTTTTSLSPELIRFTASSSSGMVPKLPAGKMNNRDLKPQPDIVLLPLPTAYELDSTKLKSPLITSPMFRNVPTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 56184 - protein, 271 aa, Homo sapiens
  Payload ID: 11038
  Gene Symbol: NXPH1
  Gene Name: neurexophilin 1
  Uniprot ID: P58417
  ENSP ID: ENSP00000384551
MQAACWYVLFLLQPTVYLVTCANLTNGGKSELLKSGSSKSTLKHIWTESSKDLSISRLLSQTFRGKENDTDLDLRYDTPEPYSEQDLWDWLRNSTDLQEPRPRAKRRPIVKTGKFKKMFGWGDFHSNIKTVKLNLLITGKIVDHGNGTFSVYFRHNSTGQGNVSVSLVPPTKIVEFDLAQQTVIDAKDSKSFNCRIEYEKVDKATKNTLCNYDPSKTCYQEQTQSHVSWLCSKPFKVICIYISFYSTDYKLVQKVCPDYNYHSDTPYFPSG

SEQ ID NO: 56185 - protein, 139 aa, Homo sapiens
  Payload ID: 11038
  Gene Symbol: NXPH1
  Gene Name: neurexophilin 1
  ENSP ID: ENSP00000404689
MQAACWYVLFLLQPTVYLVTCANLTNGGKSELLKSGSSKSTLKHIWTESSKDLSISRLLSQTFRGKENDTDLDLRYDTPEPYSEQDLWDWLRNSTDLQEPRPRAKRRPIVKTGKFKKMFGWGDFHSNIKTVKLNLLITG

SEQ ID NO: 56186 - protein, 143 aa, Homo sapiens
  Payload ID: 11038
  Gene Symbol: NXPH1
  Gene Name: neurexophilin 1
  ENSP ID: ENSP00000408216
MQAACWYVLFLLQPTVYLVTCANLTNGGKSELLKSGSSKSTLKHIWTESSKDLSISRLLSQTFRGKENDTDLDLRYDTPEPYSEQDLWDWLRNSTDLQEPRPRAKRRPIVKTGKFKKMFGWGDFHSNIKTVKLNLLITGKIVD

SEQ ID NO: 56187 - protein, 253 aa, Homo sapiens
  Payload ID: 11038
  Gene Symbol: NXPH1
  Gene Name: neurexophilin 1
  ENSP ID: ENSP00000473269
VTCANLTNGGKSELLKSGSSKSTLKHIWTESSKDLSISRLLSQTFRGKENDTDLDLRYDTPEPYSEQDLWDWLRNSTDLQEPRPRAKRRPIVKTGKFKKMFGWGDFHSNIKTVKLNLLITGKIVDHGNGTFSVYFRHNSTGQGNVSVSLVPPTKIVEFDLAQQTVIDAKDSKSFNCRIEYEKVDKATKNTLCNYDPSKTCYQEQTQSHVSWLCSKPFKVICIYISFYSTDYKLVQKVCPDYNYHSDTPYFPSG

SEQ ID NO: 56188 - protein, 264 aa, Homo sapiens
  Payload ID: 11039
  Gene Symbol: NXPH2
  Gene Name: neurexophilin 2
  Uniprot ID: O95156
  ENSP ID: ENSP00000272641
MRLRPLPLVVVPGLLQLLFCDSKEVVHATEGLDWEDKDAPGTLVGNVVHSRIISPLRLFVKQSPVPKPGPMAYADSMENFWDWLANITEIQEPLARTKRRPIVKTGKFKKMFGWGDFHSNIKTVKLNLLITGKIVDHGNGTFSVYFRHNSTGLGNVSVSLVPPSKVVEFEVSPQSTLETKESKSFNCRIEYEKTDRAKKTALCNFDPSKICYQEQTQSHVSWLCSKPFKVICIYIAFYSVDYKLVQKVCPDYNYHSETPYLSSG

SEQ ID NO: 56189 - protein, 252 aa, Homo sapiens
  Payload ID: 11040
  Gene Symbol: NXPH3
  Gene Name: neurexophilin 3
  Uniprot ID: O95157
  ENSP ID: ENSP00000329295
MQLTRCCFVFLVQGSLYLVICGQDDGPPGSEDPERDDHEGQPRPRVPRKRGHISPKSRPMANSTLLGLLAPPGEAWGILGQPPNRPNHSPPPSAKVKKIFGWGDFYSNIKTVALNLLVTGKIVDHGNGTFSVHFQHNATGQGNISISLVPPSKAVEFHQEQQIFIEAKASKIFNCRMEWEKVERGRRTSLCTHDPAKICSRDHAQSSATWSCSQPFKVVCVYIAFYSTDYRLVQKVCPDYNYHSDTPYYPSG

SEQ ID NO: 56190 - protein, 354 aa, Homo sapiens
  Payload ID: 11040
  Gene Symbol: NXPH3
  Gene Name: neurexophilin 3
  ENSP ID: ENSP00000421168
MQLTRCCFVFLVQGSLYLVICGQDDGPPGSEDPERDDHEGQPRPRVPRKRGHISPKSRPMANSTLLGLLAPPGEAWGILGQPPNRPNHSPPPSAKVKKIFGWGDFYSNIKTVALNLLVTGKIVDHGNGTFSVHFQHNATGQGNISISLVPPSKAVEFHQEQQIFIEAKASKIFNCRMEWEKVERGRRTSLCTHDPAKICSRDHAQSSATWSCSQPFKVVCVYIAFYSTDYRLVQKGPSLLSGDVRHTPLLQTTLRSPPWRLETAGTGAAHQWTPTVCRSASHSAVETAGRRRKQWGQRPWAPSPPPLAELSAGTGGTLTPLLLLSSCGEPDAGDSWRARPSWHTVLPAPGMDSF

SEQ ID NO: 56191 - protein, 308 aa, Homo sapiens
  Payload ID: 11041
  Gene Symbol: NXPH4
  Gene Name: neurexophilin 4
  Uniprot ID: O95158
  ENSP ID: ENSP00000333593
MRLLPEWFLLLFGPWLLRKAVSAQIPESGRPQYLGLRPAAAGAGAPGQQLPEPRSSDGLGVGRAWSWAWPTNHTGALARAGAAGALPAQRTKRKPSIKAARAKKIFGWGDFYFRVHTLKFSLLVTGKIVDHVNGTFSVYFRHNSSSLGNLSVSIVPPSKRVEFGGVWLPGPVPHPLQSTLALEGVLPGLGPPLGMAAAAAGPGLGGSLGGALAGPLGGALGVPGAKESRAFNCHVEYEKTNRARKHRPCLYDPSQVCFTEHTQSQAAWLCAKPFKVICIFVSFLSFDYKLVQKVCPDYNFQSEHPYFG

SEQ ID NO: 56192 - protein, 36 aa, Homo sapiens
  Payload ID: 11041
  Gene Symbol: NXPH4
  Gene Name: neurexophilin 4
  ENSP ID: ENSP00000452288
MRLLPEWFLLLFGPWLLRKPRPGLSLPPARSWEHPA

SEQ ID NO: 56193 - protein, 405 aa, Homo sapiens
  Payload ID: 11042
  Gene Symbol: NXPE1
  Gene Name: neurexophilin and PC-esterase domain family, member 1
  Uniprot ID: Q8N323
  ENSP ID: ENSP00000251921
MSSPALTAGASGKVMDFNNGTYLVSFTLFWEGQVSLSLLLIHPSEGASALWRARNQGYDKIIFKGKFVNGTSHVFTECGLTLNSNAELCEYLDDRDQEAFYCMKPQHMPCEALTYMTTRNREVSYLTDKENSLFHRSKVGVEMMKDRKHIDVTNCNKREKIEETCQVGMKPPVPGGYTLQGKWITTFCNQVQLDTIKINGCLKGKLIYLLGDSTLRQWIYYFPKVVKTLKFFDLHETGIFKKHLLLDAERHTQIQWKKHSYPFVTFQLYSLIDHDYIPREIDRLSGDKNTAIVITFGQHFRPFPIDIFIRRAIGVQKAIERLFLRSPATKVIIKTENIREMHIETERFGDFHGYIHYLIMKDIFKDLNVGIIDAWDMTIAYGTDTIHPPDHVIGNQINMFLNYIC

SEQ ID NO: 56194 - protein, 547 aa, Homo sapiens
  Payload ID: 11042
  Gene Symbol: NXPE1
  Gene Name: neurexophilin and PC-esterase domain family, member 1
  Uniprot ID: Q8N323
  ENSP ID: ENSP00000411690
MSSNTMLQKTLLILISFSVVTWMIFIISQNFTKLWSALNLSISVHYWNNSAKSLFPKTSLIPLKPLTETELRIKEIIEKLDQQIPPRPFTHVNTTTSATHSTATILNPRDTYCRGDQLDILLEVRDHLGQRKQYGGDFLRARMSSPALTAGASGKVMDFNNGTYLVSFTLFWEGQVSLSLLLIHPSEGASALWRARNQGYDKIIFKGKFVNGTSHVFTECGLTLNSNAELCEYLDDRDQEAFYCMKPQHMPCEALTYMTTRNREVSYLTDKENSLFHRSKVGVEMMKDRKHIDVTNCNKREKIEETCQVGMKPPVPGGYTLQGKWITTFCNQVQLDTIKINGCLKGKLIYLLGDSTLRQWIYYFPKVVKTLKFFDLHETGIFKKHLLLDAERHTQIQWKKHSYPFVTFQLYSLIDHDYIPREIDRLSGDKNTAIVITFGQHFRPFPIDIFIRRAIGVQKAIERLFLRSPATKVIIKTENIREMHIETERFGDFHGYIHYLIMKDIFKDLNVGIIDAWDMTIAYGTDTIHPPDHVIGNQINMFLNYIC

SEQ ID NO: 56195 - protein, 62 aa, Homo sapiens
  Payload ID: 11042
  Gene Symbol: NXPE1
  Gene Name: neurexophilin and PC-esterase domain family, member 1
  ENSP ID: ENSP00000439503
MSSNTMLQKTLLILISFSVVTWMIFIISQNFTKLWSALNLSISVHYWNNSAKSLFPKTSLIP

SEQ ID NO: 56196 - protein, 121 aa, Homo sapiens
  Payload ID: 11042
  Gene Symbol: NXPE1
  Gene Name: neurexophilin and PC-esterase domain family, member 1
  ENSP ID: ENSP00000439779
MSSNTMLQKTLLILISFSVVTWMIFIISQNFTKLWSALNLSISVHYWNNSAKSLFPKTSLIPLKPLTETELRIKEIIEKLDQQIPPRPFTHVNTTTSATHSTATILNPRDTYCRGDQLDIL

SEQ ID NO: 56197 - protein, 295 aa, Homo sapiens
  Payload ID: 11042
  Gene Symbol: NXPE1
  Gene Name: neurexophilin and PC-esterase domain family, member 1
  ENSP ID: ENSP00000442984
MSSNTMLQKTLLILISFSVVTWMIFIISQNFTKLWSALNLSISVHYWNNSAKSLFPKTSLIPLKPLTETELRIKEIIEKLDQQIPPRPFTHVNTTTSATHSTATILNPRDTYCRGDQLDILLEVRDHLGQRKQYGGDFLRARMSSPALTAGASGKVMDFNNGTYLVSFTLFWEGQVSLSLLLIHPSEGASALWRARNQGYDKIIFKGKFVNGTSHVFTECGLTLNSNAELCEYLDDRDQEAFYCMKPQHMPCEALTYMTTRNREVSYLTDKENSLFHRMAPGETSIAGNQVQSGS

SEQ ID NO: 56198 - protein, 263 aa, Homo sapiens
  Payload ID: 11042
  Gene Symbol: NXPE1
  Gene Name: neurexophilin and PC-esterase domain family, member 1
  ENSP ID: ENSP00000445200
MMKDRKHIDVTNCNKREKIEETCQVGMKPPVPGGYTLQGKWITTFCNQVQLDTIKINGCLKGKLIYLLGDSTLRQWIYYFPKVVKTLKFFDLHETGIFKKHLLLDAERHTQIQWKKHSYPFVTFQLYSLIDHDYIPREIDRLSGDKNTAIVITFGQHFRPFPIDIFIRRAIGVQKAIERLFLRSPATKVIIKTENIREMHIETERFGDFHGYIHYLIMKDIFKDLNVGIIDAWDMTIAYGTDTIHPPDHVIGNQINMFLNYIC

SEQ ID NO: 56199 - protein, 559 aa, Homo sapiens
  Payload ID: 11043
  Gene Symbol: NXPE2
  Gene Name: neurexophilin and PC-esterase domain family, member 2
  Uniprot ID: Q96DL1
  ENSP ID: ENSP00000374237
MVEKILIHRILTLFPNAIARKLLLMLTFILIFWIIYLASKDHTKFSFNLENHIILNQGNIFKKYSHSETPLCPAVSPKETELRIKDIMEKLDQQIPPRPFTHVNTTTSATHSTATILNPQDTYCRGDQLDILLEVRDHLGHRKQYGGDFLRARMYSTALMAGASGKVTDFNNGTYLVSFTLFWEGQVSLSLLLIHPSEGVSALWRARNQGCDRIIFTGLFANRSSNVFTECGLTLNTNAELCQYMDDRDQEAFYCVRPQHMPCEALTHMTTRTRNISYLSKEEWRLFHRSNIGVEMMKNFTPIEVIPCNKSENIKKNCQIGMKTPFPSGYTLKKMWITAFCKQIKFNETKNINDCLERKLIYLMGDSTLHQWIYYLQKAVKTLKYFDHHGAGIFKTHVLLDVERHILIQWKKHGHPFVTKKLFSVKDENYIPREIDQVAGDKNTAIVITLGQHFRPFPINIFIRRAINIQKAIERLFLRSPETKVILKTENTREIEQNAEMFSDFHGYIQNLIIRDIFVDLNVGIIDAWDMTIAYCTNNAHPPDYVIQNQIGMFLNYIC

SEQ ID NO: 56200 - protein, 559 aa, Homo sapiens
  Payload ID: 11044
  Gene Symbol: NXPE3
  Gene Name: neurexophilin and PC-esterase domain family, member 3
  Uniprot ID: Q969Y0
  ENSP ID: ENSP00000273347
MWTNFFKLRLFCCLLAVLMVVVLVINVTQVEYLDHETVSATFIDSSGQFVSSQVTGISRNPYCGYDQQTLSSQERMEEDSLLAALHRQVPDVGPVPFVKSTDPSSSYFVILNSAAFFKVGSQLEVLVHVQDFQRKPKKYGGDYLQARIHSLKLQAGAVGRVVDYQNGFYKVFFTLLWPGKVKVSVSLVHPSEGIRVLQRLQEDKPDRVYFKSLFRSGRISETTECNVCLPGNLPLCNFTDLYTGEPWFCFKPKKLPCSSRITHFKGGYLKGLLTAAESAFFQSGVNIKMPVNSSGPDWVTVIPRRIKETNSLELSQGSGTFPSGYYYKDQWRPRKFKMRQFNDPDNITECLQRKVVHLFGDSTIRQWFEYLTTFVPDLVEFNLGSPKNVGPFLAVDQKHNILLKYRCHGPPIRFTTVFSNELHYVANELNGIVGGKNTVVAIAVWSHFSTFPLEVYIRRLRNIRRAVVRLLDRSPKTVVVIRTANAQELGPEVSLFNSDWYNFQLDTILRRMFSGVGVYLVDAWEMTLAHYLPHKLHPDEVIVKNQLDMFLSFVCPLET

SEQ ID NO: 56201 - protein, 559 aa, Homo sapiens; identical to SEQ ID NO: 56200
  Payload ID: 11044
  Gene Symbol: NXPE3
  Gene Name: neurexophilin and PC-esterase domain family, member 3
  Uniprot ID: Q969Y0
  ENSP ID: ENSP00000396421

SEQ ID NO: 56202 - protein, 559 aa, Homo sapiens; identical to SEQ ID NO: 56200
  Payload ID: 11044
  Gene Symbol: NXPE3
  Gene Name: neurexophilin and PC-esterase domain family, member 3
  Uniprot ID: Q969Y0
  ENSP ID: ENSP00000417485

SEQ ID NO: 56203 - protein, 559 aa, Homo sapiens; identical to SEQ ID NO: 56200
  Payload ID: 11044
  Gene Symbol: NXPE3
  Gene Name: neurexophilin and PC-esterase domain family, member 3
  Uniprot ID: Q969Y0
  ENSP ID: ENSP00000418369

SEQ ID NO: 56204 - protein, 3 aa, Homo sapiens
  Payload ID: 11044
  Gene Symbol: NXPE3
  Gene Name: neurexophilin and PC-esterase domain family, member 3
  ENSP ID: ENSP00000418381
MWT

SEQ ID NO: 56205 - protein, 53 aa, Homo sapiens
  Payload ID: 11044
  Gene Symbol: NXPE3
  Gene Name: neurexophilin and PC-esterase domain family, member 3
  ENSP ID: ENSP00000419667
MWTNFFKLRLFCCLLAVLMVVVLVINVTQVEYLDHETVSATFIDSSGQFVSSQ

SEQ ID NO: 56206 - protein, 89 aa, Homo sapiens
  Payload ID: 11044
  Gene Symbol: NXPE3
  Gene Name: neurexophilin and PC-esterase domain family, member 3
  ENSP ID: ENSP00000478069
MPVNSSGPDWVTVIPRRIKETNSLELSQGSGTFPSGYYYKDQWRPRKFKMRQFNDPTTLQSAYKEKWCIYLVTQQSGNGLNTLLHLFQI

SEQ ID NO: 56207 - protein, 544 aa, Homo sapiens
  Payload ID: 11045
  Gene Symbol: NXPE4
  Gene Name: neurexophilin and PC-esterase domain family, member 4
  Uniprot ID: Q6UWF7
  ENSP ID: ENSP00000364627
MKISMINYKSLLALLFILASWIIFTVFQNSTKVWSALNLSISLHYWNNSTKSLFPKTPLISLKPLTETELRIKEIIEKLDQQIPPRPFTHVNTTTSATHSTATILNPRDTYCRGDQLHILLEVRDHLGRRKQYGGDFLRARMSSPALMAGASGKVTDFNNGTYLVSFTLFWEGQVSLSLLLIHPSEGVSALWSARNQGYDRVIFTGQFVNGTSQVHSECGLILNTNAELCQYLDNRDQEGFYCVRPQHMPCAALTHMYSKNKKVSYLSKQEKSLFERSNVGVEIMEKFNTISVSKCNKETVAMKEKCKFGMTSTIPSGHVWRNTWNPVSCSLATVKMKECLRGKLIYLMGDSTIRQWMEYFKASINTLKSVDLHESGKLQHQLAVDLDRNINIQWQKYCYPLIGSMTYSVKEMEYLTRAIDRTGGEKNTVIVISLGQHFRPFPIDVFIRRALNVHKAIQHLLLRSPDTMVIIKTENIREMYNDAERFSDFHGYIQYLIIKDIFQDLSVSIIDAWDITIAYGTNNVHPPQHVVGNQINILLNYIC

SEQ ID NO: 56208 - protein, 260 aa, Homo sapiens
  Payload ID: 11045
  Gene Symbol: NXPE4
  Gene Name: neurexophilin and PC-esterase domain family, member 4
  Uniprot ID: Q6UWF7
  ENSP ID: ENSP00000401503
MEKFNTISVSKCNKETVAMKEKCKFGMTSTIPSGHVWRNTWNPVSCSLATVKMKECLRGKLIYLMGDSTIRQWMEYFKASINTLKSVDLHESGKLQHQLAVDLDRNINIQWQKYCYPLIGSMTYSVKEMEYLTRAIDRTGGEKNTVIVISLGQHFRPFPIDVFIRRALNVHKAIQHLLLRSPDTMVIIKTENIREMYNDAERFSDFHGYIQYLIIKDIFQDLSVSIIDAWDITIAYGTNNVHPPQHVVGNQINILLNYIC

SEQ ID NO: 56209 - protein, 142 aa, Homo sapiens
  Payload ID: 11046
  Gene Symbol: NRN1
  Gene Name: neuritin 1
  Uniprot ID: Q9NPD7
  ENSP ID: ENSP00000244766
MGLKLNGRYISLILAVQIAYLVQAVRAAGKCDAVFKGFSDCLLKLGDSMANYPQGLDDKTNIKTVCTYWEDFHSCTVTALTDCQEGAKDMWDKLRKESKNLNIQGSLFELCGSGNGAAGSLLPAFPVLLVSLSAALATWLSF

SEQ ID NO: 56210 - protein, 168 aa, Homo sapiens
  Payload ID: 11046
  Gene Symbol: NRN1
  Gene Name: neuritin 1
  ENSP ID: ENSP00000480483
MATAARPQPDHSSSAPGLRTSRLPSFQRGGRGCIRGSHSEYRVHAYLVQAVRAAGKCDAVFKGFSDCLLKLGDSMANYPQGLDDKTNIKTVCTYWEDFHSCTVTALTDCQEGAKDMWDKLRKESKNLNIQGSLFELCGSGNGAAGSLLPAFPVLLVSLSAALATWLSF

SEQ ID NO: 56211 - protein, 142 aa, Homo sapiens; identical to SEQ ID NO: 56209
  Payload ID: 11046
  Gene Symbol: NRN1
  Gene Name: neuritin 1
  Uniprot ID: Q9NPD7
  ENSP ID: ENSP00000484055

SEQ ID NO: 56212 - protein, 165 aa, Homo sapiens
  Payload ID: 11047
  Gene Symbol: NRN1L
  Gene Name: neuritin 1-like
  Uniprot ID: Q496H8
  ENSP ID: ENSP00000342411
MMRCCRRRCCCRQPPHALRPLLLLPLVLLPPLAAAAAGPNRCDTIYQGFAECLIRLGDSMGRGGELETICRSWNDFHACASQVLSGCPEEAAAVWESLQQEARQAPRPNNLHTLCGAPVHVRERGTGSETNQETLRATAPALPMAPAPPLLAAALALAYLLRPLA

SEQ ID NO: 56213 - protein, 88 aa, Homo sapiens
  Payload ID: 11047
  Gene Symbol: NRN1L
  Gene Name: neuritin 1-like
  ENSP ID: ENSP00000459748
  MOD_RES (1)..(1): Any amino acid
XRCCRRRCCCRQPPHALRPLLLLPLVLLPPLAAAAAGPNRCDTIYQGFAECLIRLGDSMGRGGELETICSTVDKEYLIVLREPGGWMS

SEQ ID NO: 56214 - protein, 87 aa, Homo sapiens
  Payload ID: 11047
  Gene Symbol: NRN1L
  Gene Name: neuritin 1-like
  ENSP ID: ENSP00000464568
MTSMPVPLRSCQAVRRRQLQCGNHYSKKLARPPVRITCTLCAVPRCMFGSAAQAPKPTRRRCGLQRLHSPWPLRPHCWRLLWLWPTS

SEQ ID NO: 56215 - protein, 2947 aa, Homo sapiens [sequence omitted]

SEQ ID NO: 56216 - protein, 524 aa, Homo sapiens
  Payload ID: 11048
  Gene Symbol: NBEA
  Gene Name: neurobeachin
  Uniprot ID: Q8NFP9
  ENSP ID: ENSP00000369254
MFVNSNGYNLGVREDEVVVNDVDLPPWAKKPEDFVRINRMALESEFVSCQLHQWIDLIFGYKQRGPEAVRALNVFHYLTYEGSVNLDSITDPVLREIPEAYFIRDPHTFLLTKDFIKAMEAQIQNFGQTPSQLLIEPHPPRSSAMHLCFLPQSPLMFKDQMQQDVIMVLKFPSNSPVTHVAANTLPHLTIPAVVTVTCSRLFAVNRWHNTVGLRGAPGYSLDQAHHLPIEMDPLIANNSGVNKRQITDLVDQSIQINAHCFVVTADNRYILICGFWDKSFRVYSTETGKLTQIVFGHWDVVTCLARSESYIGGDCYIVSGSRDATLLLWYWSGRHHIIGDNPNSSDYPAPRAVLTGHDHEVVCVSVCAELGLVISGAKEGPCLVHTITGDLLRALEGPENCLFPRLISVSSEGHCIIYYERGRFSNFSINGKLLAQMEINDSTRAILLSSDGQNLVTGGDNGVVEVWQACDFKQLYIYPGCDAGIRAMDLSHDQRTLITGMASGSIVAFNIDFNRWHYEHQNRY

SEQ ID NO: 56217 - protein, 2943 aa, Homo sapiens
  Payload ID: 11048
  Gene Symbol: NBEA
  Gene Name: neurobeachin
  ENSP ID: ENSP00000369271
MASEKPGPGPGLEPQPVGLIAVGAAGGGGGGSGGGGTGGSGMGELRGASGSGSVMLPAGMINPSVPIRNIRMKFAVLIGLIQVGEVSNRDIVETVLNLLVGGEFDLEMNFIIQDAESITCMTELLEHCDVTCQAEIWSMFTAILRKSVRNLQTSTEVGLIEQVLLKMSAVDDMIADLLVDMLGVLASYSITVKELKLLFSMLRGESGIWPRHAVKLLSVLNQMPQRHGPDTFFNFPGCSAAAIALPPIAKWPYQNGFTLNTWFRMDPLNNINVDKDKPYLYCFRTSKGVGYSAHFVGNCLIVTSLKSKGKGFQHCVKYDFQPRKWYMISIVHIYNRWRNSEIRCYVNGQLVSYGDMAWHVNTNDSYDKCFLGSSETADANRVFCGQLGAVYVFSEALNPAQIFAIHQLGPGYKSTFKFKSESDIHLAEHHKQVLYDGKLASSIAFTYNAKATDAQLCLESSPKENASIFVHSPHALMLQDVKAIVTHSIHSAIHSIGGIQVLFPLFAQLDNRQLNDSQVETTVCATLLAFLVELLKSSVAMQEQMLGGKGFLVIGYLLEKSSRVHITRAVLEQFLSFAKYLDGLSHGAPLLKQLCDHILFNPAIWIHTPAKVQLSLYTYLSAEFIGTATIYTTIRRVGTVLQLMHTLKYYYWVINPADSSGITPKGLDGPRPSQKEIISLRAFMLLFLKQLILKDRGVKEDELQSILNYLLTMHEDENIHDVLQLLVALMSEHPASMIPAFDQRNGIRVIYKLLASKSESIWVQALKVLGYFLKHLGHKRKVEIMHTHSLFTLLGERLMLHTNTVTVTTYNTLYEILTEQVCTQVVHKPHPEPDSTVKIQNPMILKVVATLLKNSTPSAELMEVRRLFLSDMIKLFSNSRENRRCLLQCSVWQDWMFSLGYINPKNSEEQKITEMVYNIFRILLYHAIKYEWGGWRVWVDTLSIAHSKVTYEAHKEYLAKMYEEYQRQEEENIKKGKKGNVSTISGLSSQTTGAKGGMEIREIEDLSQSQSPESETDYPVSTDTRDLLMSTKVSDDILGNSDRPGSGVHVEVHDLLVDIKAEKVEATEVKLDDMDLSPETLVGGENGALVEVESLLDNVYSAAVEKLQNNVHGSVGIIKKNEEKDNGPLITLADEKEDLPNSSTSFLFDKIPKQEEKLLPELSSNHIIPNIQDTQVHLGVSDDLGLLAHMTGSVDLTCTSSIIEEKEFKIHTTSDGMSSISERDLASSTKGLEYAEMTATTLETESSSSKIVPNIDAGSIISDTERSDDGKESGKEIRKIQTTTTTQAVQGRSITQQDRDLRVDLGFRGMPMTEEQRRQFSPGPRTTMFRIPEFKWSPMHQRLLTDLLFALETDVHVWRSHSTKSVMDFVNSNENIIFVHNTIHLISQMVDNIIIACGGILPLLSAATSPTTELENIEVTQGMSAETAVTFLSRLMAMVDVLVFASSLNFSEIEAEKNMSSGGLMRQCLRLVCCVAVRNCLECRQRQRDRGNKSSHGSSKPQEVPQSVTATAASKTPLENVPGNLSPIKDPDRLLQDVDINRLRAVVFRDVDDSKQAQFLALAVVYFISVLMVSKYRDILEPQRETTRTGSQPGRNIRQEINSPTSTVVVIPSIPHPSLNHGFLAKLIPEQSFGHSFYKETPAAFPDTIKEKETPTPGEDIQVESSIPHTDSGIGEEQVASILNGAELETSTGPDAMSELLSTLSSEVKKSQESLTENPSETLKPATSISSISQTKGINVKEILKSLVAAPVEIAECGPEPIPYPDPALKRETQAILPMQFHSFDRSVVVPVKKPPPGSLAVTTVGATTAGSGLPTGSTSNIFAATGATPKSMINTTGAVDSGSSSSSSSSSFVNGATSKNLPAVQTVAPMPEDSAENMSITAKLERALEKVAPLLREIFVDFAPFLSRTLLGSHGQELLIEGLVCMKSSTSVVELVMLLCSQEWQNSIQKNAGLAFIELINEGRLLCHAMKDHIVRVANEAEFILNRQRAEDVHKHAEFESQCAQYAADRREEEKMCDHLISAAKHRDHVTANQLKQKILNILTNKHGAWGAVSHSQLHDFWRLDYWEDDLRRRRRFVRNAFGSTHAEALLKAAIEYGTEEDVVKSKKTFRSQAIVNQNAETELMLEGDDDAVSLLQEKEIDNLAGPVVLSTPAQLIAPVVVAKGTLSITTTEIYFEVDEDDSAFKKIDTKVLAYTEGLHGKWMFSEIRAVFSRRYLLQNTALEVFMANRTSVMFNFPDQATVKKVVYSLPRVGVGTSYGLPQARRISLATPRQLYKSSNMTQRWQRREISNFEYLMFLNTIAGRTYNDLNQYPVFPWVLTNYESEELDLTLPGNFRDLSKPIGALNPKRAVFYAERYETWEDDQSPPYHYNTHYSTATSTLSWLVRIEPFTTFFLNANDGKFDHPDRTFSSVARSWRTSQRDTSDVKELIPEFYYLPEMFVNSNGYNLGVREDEVVVNDVDLPPWAKKPEDFVRINRMALESEFVSCQLHQWIDLIFGYKQRGPEAVRALNVFHYLTYEGSVNLDSITDPVLREAMEAQIQNFGQTPSQLLIEPHPPRSSAMHLCFLPQSPLMFKDQMQQDVIMVLKFPSNSPVTHVAANTLPHLTIPAVVTVTCSRLFAVNRWHNTVGLRGAPGYSLDQAHHLPIEMDPLIANNSGVNKRQITDLVDQSIQINAHCFVVTADNRYILICGFWDKSFRVYSTETGKLTQIVFGHWDVVTCLARSESYIGGDCYIVSGSRDATLLLWYWSGRHHIIGDNPNSSDYPAPRAVLTGHDHEVVCVSVCAELGLVISGAKEGPCLVHTITGDLLRALEGPENCLFPRLISVSSEGHCIIYYERGRFSNFSINGKLLAQMEINDSTRAILLSSDGQNLVTGGDNGVVEVWQACDFKQLYIYPGCDAGIRAMDLSHDQRTLITGMASGSIVAFNIDFNRWHYEHQNRY

SEQ ID NO: 56218 - protein, 2946 aa, Homo sapiens
  Payload ID: 11048
  Gene Symbol: NBEA
  Gene Name: neurobeachin
  Uniprot ID: Q8NFP9
  ENSP ID: ENSP00000383295
MASEKPGPGPGLEPQPVGLIAVGAAGGGGGGSGGGGTGGSGMGELRGASGSGSVMLPAGMINPSVPIRNIRMKFAVLIGLIQVGEVSNRDIVETVLNLLVGGEFDLEMNFIIQDAESITCMTELLEHCDVTCQAEIWSMFTAILRKSVRNLQTSTEVGLIEQVLLKMSAVDDMIADLLVDMLGVLASYSITVKELKLLFSMLRGESGIWPRHAVKLLSVLNQMPQRHGPDTFFNFPGCSAAAIALPPIAKWPYQNGFTLNTWFRMDPLNNINVDKDKPYLYCFRTSKGVGYSAHFVGNCLIVTSLKSKGKGFQHCVKYDFQPRKWYMISIVHIYNRWRNSEIRCYVNGQLVSYGDMAWHVNTNDSYDKCFLGSSETADANRVFCGQLGAVYVFSEALNPAQIFAIHQLGPGYKSTFKFKSESDIHLAEHHKQVLYDGKLASSIAFTYNAKATDAQLCLESSPKENASIFVHSPHALMLQDVKAIVTHSIHSAIHSIGGIQVLFPLFAQLDNRQLNDSQVETTVCATLLAFLVELLKSSVAMQEQMLGGKGFLVIGYLLEKSSRVHITRAVLEQFLSFAKYLDGLSHGAPLLKQLCDHILFNPAIWIHTPAKVQLSLYTYLSAEFIGTATIYTTIRRVGTVLQLMHTLKYYYWVINPADSSGITPKGLDGPRPSQKEIISLRAFMLLFLKQLILKDRGVKEDELQSILNYLLTMHEDENIHDVLQLLVALMSEHPASMIPAFDQRNGIRVIYKLLASKSESIWVQALKVLGYFLKHLGHKRKVEIMHTHSLFTLLGERLMLHTNTVTVTTYNTLYEILTEQVCTQVVHKPHPEPDSTVKIQNPMILKVVATLLKNSTPSAELMEVRRLFLSDMIKLFSNSRENRRCLLQCSVWQDWMFSLGYINPKNSEEQKITEMVYNIFRILLYHAIKYEWGGWRVWVDTLSIAHSKVTYEAHKEYLAKMYEEYQRQEEENIKKGKKGNVSTISGLSSQTTGAKGGMEIREIEDLSQSQSPESETDYPVSTDTRDLLMSTKVSDDILGNSDRPGSGVHVEVHDLLVDIKAEKVEATEVKLDDMDLSPETLVGGENGALVEVESLLDNVYSAAVEKLQNNVHGSVGIIKKNEEKDNGPLITLADEKEDLPNSSTSFLFDKIPKQEEKLLPELSSNHIIPNIQDTQVHLGVSDDLGLLAHMTGSVDLTCTSSIIEEKEFKIHTTSDGMSSISERDLASSTKGLEYAEMTATTLETESSSSKIVPNIDAGSIISDTERSDDGKESGKEIRKIQTTTTTQAVQGRSITQQDRDLRVDLGFRGMPMTEEQRRQFSPGPRTTMFRIPEFKWSPMHQRLLTDLLFALETDVHVWRSHSTKSVMDFVNSNENIIFVHNTIHLISQMVDNIIIACGGILPLLSAATSPTGSKTELENIEVTQGMSAETAVTFLSRLMAMVDVLVFASSLNFSEIEAEKNMSSGGLMRQCLRLVCCVAVRNCLECRQRQRDRGNKSSHGSSKPQEVPQSVTATAASKTPLENVPGNLSPIKDPDRLLQDVDINRLRAVVFRDVDDSKQAQFLALAVVYFISVLMVSKYRDILEPQRETTRTGSQPGRNIRQEINSPTSTVVVIPSIPHPSLNHGFLAKLIPEQSFGHSFYKETPAAFPDTIKEKETPTPGEDIQVESSIPHTDSGIGEEQVASILNGAELETSTGPDAMSELLSTLSSEVKKSQESLTENPSETLKPATSISSISQTKGINVKEILKSLVAAPVEIAECGPEPIPYPDPALKRETQAILPMQFHSFDRSVVVPVKKPPPGSLAVTTVGATTAGSGLPTGSTSNIFAATGATPKSMINTTGAVDSGSSSSSSSSSFVNGATSKNLPAVQTVAPMPEDSAENMSITAKLERALEKVAPLLREIFVDFAPFLSRTLLGSHGQELLIEGLVCMKSSTSVVELVMLLCSQEWQNSIQKNAGLAFIELINEGRLLCHAMKDHIVRVANEAEFILNRQRAEDVHKHAEFESQCAQYAADRREEEKMCDHLISAAKHRDHVTANQLKQKILNILTNKHGAWGAVSHSQLHDFWRLDYWEDDLRRRRRFVRNAFGSTHAEALLKAAIEYGTEEDVVKSKKTFRSQAIVNQNAETELMLEGDDDAVSLLQEKEIDNLAGPVVLSTPAQLIAPVVVAKGTLSITTTEIYFEVDEDDSAFKKIDTKVLAYTEGLHGKWMFSEIRAVFSRRYLLQNTALEVFMANRTSVMFNFPDQATVKKVVYSLPRVGVGTSYGLPQARRISLATPRQLYKSSNMTQRWQRREISNFEYLMFLNTIAGRTYNDLNQYPVFPWVLTNYESEELDLTLPGNFRDLSKPIGALNPKRAVFYAERYETWEDDQSPPYHYNTHYSTATSTLSWLVRIEPFTTFFLNANDGKFDHPDRTFSSVARSWRTSQRDTSDVKELIPEFYYLPEMFVNSNGYNLGVREDEVVVNDVDLPPWAKKPEDFVRINRMALESEFVSCQLHQWIDLIFGYKQRGPEAVRALNVFHYLTYEGSVNLDSITDPVLREAMEAQIQNFGQTPSQLLIEPHPPRSSAMHLCFLPQSPLMFKDQMQQDVIMVLKFPSNSPVTHVAANTLPHLTIPAVVTVTCSRLFAVNRWHNTVGLRGAPGYSLDQAHHLPIEMDPLIANNSGVNKRQITDLVDQSIQINAHCFVVTADNRYILICGFWDKSFRVYSTETGKLTQIVFGHWDVVTCLARSESYIGGDCYIVSGSRDATLLLWYWSGRHHIIGDNPNSSDYPAPRAVLTGHDHEVVCVSVCAELGLVISGAKEGPCLVHTITGDLLRALEGPENCLFPRLISVSSEGHCIIYYERGRFSNFSINGKLLAQMEINDSTRAILLSSDGQNLVTGGDNGVVEVWQACDFKQLYIYPGCDAGIRAMDLSHDQRTLITGMASGSIVAFNIDFNRWHYEHQNRY

SEQ ID NO: 56219 - protein, 739 aa, Homo sapiens
  Payload ID: 11048
  Gene Symbol: NBEA
  Gene Name: neurobeachin
  Uniprot ID: Q8NFP9
  ENSP ID: ENSP00000440233
MFSEIRAVFSRRYLLQNTALEVFMANRTSVMFNFPDQATVKKVVYSLPRVGVGTSYGLPQARRISLATPRQLYKSSNMTQRWQRREISNFEYLMFLNTIAGRTYNDLNQYPVFPWVLTNYESEELDLTLPGNFRDLSKPIGALNPKRAVFYAERYETWEDDQSPPYHYNTHYSTATSTLSWLVRIEPFTTFFLNANDGKFDHPDRTFSSVARSWRTSQRDTSDVKELIPEFYYLPEMFVNSNGYNLGVREDEVVVNDVDLPPWAKKPEDFVRINRMALESEFVSCQLHQWIDLIFGYKQRGPEAVRALNVFHYLTYEGSVNLDSITDPVLREAMEAQIQNFGQTPSQLLIEPHPPRSSAMHLCFLPQSPLMFKDQMQQDVIMVLKFPSNSPVTHVAANTLPHLTIPAVVTVTCSRLFAVNRWHNTVGLRGAPGYSLDQAHHLPIEMDPLIANNSGVNKRQITDLVDQSIQINAHCFVVTADNRYILICGFWDKSFRVYSTETGKLTQIVFGHWDVVTCLARSESYIGGDCYIVSGSRDATLLLWYWSGRHHIIGDNPNSSDYPAPRAVLTGHDHEVVCVSVCAELGLVISGAKEGPCLVHTITGDLLRALEGPENCLFPRLISVSSEGHCIIYYERGRFSNFSINGKLLAQMEINDSTRAILLSSDGQNLVTGGDNGVVEVWQACDFKQLYIYPGCDAGIRAMDLSHDQRTLITGMASGSIVAFNIDFNRWHYEHQNRY

SEQ ID NO: 56220 - protein, 2946 aa, Homo sapiens [sequence omitted]

SEQ ID NO: 56221 - protein, 709 aa, Homo sapiens
  Payload ID: 11049
  Gene Symbol: NBEAL1
  Gene Name: neurobeachin-like 1
  ENSP ID: ENSP00000388466
EIFHVDQSNYFLNFKKEVRNKIYSRLLSLHSPNSYYGSRSPQELFKASGLTQFPWILQDYTSEELDLNNPAVFRDLSKPIGVVNEKNAKAMREKYENFEDPMGTIDKFHYGTHYSNSAGVMHYLIRVEPFTTLHIQLQSGRFDCADRQFHSIPATWQALMDNPYDVKELIPEFFYFPEFLENQNQFNLGRLQISKELVNDVILPKWAKSAEDFIYKHRKALESEYVSAHLHEWIDLIFGYKQRGPAAVEALNVFYYCSYEGAVDLDALTDEKERKALEGMINNFGQTPCQLLKEPHPPRLSAEEAVQKPTKIDTSTLNLFQHLPELKSFFIEGISDGIPLLKATIPKNQYRSFMSQGSPELLITISMNYVIGTHGWLPYDRNISNYFTFIKDQTVTNPKTQRSINGSFAPGLEITSKLFVVSHDAKLLFSAGYWDNSIQVMSLTKGKIISHIIRHMDIVTCLATDYCGIHLISGSRDTTCMIWQITQQGGVPVGLASKPFQILYGHTNEVLSVGISTELDMAVSGSRDGTVIIHTIQKGQYMRTLRPPCESSLFLTIPNLAISWEGHIVVYSSTEEKTTLKDKNALHLFSINGKYLGSQILKEQVSDICIIGEHIVTGSIQGFLSIRDLHSLNLSINPLAMRLPIHCVCVTKEYSHILVGLEDGKLIVVGVGKPAEMRSGQLSRKFWGSSKRLSQISAGETEYNTQDSK

SEQ ID NO: 56222 - protein, 2694 aa, Homo sapiens
  Payload ID: 11049
  Gene Symbol: NBEAL1
  Gene Name: neurobeachin-like 1
  Uniprot ID: Q6ZS30
  ENSP ID: ENSP00000399903
MASRERLFELWMLYCTKKDPDYLKLWLDTFVSSYEQFLDVDFEKLPTRVDDMPPGISLLPDNILQVLRIQLLQCVQKMADGLEEQQQALSILLVKFFIILCRNLSNVEEIGTCSYINYVITMTTLYIQQLKSKKKEKEMADQTCIEEFVIHALAFCESLYDPYRNWRHRISGRILSTVEKSRQKYKPASLTVEFVPFFYQCFQESEHLKESLKCCLLHLFGAIVAGGQRNALQAISPATMEVLMRVLADCDSWEDGDPEEVGRKAELTLKCLTEVVHILLSSNSDQRQVETSTILENYFKLLNSDHSALPNQRRSRQWENRFIALQIKMLNTITAMLDCTDRPVLQAIFLNSNCFEHLIRLLQNCKVFQGQLDCLAISTIQALTAVMNKSPAAKEVFKERIGYTHMLEVLKSLGQPPLELLKELMNMAVEGDHTSVGILGISNVQPLLLLIQWLPELQSHDLQIFISDWLKRICCINRQSRTTCVNANMGIRIIETLDLHSSLHQTCAENLIAIHGSLGSQSVSSEEIRRLLRLLRVDESESVHPYVTPVTRAILTMARKLSLESALQYFNLSHSMAGISVPPIQKWPGSAFSFSAWFCLDQDQLTLGIANKGGKRKQLYSFFTGSGMGFEAFITHSGMLVVAVCTKREYATVMLPDHSFCDSLWHNITVVHMPGKRPFGQSFVYIYDNGQQKVSAPLRFPAMNEPFTSCCIGSAGQRTTTPPPSQIPDPPFSSPITPHRTSFGGILSSASWGGTIEKSKLITKLISAGTQDSEWGCPTSLEGQLGSVIIFYEPLQPPQVKALYLAGPNCLSPWKCQESDMADLPGNILLYYTAKACKNSICLDLSTNCLHGRLTGNKVVNWDIKDIINCIGGLNVLFPLLEQISHFSEGQIPEEKNESTVPESVTPVEGDWLVWTSTKASESRLERNLVATFILIVKHFIQRHPINQGNLIHSHGVATLGALLQKVPSTLMDVNVLMAVQLLIEQVSLEKNMQLLQQMYQYLLFDFRIWNRGDFPFRIGHIQYLSTIIKDSRRVFRKKYGVQFLLDTLRIYYGNGCKYNELSLDDIRTIRTSLYGLIKYFLCKGGSHEEIQSIMGYIAATNEEEQLFGILDVLFSLLRTSPTRGQLFLLLFEPGNADILYALLLNQKYSDRLREIIFKIMEQMLKCTNVYERSKQHIRLREVGYSGLGLLLNEALVNTSLIKNLTHQIINTDPVINFKDLLSVVYISHRAHINVRVAICRKVLQILQFQPDAAHQISQQVGWQDTLVRLFLKAKFENGNTLHKHSRAVLMKDNDKNMSTEDTKKNSDEKTDEEKITSFASANVSSDQWSLEDRHSLDSNTPLFPEDSSVGELSFKSENQEEFWHSNPSHLSLDLSGIDSCEMSDSGSQVPDSLPSTPSPVESTKSFSVHSDRESSITNDMGFSDDFSLLESQERCEEELLQLLTHILNYVMCKGLEKSDDDTWIERGQVFSALSKPGISSELLRPSDEIKLTLLQKMLEWAISENREAKTNPVTAENAFRLVLIIQDFLQSEGLVNSNMWTEKLLEDMMLLFDCLSVCYSESPVWVKLSQIQIQLLLGFIGRGNLQVCAMASAKLNTLLQTKVIENQDEACYILGKLEHVLSQSIKEQTEIYSFLIPLVRTLVSKIYELLFMNLHLPSLPFTNGSSSFFEDFQEYCNSNEWQVYIEKYIVPYMKQYEAHTFYDGHENMALYWKDCYEALMVNMHKRDREGGESKLKFQELFVEPFNRKARQENLRYNNMLKQLSSQQLATLRRWKAIQLYLTCERGPWAKRKQNPIHWKLANVENYSRMRLKLVPNYNFKTHEEASALRDNLGIQHSQPSSDTLLLEVVKQVKVSDMVEDKLDLPEEDITARVNVDEKEEQDQKEKLVLMEDCELITIIDVIPGRLEITTQHIYFYDGSIEKEDGVGFDFKWPHSQIREIHLRRYNLRRSALEIFHVDQSNYFLNFKKEVRNKIYSRLLSLHSPNSYYGSRSPQELFKASGLTQKWVNREISNFDYLIQINTMAGRTYNDLAQYPVFPWILQDYTSEELDLNNPAVFRDLSKPIGVVNEKNAKAMREKYENFEDPMGTIDKFHYGTHYSNSAGVMHYLIRVEPFTTLHIQLQSGRFDCADRQFHSIPATWQALMDNPYDVKELIPEFFYFPEFLENQNQFNLGRLQISKELVNDVILPKWAKSAEDFIYKHRKALESEYVSAHLHEWIDLIFGYKQRGPAAVEALNVFYYCSYEGAVDLDALTDEKERKALEGMINNFGQTPCQLLKEPHPPRLSAEEAVQKPTKIDTSTLNLFQHLPELKSFFIEGISDGIPLLKATIPKNQYRSFMSQGSPELLITISMNYVIGTHGWLPYDRNISNYFTFIKDQTVTNPKTQRSINGSFAPGLEITSKLFVVSHDAKLLFSAGYWDNSIQVMSLTKGKIISHIIRHMDIVTCLATDYCGIHLISGSRDTTCMIWQITQQGGVPVGLASKPFQILYGHTNEVLSVGISTELDMAVSGSRDGTVIIHTIQKGQYMRTLRPPCESSLFLTIPNLAISWEGHIVVYSSTEEKTTLKDKNALHLFSINGKYLGSQILKEQVSDICIIGEHIVTGSIQGFLSIRDLHSLNLSINPLAMRLPIHCVCVTKEYSHILVGLEDGKLIVVGVGKPAEMRSGQLSRKFWGSSKRLSQISAGETEYNTQDSK

SEQ ID NO: 56223 - protein, 230 aa, Homo sapiens
  Payload ID: 11049
  Gene Symbol: NBEAL1
  Gene Name: neurobeachin-like 1
  ENSP ID: ENSP00000411142
  MOD_RES (1)..(1): Any amino acid
XGGVPVGLASKPFQILYGHTNEVLSVGISTELDMAVSGSRDGTVIIHTIQKGQYMRTLRPPCESSLFLTIPNLAISWEGHIVVYSSTEEKTTLKDKNALHLFSINGKYLGSQILKEQVSDICIIGEHIVTGSIQGFLSIRDLHSLNLSINPLAMRLPIHCVCVTKEYSHILVGLEDGKLIVVGVGKPAEMRSGQLSRKFWGSSKRLSQISAGETEYNTQDSKSRITKQQR

SEQ ID NO: 56224 - protein, 107 aa, Homo sapiens
  Payload ID: 11050
  Gene Symbol: NBEAL2
  Gene Name: neurobeachin-like 2
  ENSP ID: ENSP00000409601
IDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVV

SEQ ID NO: 56225 - protein, 2042 aa, Homo sapiens
  Payload ID: 11050
  Gene Symbol: NBEAL2
  Gene Name: neurobeachin-like 2
  ENSP ID: ENSP00000410405
  MOD_RES (1)..(1): Any amino acid
XPMELRHLLRPRPGLDSEPGGAEAGKARHAGAVIRTLSGMARHQGPARALRYFDLTPSMAGIMVPPVQRWPGPGFTFHAWLCLHPMDTAPTPAPTRPLQRKQLYSFFTSSGSGFEAFFTAAGTLVVAVCTRKEYLTMSLPEVSFADSAWHCVAIVHVPGRRPFSQNLVHVYKDGHLVKTAPLRCPSLSEPFSSCCIGSAGYRTTTTTTGLPTPPVPATLAYTHPALTRSQSVPASTGLGWGSGLVAPLQEGSIDSTLAGTQDTRWGSPTSLEGELGAVAIFHEALQATALRTLCTLGPNETAPFKPEGELHELSTRLLLHYSPQACKNNICLDLSPSHGLDGRLTGHRVETWDVKDVVNCVGGMGALLPLLERVAAQPKEAEAGPAETHDLVGPELTSGHNTQGLVLPLGKSSEERMERNAVAAFLLMLRNFLQGHMVNQESLVQCQGPAIIGALLRKVPSWAMDMNVLMSAQLLMEQVAAEGSGPLLYLLYQHLLFNFHLWTLSDFAVRLGHIQYMSSIVREHRQKLRKKYGVQFILDALRTHYSPQRERPLAADDLRTVQTSLLGLAREFLVRSLSADDVQVTQTMLSFLAATGDDGQILRRLQQNERLPERSRQRLRLRECGLQGLVACLPEGTVSPQLCQGLYKLFLGAGSGNTAGGGGSSGTLTPASQPGTPSPLDGPRPFPAAPGRHSSSLSNVLEDGSLPEPTISGDDTSNTSNPQQTSEEELCNLLTNVLFSVTWRGVEGSDEAAWRERGQVFSVLTQLGASATLVRPPDCIKRSLLEMMLESALTDIKEAPVGVLASLTQQALWLLRLLQDFLCAEGHGNQELWSEKLFEGVCSLLDRLGAWPHLANGTADLREMAQIGLRLVLGYILLEDPQLHAQAYVRLHMLLQTAVPARREEACYVLSKLEAALGRVLNTSSLESATDEAGSPLAAAAAAAAAERCSWLVPLVRTLLDRAYEPLGLQWGLPSLPPTNGSPTFFEDFQAFCATPEWRHFIDKQVQPTMSQFEMDTYAKSHDLMSGFWNACYDMLMSSGQRRQWERAQSRRAFQELVLEPAQRRARLEGLRYTAVLKQQATQHSMALLHWGALWRQLASPCGAWALRDTPIPRWKLSSAETYSRMRLKLVPNHHFDPHLEASALRDNLGEVPLTPTEEASLPLAVTKEAKVSTPPELLQEDQLGEDELAELETPMEAAELDEQREKLVLSAECQLVTVVAVVPGLLEVTTQNVYFYDGSTERVETEEGIGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVVSDGVPLVLALVPHRQPHSFITQGSPDLLVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 56226 - protein, 1093 aa, Homo sapiens
  Payload ID: 11050
  Gene Symbol: NBEAL2
  Gene Name: neurobeachin-like 2
  ENSP ID: ENSP00000414560
  MOD_RES (1)..(1): Any amino acid
XLNTSSLESATDEAGSPLAAAAAAAAAERCSWLVPLVRTLLDRAYEPLGLQWGLPSLPPTNGSPTFFEDFQAFCATPEWRHFIDKQVQPTMSQFEMDTYAKSHDLMSGFWNACYDMLMSSGQRRQWERAQSRRAFQELVLEPAQRRARLEGLRYTAVLKQQATQHSMALLHWGALWRQLASPCGAWALRDTPIPRWKLSSAETYSRMRLKLVPNHHFDPHLEASALRDNLGEVPLTPTEEASLPLAVTKEAKVSTPPELLQEDQLGEDELAELETPMEAAELDEQREKLVLSAECQLVTVVAVVPGLLEVTTQNVYFYDGSTERVETEEGIGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 56227 - protein, 2754 aa, Homo sapiens
  Payload ID: 11050
  Gene Symbol: NBEAL2
  Gene Name: neurobeachin-like 2
  Uniprot ID: Q6ZNJ1
  ENSP ID: ENSP00000415034
MAASERLYELWLLYYAQKDLGYLQQWLKAFVGAFKKSISLSSLEPRRPEEAGAEVPLLPLDELHVLAEQLHQADLEQALLLLKLFIILCRNLENIEAGRGQVLVPRVLALLTKLVAELKGCPPPQGRGTQLENVALHALLLCEGLFDPYQTWRRQRSGEVISSKEKSKYKFPPAALPQEFSAFFQESLQNADHLPPILLLRLIHLFCAVLAGGKENGQMAVSDGSVKGLLSVVRGWSRGPAPDPCLVPLALEALVGAVHVLHASRAPPRGPELRALLESYFHVLNADWPAGLSSGPEEALVTLRVSMLDAIPMMLACEDRPVLQATFLSNNCFEHLTRLIQNSKLYLQSRAPPEGDSDLATRLLTEPDVQKVLDQDTDAIAVHVVRVLTCIMSDSPSAKEVFKERIGYPHLQEVLQSHGPPTHRLLQELLNMAVEGDHSMCPPPPIRNEQPVLVLAQWLPSLPTAELRLFLAQRLRWLCDSCPASRATCVQAGLVGCLLETLSTGLALEARCQEQLLALLQALGRVSIRPMELRHLLRPRPGLDSEPGGAEAGKARHAGAVIRTLSGMARHQGPARALRYFDLTPSMAGIMVPPVQRWPGPGFTFHAWLCLHPMDTAPTPAPTRPLQRKQLYSFFTSSGSGFEAFFTAAGTLVVAVCTRKEYLTMSLPEVSFADSAWHCVAIVHVPGRRPFSQNLVHVYKDGHLVKTAPLRCPSLSEPFSSCCIGSAGYRTTTTTTGLPTPPVPATLAYTHPALTRSQSVPASTGLGWGSGLVAPLQEGSIDSTLAGTQDTRWGSPTSLEGELGAVAIFHEALQATALRTLCTLGPNETAPFKPEGELHELSTRLLLHYSPQACKNNICLDLSPSHGLDGRLTGHRVETWDVKDVVNCVGGMGALLPLLERVAAQPKEAEAGPAETHDLVGPELTSGHNTQGLVLPLGKSSEERMERNAVAAFLLMLRNFLQGHMVNQESLVQCQGPAIIGALLRKVPSWAMDMNVLMSAQLLMEQVAAEGSGPLLYLLYQHLLFNFHLWTLSDFAVRLGHIQYMSSIVREHRQKLRKKYGVQFILDALRTHYSPQRERPLAADDLRTVQTSLLGLAREFLVRSLSADDVQVTQTMLSFLAATGDDGQAVGALDLLLALLHGSLVQESLAVFLLEPGNLEVLLALLVRPGSLPLLPDRVCKILRRLQQNERLPERSRQRLRLRECGLQGLVACLPEGTVSPQLCQGLYKLFLGADCLNLSDLLAVVQLSLQADLSVRLDICRQLFHLIYGQPDVVRLLARQAGWQDVLTRLYVLEAATAGSPPPSSPESPTSPKPAPPKPPTESPAEPSDVFLPSEAPCPDPDGFYHALSPFCTPFDLGLERSSVGSGNTAGGGGSSGTLTPASQPGTPSPLDGPRPFPAAPGRHSSSLSNVLEDGSLPEPTISGDDTSNTSNPQQTSEEELCNLLTNVLFSVTWRGVEGSDEAAWRERGQVFSVLTQLGASATLVRPPDCIKRSLLEMMLESALTDIKEAPVGVLASLTQQALWLLRLLQDFLCAEGHGNQELWSEKLFEGVCSLLDRLGAWPHLANGTADLREMAQIGLRLVLGYILLEDPQLHAQAYVRLHMLLQTAVPARREEACYVLSKLEAALGRVLNTSSLESATDEAGSPLAAAAAAAAAERCSWLVPLVRTLLDRAYEPLGLQWGLPSLPPTNGSPTFFEDFQAFCATPEWRHFIDKQVQPTMSQFEMDTYAKSHDLMSGFWNACYDMLMSSGQRRQWERAQSRRAFQELVLEPAQRRARLEGLRYTAVLKQQATQHSMALLHWGALWRQLASPCGAWALRDTPIPRWKLSSAETYSRMRLKLVPNHHFDPHLEASALRDNLGEVPLTPTEEASLPLAVTKEAKVSTPPELLQEDQLGEDELAELETPMEAAELDEQREKLVLSAECQLVTVVAVVPGLLEVTTQNVYFYDGSTERVETEEGIGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVVSDGVPLVLALVPHRQPHSFITQGSPDLLVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 56228 - protein, 255 aa, Homo sapiens
  Payload ID: 11050
  Gene Symbol: NBEAL2
  Gene Name: neurobeachin-like 2
  ENSP ID: ENSP00000415063
EPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEDAATAEWPVGARQWCEWTSTGSGPGWKAAIQRWPLGWQPAGDCTTPWQAV

SEQ ID NO: 56229 - protein, 216 aa, Homo sapiens
  Payload ID: 11051
  Gene Symbol: NBL1
  Gene Name: neuroblastoma 1, DAN family BMP antagonist
  Uniprot ID: P41271
  ENSP ID: ENSP00000289749
MPGNLMSQTSRAVSIWKFPAKLGKTHGHRALEATGMMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILHCSCQACGKEPSHEGLSVYVQGEDGPGSQPGTHPHPHPHPHPGGQTPEPEDPPGAPHTEEEGAED

SEQ ID NO: 56230 - protein, 181 aa, Homo sapiens; identical to SEQ ID NO: 51716
  Payload ID: 11051
  Gene Symbol: NBL1
  Gene Name: neuroblastoma 1, DAN family BMP antagonist
  Uniprot ID: P41271
  ENSP ID: ENSP00000364278

SEQ ID NO: 56231 - protein, 128 aa, Homo sapiens
  Payload ID: 11051
  Gene Symbol: NBL1
  Gene Name: neuroblastoma 1, DAN family BMP antagonist
  ENSP ID: ENSP00000390607
MMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILHCSCQACGKEPS

SEQ ID NO: 56232 - protein, 128 aa, Homo sapiens
  Payload ID: 11051
  Gene Symbol: NBL1
  Gene Name: neuroblastoma 1, DAN family BMP antagonist
  ENSP ID: ENSP00000391858
MCSLALQQLISMDLFWRLFFVCGQEGLRALEATGMMLRVLVGAVLPAMLLAAPPPINKLALFPDKSAWCEAKNITQIVGHSGCEAKSIQNRACLGQCFSYSVPNTFPQSTESLVHCDSCMPAQSMWEI

SEQ ID NO: 56233 - protein, 163 aa, Homo sapiens
  Payload ID: 11051
  Gene Symbol: NBL1
  Gene Name: neuroblastoma 1, DAN family BMP antagonist
  ENSP ID: ENSP00000394079
MLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILHCSCQACGKEPSHEGLSVYVQGEDGPGSQPGTHPHPHPHPHPGGQTPE

SEQ ID NO: 56234 - protein, 109 aa, Homo sapiens
  Payload ID: 11051
  Gene Symbol: NBL1
  Gene Name: neuroblastoma 1, DAN family BMP antagonist
  ENSP ID: ENSP00000399333
MMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVD

SEQ ID NO: 56235 - protein, 116 aa, Homo sapiens
  Payload ID: 11051
  Gene Symbol: NBL1
  Gene Name: neuroblastoma 1, DAN family BMP antagonist
  ENSP ID: ENSP00000400250
MMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKIL

SEQ ID NO: 56236 - protein, 117 aa, Homo sapiens
  Payload ID: 11051
  Gene Symbol: NBL1
  Gene Name: neuroblastoma 1, DAN family BMP antagonist
  ENSP ID: ENSP00000412419
MMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILH

SEQ ID NO: 56237 - protein, 181 aa, Homo sapiens; identical to SEQ ID NO: 51716
  Payload ID: 11051
  Gene Symbol: NBL1
  Gene Name: neuroblastoma 1, DAN family BMP antagonist
  Uniprot ID: P41271
  ENSP ID: ENSP00000449007

SEQ ID NO: 56238 - protein, 215 aa, Homo sapiens
  Payload ID: 11051
  Gene Symbol: NBL1
  Gene Name: neuroblastoma 1, DAN family BMP antagonist
  ENSP ID: ENSP00000478223
MCSLALQQLISMDLFWRLFFVCGQEGLRALEATGMMLRVLVGAVLPAMLLAAPPPINKLALFPDKSAWCEAKNITQIVGHSGCEAKSIQNRACLGQCFSYSVPNTFPQSTESLVHCDSCMPAQSMWEIVTLECPGHEEVPRVDKLVEKILHCSCQACGKEPSHEGLSVYVQGEDGPGSQPGTHPHPHPHPHPGGQTPEPEDPPGAPHTEEEGAED

SEQ ID NO: 56239 - protein, 181 aa, Homo sapiens; identical to SEQ ID NO: 51716
  Payload ID: 11051
  Gene Symbol: NBL1
  Gene Name: neuroblastoma 1, DAN family BMP antagonist
  Uniprot ID: P41271
  ENSP ID: ENSP00000478885

SEQ ID NO: 56240 - protein, 181 aa, Homo sapiens; identical to SEQ ID NO: 51716
  Payload ID: 11051
  Gene Symbol: NBL1
  Gene Name: neuroblastoma 1, DAN family BMP antagonist
  Uniprot ID: P41271
  ENSP ID: ENSP00000480391

SEQ ID NO: 56241 - protein, 181 aa, Homo sapiens; identical to SEQ ID NO: 51716
  Payload ID: 11051
  Gene Symbol: NBL1
  Gene Name: neuroblastoma 1, DAN family BMP antagonist
  Uniprot ID: P41271
  ENSP ID: ENSP00000483061

SEQ ID NO: 56242 - protein, 2371 aa, Homo sapiens
  Payload ID: 11052
  Gene Symbol: NBAS
  Gene Name: neuroblastoma amplified sequence
  Uniprot ID: A2RRP1
  ENSP ID: ENSP00000281513
MAAPESGPALSPGTAEGEEETILYDLLVNTEWPPETEVQPRGNQKHGASFIITKAIRDRLLFLRQYIWYSPAPFLLPDGLVRLVNKQINWHLVLASNGKLLAAVQDQCVEIRSAKDDFTSIIGKCQVPKDPKPQWRRVAWSYDCTLLAYAESTGTVRVFDLMGSELFVISPASSFIGDLSYAIAGLIFLEYKASAQWSAELLVINYRGELRSYLVSVGTNQSYQESHCFSFSSHYPHGINTAIYHPGHRLLLVGGCETAEVGMSKASSCGLSAWRVLSGSPYYKQVTNGGDGVTAVPKTLGLLRMLSVKFYSRQGQEQDGIFKMSLSPDGMLLAAIHFSGKLSIWAIPSLKQQGEWGQNEQPGYDDLNPDWRLSTEKRKKIKDKESFYPLIDVNWWADSAVTLARCSGALTVSSVKTLKNLLGKSCEWFEPSPQVTATHDGGFLSLECEIKLAPKRSRLETRAGEEDEGEEDSDSDYEISAKARYFGYIKQGLYLVTEMERFAPPRKRPRTITKNYRLVSLRSTTPEELYQRKIESEEYEEALSLAHTYGLDTDLVYQRQWRKSAVNVASIQNYLSKIKKRSWVLHECLERVPENVDAAKELLQYGLKGTDLEALLAIGKGADDGRFTLPGEIDIDSISYEELSPPDEEPAKNKKEKELKKRQELLKLVNFSKLTLEQKELCRCRRKLLTYLDRLATYEEILGVPHASEQRYDAEFFKKFRNQNIVLSARTYAQESNVQALEILFTYHGSDLLPHRLAILSNFPETTSPHEYSVLLPEACFNGDSLMIIPWHEHKHRAKDWCEELACRMVVEPNLQDESEFLYAAQPELLRFRMTQLTVEKVMDWYQTRAEEIEHYARQVDCALSLIRLGMERNIPGLLVLCDNLVTLETLVYEARCDVTLTLKELQQMKDIEKLRLLMNSCSEDKYVTSAYQWMVPFLHRCEKQSPGVANELLKEYLVTLAKGDLKFPLKIFQHSKPDLQQKIIPDQDQLMAIALECIYTCERNDQLCLCYDLLECLPERGYGDKTEATTKLHDMVDQLEQILSVSELLEKHGLEKPISFVKNTQSSSEEARKLMVRLTRHTGRKQPPVSESHWRTLLQDMLTMQQNVYTCLDSDACYEIFTESLLCSSRLENIHLAGQMMHCSACSENPPAGIAHKGKPHYRVSYEKSIDLVLAASREYFNSSTNLTDSCMDLARCCLQLITDRPPAIQEELDLIQAVGCLEEFGVKILPLQVRLCPDRISLIKECISQSPTCYKQSTKLLGLAELLRVAGENPEERRGQVLILLVEQALRFHDYKAASMHCQELMATGYPKSWDVCSQLGQSEGYQDLATRQELMAFALTHCPPSSIELLLAASSSLQTEILYQRVNFQIHHEGGENISASPLTSKAVQEDEVGVPGSNSADLLRWTTATTMKVLSNTTTTTKAVLQAVSDGQWWKKSLTYLRPLQGQKCGGAYQIGTTANEDLEKQGCHPFYESVISNPFVAESEGTYDTYQHVPVESFAEVLLRTGKLAEAKNKGEVFPTTEVLLQLASEALPNDMTLALAYLLALPQVLDANRCFEKQSPSALSLQLAAYYYSLQIYARLAPCFRDKCHPLYRADPKELIKMVTRHVTRHEHEAWPEDLISLTKQLHCYNERLLDFTQAQILQGLRKGVDVQRFTADDQYKRETILGLAETLEESVYSIAISLAQRYSVSRWEVFMTHLEFLFTDSGLSTLEIENRAQDLHLFETLKTDPEAFHQHMVKYIYPTIGGFDHERLQYYFTLLENCGCADLGNCAIKPETHIRLLKKFKVVASGLNYKKLTDENMSPLEALEPVLSSQNILSISKLVPKIPEKDGQMLSPSSLYTIWLQKLFWTGDPHLIKQVPGSSPEWLHAYDVCMKYFDRLHPGDLITVVDAVTFSPKAVTKLSVEARKEMTRKAIKTVKHFIEKPRKRNSEDEAQEAKDSKVTYADTLNHLEKSLAHLETLSHSFILSLKNSEQETLQKYSHLYDLSRSEKEKLHDEAVAICLDGQPLAMIQQLLEVAVGPLDISPKDIVQSAIMKIISALSGGSADLGGPRDPLKVLEGVVAAVHASVDKGEELVSPEDLLEWLRPFCADDAWPVRPRIHVLQILGQSFHLTEEDSKLLVFFRTEAILKASWPQRQVDIADIENEENRYCLFMELLESSHHEAEFQHLVLLLQAWPPMKSEYVITNNPWVRLATVMLTRCTMENKEGLGNEVLKMCRSLYNTKQMLPAEGVKELCLLLLNQSLLLPSLKLLLESRDEHLHEMALEQITAVTTVNDSNCDQELLSLLLDAKLLVKCVSTPFYPRIVDHLLASLQQGRWDAEELGRHLREAGHEAEAGSLLLAVRGTHQAFRTFSTALRAAQHWV

SEQ ID NO: 56243 - protein, 184 aa, Homo sapiens
  Payload ID: 11052
  Gene Symbol: NBAS
  Gene Name: neuroblastoma amplified sequence
  ENSP ID: ENSP00000390920
VDIADIENEENRYCLFMELLESSHHEAEFQHLVLLLQAWPPMKSEYVITNNPWVRLATVMLTRCTMENKEGLGNEVLKMCRSLYNTKQMLPAEVNDSNCDQELLSLLLDAKLLVKCVSTPFYPRIVDHLLASLQQGRWDAEELGRHLREAGHEAEAGSLLLAVRGTHQAFRTFSTALRAAQHWV

SEQ ID NO: 56244 - protein, 204 aa, Homo sapiens
  Payload ID: 11052
  Gene Symbol: NBAS
  Gene Name: neuroblastoma amplified sequence
  ENSP ID: ENSP00000391476
  MOD_RES (1)..(1): Any amino acid
XKELQQMKDIEKLRLLMNSCSEDKYVTSAYQWMVPFLHRCEKQSPGVANELLKEYLVTLAKGDLKFPLKIFQHSKPDLQQKIIPDQDQLMAIALECIYTCERNDQLCLCYDLLECLPERGYGDKTEATTKLHDMVDQLEQILSVSELLEKHGLEKPISFVKNTQSSSEEARKLMVRLTRHTGRNLFTTSLSVDIWVILSFGFYK

SEQ ID NO: 56245 - protein, 171 aa, Homo sapiens
  Payload ID: 11052
  Gene Symbol: NBAS
  Gene Name: neuroblastoma amplified sequence
  ENSP ID: ENSP00000392421
LSVEARKEMTRKAIKTVKHFIEKPRKRNSEDEAQEAKDSKVTYADTLNHLEKSLAHLETLSHSFILSLKNSEQETLQKYSHLYDLSRSEKEKLHDEAVAICLDGQPLAMIQQLLEVAVGPLDISPKDIVQSAIMKIISALSGGSADLGGPRDPLKVLEGVVAAVHASVDKG

SEQ ID NO: 56246 - protein, 281 aa, Homo sapiens
  Payload ID: 11052
  Gene Symbol: NBAS
  Gene Name: neuroblastoma amplified sequence
  ENSP ID: ENSP00000396501
MTQLTVEKVMDWYQTRAEEIEHYARQLQQKIIPDQDQLMAIALECIYTCERNDQLCLCYDLLECLPERGYGDKTEATTKLHDMVDQLEQILSVSELLEKHGLEKPISFVKNTQSSSEEARKLMVRLTRHTGRKQPPVSESHWRTLLQDMLTMQQNVYTCLDSDACYEIFTESLLCSSRLENIHLAGQMMHCSACSENPPAGIAHKGKPHYRVSYEKSIDLVLAASREYFNSSTNLTDSCMDLARCCLQLITDRPPAIQEELDLIQAVGCLEEFGVKILPLQ

SEQ ID NO: 56247 - protein, 1419 aa, Homo sapiens
  Payload ID: 11052
  Gene Symbol: NBAS
  Gene Name: neuroblastoma amplified sequence
  ENSP ID: ENSP00000398411
  MOD_RES (1)..(1): Any amino acid
XMTQLTVEKVMDWYQTRAEEIEHYARQLQQKIIPDQDQLMAIALECIYTCERNDQLCLCYDLLECLPERGYGDKTEATTKLHDMVDQLEQILSVSELLEKHGLEKPISFVKNTQSSSEEARKLMVRLTRHTGRKQPPVSESHWRTLLQDMLTMQQNVYTCLDSDACYEIFTESLLCSSRLENIHLAGQMMHCSACSENPPAGIAHKGKPHYRVSYEKSIDLVLAASREYFNSSTNLTDSCMDLARCCLQLITDRPPAIQEELDLIQAVGCLEEFGVKILPLQVRLCPDRISLIKECISQSPTCYKQSTKLLGLAELLRVAGENPEERRGQVLILLVEQALRFHDYKAASMHCQELMATGYPKSWDVCSQLGQSEGYQDLATRQELMAFALTHCPPSSIELLLAASSSLQTEILYQRVNFQIHHEGGENISASPLTSKAVQEDEVGVPGSNSADLLRWTTATTMKVLSNTTTTTKAVLQAVSDGQWWKKSLTYLRPLQGQKCGGAYQIGTTANEDLEKQGCHPFYESVISNPFVAESEGTYDTYQHVPVESFAEVLLRTGKLAEAKNKGEVFPTTEVLLQLASEALPNDMTLALAYLLALPQVLDANRCFEKQSPSALSLQLAAYYYSLQIYARLAPCFRDKCHPLYRADPKELIKMVTRHVTRHEHEAWPEDLISLTKQLHCYNERLLDFTQAQILQGLRKGVDVQRFTADDQYKRETILGLAETLEESVYSIAISLAQRYSVSRWEVFMTHLEFLFTDSGLSTLEIENRAQDLHLFETLKTDPEAFHQHMVKYIYPTIGGFDHERLQYYFTLLENCGCADLGNCAIKPETHIRLLKKFKVVASGLNYKKLTDENMSPLEALEPVLSSQNILSISKLVPKIPEKDGQMLSPSSLYTIWLQKLFWTGDPHLIKQVPGSSPEWLHAYDVCMKYFDRLHPGDLITVVDAVTFSPKAVTKLSVEARKEMTRKAIKTVKHFIEKPRKRNSEDEAQEAKDSKVTYADTLNHLEKSLAHLETLSHSFILSLKNSEQETLQKYSHLYDLSRSEKEKLHDEAVAICLDGQPLAMIQQLLEVAVGPLDISPKDIVQSAIMKIISALSGGSADLGGPRDPLKVLEGVVAAVHASVDKGEELVSPEDLLEWLRPFCADDAWPVRPRIHVLQILGQSFHLTEEDSKLLVFFRTEAILKASWPQRQVDIADIENEENRYCLFMELLESSHHEAEFQHLVLLLQAWPPMKSEYVITNNPWVRLATVMLTRCTMENKEGLGNEVLKMCRSLYNTKQMLPAEGVKELCLLLLNQSLLLPSLKLLLESRDEHLHEMALEQITAVTTVNDSNCDQELLSLLLDAKLLVKCVSTPFYPRIVDHLLASLQQGRWDAEELGRHLREAGHEAEAGSLLLAVRGTHQAFRTFSTALRAAQHWV

SEQ ID NO: 56248 - protein, 100 aa, Homo sapiens
  Payload ID: 11052
  Gene Symbol: NBAS
  Gene Name: neuroblastoma amplified sequence
  ENSP ID: ENSP00000402458
  MOD_RES (1)..(1): Any amino acid
XASSCGLSAWRVLSGSPYYKQVTNGGDGVTAVPKTLGLLRMLSVKFYSRQGQEQDGIFKMSLSPDGMLLAAIHFSGKLSIWAIPSLKQQGEWGQNEQVLD

SEQ ID NO: 56249 - protein, 137 aa, Homo sapiens
  Payload ID: 11052
  Gene Symbol: NBAS
  Gene Name: neuroblastoma amplified sequence
  ENSP ID: ENSP00000403119
IADIENEENRYCLFMELLESSHHEAEFQHLVLLLQAWPPMKSEYVITNNPWVRLATVMLTRCTMENKEGLGNEVLKMCRSLYNTKQMLPAEGVKELCLLLLNQSLLLPSLKLLLESRDEHLHEMALEQITAVTTDIF

SEQ ID NO: 56250 - protein, 1096 aa, Homo sapiens
  Payload ID: 11053
  Gene Symbol: NBPF1
  Gene Name: neuroblastoma breakpoint family, member 1
  ENSP ID: ENSP00000473697
MVVSAGPWSSEKAETNILEINEKLRPQLAENKQQFRNLKEKCFVTQLAGFLANRQKKYKYEECKDLIKFMLRNERQFKEEKLAEQLKQAEELRQYKVLVHSQERELTQLREKLREGRDASRSLNQHLQALLTPDKPDKSQGQDLQEQLAEGCRLAQQLFQKLSPENDEDEDEDVQVEEAEKVLESSAPREVQKAEESKVPEDSLEECAITCSNSHSPCDSNQPHKNINITFEEDKVNSTLVVDRESSHDECQDAVNILPVPGPTSSATNVSMVVSAGPLSSEKAEMNILEINEKLHPQLAEKKQQFRNLKEKCFVTQLACFLANQQNKYKYEECKDLIKSMLRNERQFKEEKLAEQLKQAEELRQYKVLVHSQERELTQLREKLREGRDASRSLNQHLQALLTPDKPDKSQGQDLQEQLAEGCRLAQQLFQKLSPENDEDEDEDVQVEEAEKVLESSAPREVQKAEESKVPEDSLEECAITCSNSHGPCDSNQPHKNINITFEEDKVNSALVVDRESSHDECQDAVNILPVPGPTSSATNVSMVVSAGPLSSEKAEMNILEINEKLHPQLAEKKQQFRNLKEKCFVTQLACFLANQQNKYKNEECKDLIKSMLRNERQFKEEKLAEQLKQAEELRQYKVLVHSQERELTQLREKLREGRDASCSLNQHLQALLTPDEPDKSQGQDLQEQLAEGCRLAQHLVQKLSPENDNDDDEDVQVEVAEKVQKSSAPREMPKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYKSYSGTFHSLEEQQVCMAVDIGGHRWDQVKKEDQEATGPRLSRELLDEKGPEVLQDSLDRCYSTPSGYLELTDSCQPYRSAFYILEQQRVGWALDMDEIEKYQEVEEDQDPSCPRLSRELLEAVEPEVLQDSLDRCYSTPSSCLEQPDSCLPYGSSFYALEEKHVGFSLDVKRRRRGRKEGEEDQNPPCPRLSGMLMEVEEPEVLQDSLDRCYSTPSMYFELPDSFQHYRSVFYSFEEQHISFALDV

SEQ ID NO: 56251 - protein, 71 aa, Homo sapiens
  Payload ID: 11053
  Gene Symbol: NBPF1
  Gene Name: neuroblastoma breakpoint family, member 1
  ENSP ID: ENSP00000473795
MVVSAGPWSSEKAETNILEINEKLRPQLAENKQQFRNLKEKCFVTQLAGFLANRQKKYSNIKSWFTLRNES

SEQ ID NO: 56252 - protein, 1139 aa, Homo sapiens
  Payload ID: 11053
  Gene Symbol: NBPF1
  Gene Name: neuroblastoma breakpoint family, member 1
  ENSP ID: ENSP00000474456
MVVSAGPWSSEKAETNILEINEKLRPQLAENKQQFRNLKEKCFVTQLAGFLANRQKKYKYEECKDLIKFMLRNERQFKEEKLAEQLKQAEELRQYKVLVHSQERELTQLREKLREGRDASRSLNQHLQALLTPDKPDKSQGQDLQEQLAEGCRLAQQLFQKLSPENDEDEDEDVQVEEAEKVLESSAPREVQKAEESKVPEDSLEECAITCSNSHSPCDSNQPHKNINITFEEDKVNSTLVVDRESSHDECQDAVNILPVPGPTSSATNVSMVVSAGPLSSEKAEMNILEINEKLHPQLAEKKQQFRNLKEKCFVTQLACFLANQQNKYKYEECKDLIKSMLRNERQFKEEKLAEQLKQAEELRQYKVLVHSQERELTQLREKLREGRDASRSLNQHLQALLTPDKPDKSQGQDLQEQLAEGCRLAQQLFQKLSPENDEDEDEDVQVEEAEKVLESSAPREVQKAEESKVPEDSLEECAITCSNSHGPCDSNQPHKNINITFEEDKVNSALVVDRESSHDECQDAVNILPVPGPTSSATNVSMVVSAGPLSSEKAEMNILEINEKLHPQLAEKKQQFRNLKEKCFVTQLACFLANQQNKYKNEECKDLIKSMLRNERQFKEEKLAEQLKQAEELRQYKVLVHSQERELTQLREKLREGRDASCSLNQHLQALLTPDEPDKSQGQDLQEQLAEGCRLAQHLVQKLSPENDNDDDEDVQVEVAEKVQKSSAPREMPKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYKSYSGTFHSLEEQQVCMAVDIGGHRWDQVKKEDQEATGPRLSRELLDEKGPEVLQDSLDRCYSTPSGYLELTDSCQPYRSAFYILEQQRVGWALDMDEIEKYQEVEEDQDPSCPRLSRELLEAVEPEVLQDSLDRCYSTPSSCLEQPDSCLPYGSSFYALEEKHVGFSLDVGEIEKKGKGKKRRGRRSTKKRRRRGRKEGEEDQNPPCPRLSGMLMEVEEPEVLQDSLDRCYSTPSMYFELPDSFQHYRSVFYSFEEQHISFALDVDNRFLTLMGTSLHLVFQMGVIFPQ

SEQ ID NO: 56253 - protein, 3795 aa, Homo sapiens
  Payload ID: 11054
  Gene Symbol: NBPF10
  Gene Name: neuroblastoma breakpoint family, member 10
  ENSP ID: ENSP00000463957
MVVSAGPWSSEKAEMNILEINETLRPQLAEKKQQFRSLKEKCFLTQLAGFLANRQKKYKYEECKDLIKFMLRNERQFKEEKLAEQLKQAEELRQYKVLVHSQERELTQLREKLREGRDASRSLYEHLQALLTPDEPDKSQGQDLQEQLAEGCRLAQHLVQKLSPENDEDEDEDVQVEEAEKVLESSAPREVQKAEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLSGFLANQQKKYKYEECKDLIKFMLRNERQFKEEKLAEQLKQAEELRQYKVLVHAQERELTQLKEKLREGRDASRSLNEHLQALLTPYEPDKSQGQDLQEQLAEGCRLAQHLVQKLSPENDNDDDEDVQVEVAEKVQKSSAPREMQKAEEKEVPEDSLEECAITYSNSHGSYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSQDRCYSTPSGCLELTDSCQPYRSAFYILEQQRVGLAIDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGFAFDMDEIEKYQEVEEDQDPSCPRLSRELLDEKEPEVLQDSLDRCYSTPSGYLELPDLGQPYSSAVYSLEEQYLGLALDVDRIKKDEEEEEDQDPPCPRLSRELLEVVEPEVLQDSLDRCYSTPSSCLEQPDSCQPYGSSFYALEENHVGFSLDVGEIEKKGKGKKRRGRRSKKERRRGRKEGEEDQNPPCPRLSRELLEEKGPEVLQDSLDRCYSTPSGCLELTDSCQPYRSAFYVLEQQRVGFAVDMDEIEKYQEVEEDQDPSCPRLSRELLDEKEPEVLQDSLDRCYSTPSGYLELPDLGQPYSSAVYSLEEQYLGLALDVDRIKKDEEEEEDQDPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLEEKGPEVLQDSLDRCYSTPSGCLELTDSCQPYRSAFYVLEQQRVGFAVDMDEIEKYQEVEEDQDPSCPRLSRELLDEKEPEVLQDSLDRCYSTPSGYLELPDLGQPYSSAVYSLEEQYLGLALDVDRIKKDEEEEEDQDPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQDPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDEEEEEDQDPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGYLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELCDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDKIEKKGKGKKRRGRRSKKERRRGRKEGEEDQNPPCPRLNGVLMEVEEREVLQDSLDRCYSTPSMYFELPDSFQHYRSVFYSFEEQHISFALYVDNRFFTLTVTSLHLVFQMGVIFPQ

SEQ ID NO: 56254 - protein, 577 aa, Homo sapiens
  Payload ID: 11054
  Gene Symbol: NBPF10
  Gene Name: neuroblastoma breakpoint family, member 10
  ENSP ID: ENSP00000477670
MVVSAGPWSSEKAEMNILEINETLRPQLAEKKQQFRSLKEKCFLTQLAGFLANRQKKYKYEECKDLIKFMLRNERQFKEEKLAEQLKQAEELRQYKVLVHSQERELTQLREKLREGRDASRSLYEHLQALLTPDEPDKSQGQDLQEQLAEGCRLAQHLVQKLSPENDEDEDEDVQVEEAEKVLESSAPREMQKAEEKEVPEDSLEECAITYSNSHGSYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKYQEVEEDQDPSCPRLNGVLMEVEEREVLQDSLDRCYSTPSMYFELPDSFQHYRSVFYSFEEQHISFALYVDNRFFTLTVTSLHLVFQMGVIFPQ

SEQ ID NO: 56255 - protein, 921 aa, Homo sapiens
  Payload ID: 11054
  Gene Symbol: NBPF10
  Gene Name: neuroblastoma breakpoint family, member 10
  ENSP ID: ENSP00000478670
MLRNERQFKEEKLAEQLKQAEELRQYKVLVHAQERELTQLKEKLREGRDASRSLNEHLQALLTPYEPDKSQGQDLQEQLAEGCRLAQHLVQKLSPENDNDDDEDVQVEVAEKVQKSSAPREMQKAEEKEVPEDSLEECAITYSNSHGSYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQHVGLAVDMDEIEKYQEVEEDQDPSCPRLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNGVLMEVEEREVLQDSLDRCYSTPSMYFELPDSFQHYRSVFYSFEEQHISFALYVDNRFFTLTVTSLHLVFQMGVIFPQ

SEQ ID NO: 56256 - protein, 1239 aa, Homo sapiens
  Payload ID: 11054
  Gene Symbol: NBPF10
  Gene Name: neuroblastoma breakpoint family, member 10
  ENSP ID: ENSP00000479344
MDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDEEEEEDQDPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRVSFDSLTSMSPGQFTRSLSLCLCLCLCLSFSFIVFYLALFCPNIKAIISGAVWFLIPPGLFFTFSHFSRLSRELLDEKGPEVLQDSLDRCYSTPSGYLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELCDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDKIEKKGKGKKRRGRRSKKERRRGRKEGEEDQNPPCPRLNGVLMEVEEREVLQDSLDRCYSTPSMYFELPDSFQHYRSVFYSFEEQHISFALYVDNRFFTLTVTSLHLVFQMGVIFPQ

SEQ ID NO: 56257 - protein, 942 aa, Homo sapiens
  Payload ID: 11054
  Gene Symbol: NBPF10
  Gene Name: neuroblastoma breakpoint family, member 10
  ENSP ID: ENSP00000479934
MVVSAGPWSSEKAEMNILEINETLRPQLAEKKQQFRSLKEKCFLTQLAGFLANRQKKYKYEECKDLIKFMLRNERQFKEEKLAEQLKQAEELRQYKVLVHSQERELTQLREKLREGRDASRSLYEHLQALLTPDEPDKSQGQDLQEQLAEGCRLAQHLVQKLSPENDEDEDEDVQVEEAEKVLESSAPREVQKAEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLSGFLANQQKKYKYEECKDLIKFMLRNERQFKEEKLAEQLKQAEELRQYKVLVHAQERELTQLKEKLREGRDASRSLNEHLQALLTPYEPDKSQGQDLQEQLAEGCRLAQHLVQKLSPENDNDDDEDVQVEVAEKVQKSSAPREMQKAEEKEVPEDSLEECAITYSNSHGSYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNGVLMEVEEREVLQDSLDRCYSTPSMYFELPDSFQHYRSVFYSFEEQHISFALYVDNRFFTLTVTSLHLVFQMGVIFPQ

SEQ ID NO: 56258 - protein, 867 aa, Homo sapiens
  Payload ID: 11054
  Gene Symbol: NBPF10
  Gene Name: neuroblastoma breakpoint family, member 10
  ENSP ID: ENSP00000482792
MVVSAGPWSSEKAEMNILEINETLRPQLAEKKQQFRSLKEKCFLTQLAGFLANRQKKYKYEECKDLIKFMLRNERQFKEEKLAEQLKQAEELRQYKVLVHSQERELTQLREKLREGRDASRSLYEHLQALLTPDEPDKSQGQDLQEQLAEGCRLAQHLVQKLSPENDEDEDEDVQVEEAEKVLESSAPREVQKAEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLSGFLANQQKKYKYEECKDLIKFMLRNERQFKEEKLAEQLKQAEELRQYKVLVHAQERELTQLKEKLREGRDASRSLNEHLQALLTPYEPDKSQGQDLQEQLAEGCRLAQHLVQKLSPENDNDDDEDVQVEVAEKVQKSSAPREMQKAEEKEVPEDSLEECAITYSNSHGSYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNGVLMEVEEREVLQDSLDRCYSTPSMYFELPDSFQHYRSVFYSFEEQHISFALYVDNRFFTLTVTSLHLVFQMGVIFPQ

SEQ ID NO: 56259 - protein, 535 aa, Homo sapiens
  Payload ID: 11054
  Gene Symbol: NBPF10
  Gene Name: neuroblastoma breakpoint family, member 10
  ENSP ID: ENSP00000483057
MVVSAGPWSSEKAEMNILEINETLRPQLAEKKQQFRSLKEMFSNSTGRLPGQPTEEIQQYKVLVHSQERELTQLREKLREGRDASRSLYEHLQALLTPDEPDKSQGQDLQEQLAEGCRLAQHLVQKLSPENDEDEDEDVQVEEAEKVLESSAPREVQKAEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLSGFLANQQKKYKYEECKDLIKFMLRNERQFKEEKLAEQLKQAEELRQYKVLVHAQERELTQLKEKLREGRDASRSLNEHLQALLTPYEPDKSQGQDLQEQLAEGCRLAQHLVQKLSPENDNDDDEDVQVEVAEKVQKSSAPREMQKAEEKEVPEDSLEECAITYSNSHGSYDSNQPHRKTKITFEEDKVDSTLIGSSSHVEWEDAVHIIPENESDDEEEEEKGPVSPRTSVGSSEKGGPRGNRSQAQQGAAG

SEQ ID NO: 56260 - protein, 267 aa, Homo sapiens
  Payload ID: 11055
  Gene Symbol: NBPF11
  Gene Name: neuroblastoma breakpoint family, member 11
  ENSP ID: ENSP00000463391
MDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLCYSTPSSCLEQPDSCQPYGSSFYALEEKHVGFSLDVGEIEKKGKGKKRRGRRSKKKRRRGRKEGEEDQNPPCPRLSSVLMEVEVPEVLQDSLDRYYSTPSMYFELPDSFQHYRSVFYSFEEQHISFALDMDNRFFTLTVRSLHLVFQMGVIFPQ

SEQ ID NO: 56261 - protein, 865 aa, Homo sapiens
  Payload ID: 11055
  Gene Symbol: NBPF11
  Gene Name: neuroblastoma breakpoint family, member 11
  Uniprot ID: Q86T75
  ENSP ID: ENSP00000477509
MVVSAGPWSSEKAEMNILEINEKLRPQLAENKQQFRNLKERCFLTQLAGFLANRQKKYKYEECKDLIKFMLRNERQFKEEKLAEQLKQAEELRQYKVLVHSQERELTQLREKLREGRDASRSLNEHLQALLTPDEPDKSQGQDLQEQLAEGCRLAQHLVQKLSPENDEDEDEDVQVEEDEKVLESSAPREVQKAEESKVPEDSLEECAITCSNSHGPCDSIQPHKNIKITFEEDKVNSSLVVDRESSHDGCQDALNILPVPGPTSSATNVSMVVSAGPLSSEKAEMNILEINEKLCPQLAEKKQQFRSLKEKCFVTQVACFLAKQQNKYKYEECKDLIKSMLRNERQFKEEKLAEQLKQAEELRQYKVLVHSQERELTQLREKLREGRDASRSLNEHLQALLTPDEPDKSQGQDLQEQLAEGCRLAQHLVQKLSPENDNDDDEDVQVEVAEKVQKSSSPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPERLASYQSYSSTFHSLEEQQVCMAVDIGRHRWDQVKKEDQEATGPRLSRELLDEKEPEVLQDSLDRCYSTPSVYLGLTDSCQPYRSAFYVLEQQRIGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDVIQLLPVVLNSLTPASPTEVPFMHWRKNMLAFLLTWEKLKRRGRGRKEGEEDQRRKEEGEEKKGKKIKTHHAPGSAAC

SEQ ID NO: 56262 - protein, 770 aa, Homo sapiens
  Payload ID: 11055
  Gene Symbol: NBPF11
  Gene Name: neuroblastoma breakpoint family, member 11
  ENSP ID: ENSP00000477874
MFSNSTGRLPGQPTEEIQQYKVLVHSQERELTQLREKLREGRDASRSLNEHLQALLTPDEPDKSQGQDLQEQLAEGCRLAQHLVQKLSPENDEDEDEDVQVEEDEKVLESSAPREVQKAEESKVPEDSLEECAITCSNSHGPCDSIQPHKNIKITFEEDKVNSSLVVDRESSHDGCQDALNILPVPGPTSSATNVSMVVSAGPLSSEKAEMNILEINEKLCPQLAEKKQQFRSLKEKCFVTQVACFLAKQQNKYKYEECKDLIKSMLRNERQFKEEKLAEQLKQAEELRQYKVLVHSQERELTQLREKLREGRDASRSLNEHLQALLTPDEPDKSQGQDLQEQLAEGCRLAQHLVQKLSPENDNDDDEDVQVEVAEKVQKSSSPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPERLASYQSYSSTFHSLEEQQVCMAVDIGRHRWDQVKKEDQEATGPRLSRELLDEKEPEVLQDSLDRCYSTPSVYLGLTDSCQPYRSAFYVLEQQRIGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDVIQLLPVVLNSLTPASPTEVPFMHWRKNMLAFLLTWEKLKRRGRGRKEGEEDQRRKEE

SEQ ID NO: 56263 - protein, 541 aa, Homo sapiens
  Payload ID: 11055
  Gene Symbol: NBPF11
  Gene Name: neuroblastoma breakpoint family, member 11
  ENSP ID: ENSP00000478618
MFSNSTGRLPGQPTEEIQQYKVLVHSQERELTQLREKLREGRDASRSLNEHLQALLTPDEPDKSQGQDLQEQLAEGCRLAQHLVQKLSPENDEDEDEDVQVEEDEKVLESSAPREVQKAEESKVPEDSLEECAITCSNSHGPCDSIQPHKNIKITFEEDKVNSSLVVDRESSHDGCQDALNILPVPGPTSSATNVSMVVSAGPLSSEKAEMNILEINEKLCPQLAEKKQQFRSLKEKCFVTQVACFLAKQQNKYKYEECKDLIKSMLRNERQFKEEKLAEQLKQAEELRQYKVLVHSQERELTQLREKLREGRDASRSLNEHLQALLTPDEPDKSQGQDLQEQLAEGCRLAQHLVQKLSPENDNDDDEDVQVEVAEKVQKSSSPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPERLASYQSYSSTFHSLEEQQVCMAVDIGRLDRGMFLCARKNCLM

SEQ ID NO: 56264 - protein, 830 aa, Homo sapiens
  Payload ID: 11055
  Gene Symbol: NBPF11
  Gene Name: neuroblastoma breakpoint family, member 11
  ENSP ID: ENSP00000479429
MVVSAGPWSSEKAEMNILEINEKLRPQLAENKQQFRNLKEMFSNSTGRLPGQPTEEIQQYKVLVHSQERELTQLREKLREGRDASRSLNEHLQALLTPDEPDKSQGQDLQEQLAEGCRLAQHLVQKLSPENDEDEDEDVQVEEDEKVLESSAPREVQKAEESKVPEDSLEECAITCSNSHGPCDSIQPHKNIKITFEEDKVNSSLVVDRESSHDGCQDALNILPVPGPTSSATNVSMVVSAGPLSSEKAEMNILEINEKLCPQLAEKKQQFRSLKEKCFVTQVACFLAKQQNKYKYEECKDLIKSMLRNERQFKEEKLAEQLKQAEELRQYKVLVHSQERELTQLREKLREGRDASRSLNEHLQALLTPDEPDKSQGQDLQEQLAEGCRLAQHLVQKLSPENDNDDDEDVQVEVAEKVQKSSSPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPERLASYQSYSSTFHSLEEQQVCMAVDIGRHRWDQVKKEDQEATGPRLSRELLDEKEPEVLQDSLDRCYSTPSVYLGLTDSCQPYRSAFYVLEQQRIGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDVIQLLPVVLNSLTPASPTEVPFMHWRKNMLAFLLTWEKLKRRGRGRKEGEEDQRRKEEGEEKKGKKIKTHHAPGSAAC

SEQ ID NO: 56265 - protein, 865 aa, Homo sapiens; identical to SEQ ID NO: 56261
  Payload ID: 11055
  Gene Symbol: NBPF11
  Gene Name: neuroblastoma breakpoint family, member 11
  Uniprot ID: Q86T75
  ENSP ID: ENSP00000484213

SEQ ID NO: 56266 - protein, 577 aa, Homo sapiens [sequence omitted]

SEQ ID NO: 56267 - protein, 1111 aa, Homo sapiens
  Payload ID: 11056
  Gene Symbol: NBPF12
  Gene Name: neuroblastoma breakpoint family, member 12
  ENSP ID: ENSP00000464426
MVVSAGPWSSEKAEMNILEINEKLRPQLAENKQQFRNLKERCFLTQLAGFLANRQKKYKYEECKDLIKFMLRNERQFKEEKLAEQLKQAEELRQYKVLVHSQERELTQLREKLREGRDASRSLNEHLQALLTPDEPDKSQGQDLQEQLAEGCRLAQQLVQKLSPENDEDEDEDVQVEEDEKVLESSAPREVQKAEESKVPEDSLEECAITCSNSHGPCDSIQPHKNIKITFEEDKVNSTVVVDRKSSHDECQDALNILPVPGPTSSATNVSMVVSAGPLSSEKAEMNILEINEKLRPQLAEKKQQFRSLKEKCFVTQLAGFLAKQQNKYKYEECKDLIKSMLRNELQFKEEKLAEQLKQAEELRQYKVLVHSQERELTQLREKLREGRDASRSLNEHLQALLTPDEPDKSQGQDLQEQLAEGCRLAQHLVQKLSPENDNDDDEDVQVEVAEKVQKSSSPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPERLASYQSYSSTFHSLEEQQVCMAVDIGRHRWDQVKKEDQEATGPRLSRELLAEKEPEVLQDSLDRCYSTPSVYLGLTDSCQPYRSAFYVLEQQRVGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKKGKGKKRRGRRSKKKRRRGRKEGEEDQNPPCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKKGKGKKRRGRRSKKKRRRGRKEGEEDQNPPCPRLNSVLMEVEEPEVLQDSLDRCYSTPSMYFELPDSFQHYRSVFYSFEEQHITFALDMDNSFFTLTVTSLHLVFQMGVIFPQ

SEQ ID NO: 56268 - protein, 1457 aa, Homo sapiens
  Payload ID: 11056
  Gene Symbol: NBPF12
  Gene Name: neuroblastoma breakpoint family, member 12
  ENSP ID: ENSP00000478609
MVVSAGPWSSEKAEMNILEINEKLRPQLAENKQQFRNLKERCFLTQLAGFLANRQKKYKYEECKDLIKFMLRNERQFKEEKLAEQLKQAEELRQYKVLVHSQERELTQLREKLREGRDASRSLNEHLQALLTPDEPDKSQGQDLQEQLAEGCRLAQQLVQKLSPENDEDEDEDVQVEEDEKVLESSAPREVQKAEESKVPEDSLEECAITCSNSHGPCDSIQPHKNIKITFEEDKVNSTVVVDRKSSHDECQDALNILPVPGPTSSATNVSMVVSAGPLSSEKAEMNILEINEKLRPQLAEKKQQFRSLKEKCFVTQLAGFLAKQQNKYKYEECKDLIKSMLRNELQFKEEKLAEQLKQAEELRQYKVLVHSQERELTQLREKLREGRDASRSLNEHLQALLTPDEPDKSQGQDLQEQLAEGCRLAQHLVQKLSPENDEDEDEDVQVEEDEKVLESSSPREMQKAEESKVPEDSLEECAITCSNSHGPCDSNQPHKNIKITFEEDKVNSSLVVDRESSHDECQDALNILPVPGPTSSATNVSMVVSAGPLSSEKAEMNILEINEKLRPQLAEKKQQFRSLKEKCFVTQVACFLAKQQNKYKYEECKDLLKSMLRNELQFKEEKLAEQLKQAEELRQYKVLVHSQERELTQLREKLREGRDASRSLNEHLQALLTPDEPDKSQGQDLQEQLAEGCRLAQHLVQKLSPENDNDDDEDVQVEVAEKVQKSSSPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPERLASYQSYSSTFHSLEEQQVCMAVDIGRHRWDQVKKEDQEATGPRLSRELLAEKEPEVLQDSLDRCYSTPSVYLGLTDSCQPYRSAFYVLEQQRVGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKKGKGKKRRGRRSKKKRRRGRKEGEEDQNPPCPRLSRELLAEKEPEVLQDSLDRWYSTPSVYLGLTDPCQPYRSAFYVLEQQRVGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKKGKGKKRRGRRSKKKRRRGRKEGEEDQNPPCPRLNSVLMEVEEPEVLQDSLDRCYSTPSMYFELPDSFQHYRSVFYSFEEQHITFALDMDNSFFTLTVTSLHLVFQMGVIFPQ

SEQ ID NO: 56269 - protein, 865 aa, Homo sapiens [sequence omitted]

SEQ ID NO: 56270 - protein, 867 aa, Homo sapiens
  Payload ID: 11056
  Gene Symbol: NBPF12
  Gene Name: neuroblastoma breakpoint family, member 12
  ENSP ID: ENSP00000480046
MVVSAGPLSSEKAEMNILEINEKLRPQLAEKKQQFRSLKEKCFVTQLAGFLAKQQNKYKYEECKDLIKSMLRNELQFKEEKLAEQLKQAEELRQYKVLVHSQERELTQLREKLREGRDASRSLNEHLQALLTPDEPDKSQGQDLQEQLAEGCRLAQHLVQKLSPENDEDEDEDVQVEEDEKVLESSSPREMQKAEESKVPEDSLEECAITCSNSHGPCDSNQPHKNIKITFEEDKVNSSLVVDRESSHDECQDALNILPVPGPTSSATNVSMVVSAGPLSSEKAEMNILEINEKLRPQLAEKKQQFRSLKEKCFVTQVACFLAKQQNKYKYEECKDLLKSMLRNELQFKEEKLAEQLKQAEELRQYKVLVHSQERELTQLREKLREGRDASRSLNEHLQALLTPDEPDKSQGQDLQEQLAEGCRLAQHLVQKLSPENDNDDDEDVQVEVAEKVQKSSSPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPERLASYQSYSSTFHSLEEQQVCMAVDIGRHRWDQVKKEDQEATGPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKKGKGKKRRGRRSKKKRRRGRKEGEEDQNPPCPRLNSVLMEVEEPEVLQDSLDRCYSTPSMYFELPDSFQHYRSVFYSFEEQHITFALDMDNSFFTLTVTSLHLVFQMGVIFPQ

SEQ ID NO: 56271 - protein, 1213 aa, Homo sapiens
  Payload ID: 11056
  Gene Symbol: NBPF12
  Gene Name: neuroblastoma breakpoint family, member 12
  ENSP ID: ENSP00000481469
MVVSAGPWSSEKAEMNILEINEKLRPQLAENKQQFRNLKERCFLTQLAGFLANRQKKYKYEECKDLIKFMLRNERQFKEEKLAEQLKQAEELRQYKVLVHSQERELTQLREKLREGRDASRSLNEHLQALLTPDEPDKSQGQDLQEQLAEGCRLAQQLVQKLSPENDEDEDEDVQVEEDEKVLESSAPREVQKAEESKVPEDSLEECAITCSNSHGPCDSIQPHKNIKITFEEDKVNSTVVVDRKSSHDECQDALNILPVPGPTSSATNVSMVVSAGPLSSEKAEMNILEINEKLRPQLAEKKQQFRSLKEKCFVTQLAGFLAKQQNKYKYEECKDLIKSMLRNELQFKEEKLAEQLKQAEELRQYKVLVHSQERELTQLREKLREGRDASRSLNEHLQALLTPDEPDKSQGQDLQEQLAEGCRLAQHLVQKLSPENDEDEDEDVQVEEDEKVLESSSPREMQKAEESKVPEDSLEECAITCSNSHGPCDSNQPHKNIKITFEEDKVNSSLVVDRESSHDECQDALNILPVPGPTSSATNVSMVVSAGPLSSEKAEMNILEINEKLRPQLAEKKQQFRSLKEKCFVTQVACFLAKQQNKYKYEECKDLLKSMLRNELQFKEEKLAEQLKQAEELRQYKVLVHSQERELTQLREKLREGRDASRSLNEHLQALLTPDEPDKSQGQDLQEQLAEGCRLAQHLVQKLSPENDNDDDEDVQVEVAEKVQKSSSPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPERLASYQSYSSTFHSLEEQQVCMAVDIGRHRWDQVKKEDQEATGPRLSRELLAEKEPEVLQDSLDRCYSTPSVYLGLTDSCQPYRSAFYVLEQQRVGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKKGKGKKRRGRRSKKKRRRGRKEGEEDQNPPCPRLNSVLMEVEEPEVLQDSLDRCYSTPSMYFELPDSFQHYRSVFYSFEEQHITFALDMDNSFFTLTVTSLHLVFQMGVIFPQ

SEQ ID NO: 56272 - protein, 299 aa, Homo sapiens [sequence omitted]

SEQ ID NO: 56273 - protein, 1457 aa, Homo sapiens; identical to SEQ ID NO: 56268
  Payload ID: 11056
  Gene Symbol: NBPF12
  Gene Name: neuroblastoma breakpoint family, member 12
  ENSP ID: ENSP00000484391

SEQ ID NO: 56274 - protein, 942 aa, Homo sapiens
  Payload ID: 11057
  Gene Symbol: NBPF14
  Gene Name: neuroblastoma breakpoint family, member 14
  ENSP ID: ENSP00000463341
MVVSAGPWSSEKAEMNILEINETLRPQLAEKKQQFRNLKEKCFLTQLAGFLANQQKKYKYEECKDLIKFMLRNERQFKEEKLAEQLKQAEELRQYKVLVHSQERELTQLREKLREGRDASRSLYEHLQALLTPYEPDKSQGQDLQEQLAEGCRLAQHLVQKLSPENDEDEDEDVQVEEAEKVLESSAPREVQKAEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLSGFLANQQKKYKYEECKDLIKFMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITYSNSHGSYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNGVLMEVEEREVLQDSLDRCYSTPSMYFELPDSFQHYRSVFYSFEEQHISFALYVDNRFFTLTVTSLHLVFQMGVIFPQ

SEQ ID NO: 56275 - protein, 249 aa, Homo sapiens
  Payload ID: 11057
  Gene Symbol: NBPF14
  Gene Name: neuroblastoma breakpoint family, member 14
  ENSP ID: ENSP00000472124
MCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGICLNLPGSYQCQCLQGFTGQYCDSLYVPCAPSPCVNGGTCRQTGDFTFECNCLPETVRRGTELWERDREVWNGKEHDEN

SEQ ID NO: 56276 - protein, 77 aa, Homo sapiens
  Payload ID: 11057
  Gene Symbol: NBPF14
  Gene Name: neuroblastoma breakpoint family, member 14
  ENSP ID: ENSP00000475918
MVVSAGPWSSEKAEMNILEINETLRPQLAEKKQQFRNLKEKCFLTQLAGFLANQQKKYKYEECKDLIKFMLRNERQF

SEQ ID NO: 56277 - protein, 299 aa, Homo sapiens
  Payload ID: 11057
  Gene Symbol: NBPF14
  Gene Name: neuroblastoma breakpoint family, member 14
  ENSP ID: ENSP00000478050
MVVSAGPLSSEKAEMNILEINEKLRPQLAEKKQQFRNLKEKCFLTQLSGFLANQQKKYKYEECKDLIKFMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITYSNSHGSYDSNQPHRKTKITFEEDKVDSTLIGSSSHVEWEDAVHIIPENESDDEEEEEKGPVSPRTSVGSSEKGGPRGNRSQAQQGAAG

SEQ ID NO: 56278 - protein, 921 aa, Homo sapiens
  Payload ID: 11057
  Gene Symbol: NBPF14
  Gene Name: neuroblastoma breakpoint family, member 14
  ENSP ID: ENSP00000478178
MLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITYSNSHGSYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDEEEEEDQDPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNGVLMEVEEREVLQDSLDRCYSTPSMYFELPDSFQHYRSVFYSFEEQHISFALYVDNRFFTLTVTSLHLVFQMGVIFPQ

SEQ ID NO: 56279 - protein, 535 aa, Homo sapiens
  Payload ID: 11057
  Gene Symbol: NBPF14
  Gene Name: neuroblastoma breakpoint family, member 14
  ENSP ID: ENSP00000478849
MVVSAGPWSSEKAEMNILEINETLRPQLAEKKQQFRNLKEMFSNSTGRLPGQPTEEIQQYKVLVHSQERELTQLREKLREGRDASRSLYEHLQALLTPYEPDKSQGQDLQEQLAEGCRLAQHLVQKLSPENDEDEDEDVQVEEAEKVLESSAPREVQKAEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLSGFLANQQKKYKYEECKDLIKFMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITYSNSHGSYDSNQPHRKTKITFEEDKVDSTLIGSSSHVEWEDAVHIIPENESDDEEEEEKGPVSPRTSVGSSEKGGPRGNRSQAQQGAAG

SEQ ID NO: 56280 - protein, 299 aa, Homo sapiens
  Payload ID: 11057
  Gene Symbol: NBPF14
  Gene Name: neuroblastoma breakpoint family, member 14
  ENSP ID: ENSP00000479092
MVVSAGPWSSEKAEMNILEINETLRPQLAEKKQQFRNLKEKCFLTQLAGFLANQQKKYKYEECKDLIKFMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITYSNSHGSYDSNQPHRKTKITFEEDKVDSTLIGSSSHVEWEDAVHIIPENESDDEEEEEKGPVSPRTSVGSSEKGGPRGNRSQAQQGAAG

SEQ ID NO: 56281 - protein, 577 aa, Homo sapiens
  Payload ID: 11057
  Gene Symbol: NBPF14
  Gene Name: neuroblastoma breakpoint family, member 14
  ENSP ID: ENSP00000479380
MVVSAGPWSSEKAEMNILEINETLRPQLAEKKQQFRNLKEKCFLTQLAGFLANQQKKYKYEECKDLIKFMLRNERQFKEEKLAEQLKQAEELRQYKVLVHSQERELTQLREKLREGRDASRSLYEHLQALLTPYEPDKSQGQDLQEQLAEGCRLAQHLVQKLSPENDEDEDEDVQVEEAEKVLESSAPREMQKAEEKEVPEDSLEECAITYSNSHGSYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKYQEVEEDQDPSCPRLNGVLMEVEEREVLQDSLDRCYSTPSMYFELPDSFQHYRSVFYSFEEQHISFALYVDNRFFTLTVTSLHLVFQMGVIFPQ

SEQ ID NO: 56282 - protein, 2988 aa, Homo sapiens
  Payload ID: 11057
  Gene Symbol: NBPF14
  Gene Name: neuroblastoma breakpoint family, member 14
  ENSP ID: ENSP00000479693
MVVSAGPWSSEKAEMNILEINETLRPQLAEKKQQFRNLKEKCFLTQLAGFLANQQKKYKYEECKDLIKFMLRNERQFKEEKLAEQLKQAEELRQYKVLVHSQERELTQLREKLREGRDASRSLYEHLQALLTPYEPDKSQGQDLQEQLAEGCRLAQHLVQKLSPENDEDEDEDVQVEEAEKVLESSAPREVQKAEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLSGFLANQQKKYKYEECKDLIKFMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITYSNSHGSYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDEEEEEDQDPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKEPEVLQDSLDRCYSTPSGYLELPDLGQPYSSAVYSLEEQYLGLALDVDRIKKDEEEEEDQDPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDEEEEEDQDPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDEEEEEDQDPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLHEKGPEVLQDSLDRCYSTPSGCLELTDSCQPYRSAFYILEQQRVGLAVDMDEIEKYKEVEEDQDPSCPRLSRELLDEKEPEVLQDSLDRCYSTPSGYLELPDLGQPYSSAVYSLEEQYLGLALDVDRFKKDEEEEEDQDPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYKEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYKEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYKEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYKEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKDPEVLQDSLDRCYSTPSGYLELPDLGQPYSSAVYSLEEQYLGLALDVDKIEKKGKGKKRRGRRSKKERRRGRKEGEEDQNPPCPRLNGVLMEVEEREVLQDSLDRCYSTPSMYFELPDSFQHYRSVFYSFEEQHISFALYVDNRFFTLTVTSLHLVFQMGVIFPQ

SEQ ID NO: 56283 - protein, 867 aa, Homo sapiens
  Payload ID: 11057
  Gene Symbol: NBPF14
  Gene Name: neuroblastoma breakpoint family, member 14
  ENSP ID: ENSP00000481840
MVVSAGPWSSEKAEMNILEINETLRPQLAEKKQQFRNLKEKCFLTQLAGFLANQQKKYKYEECKDLIKFMLRNERQFKEEKLAEQLKQAEELRQYKVLVHSQERELTQLREKLREGRDASRSLYEHLQALLTPYEPDKSQGQDLQEQLAEGCRLAQHLVQKLSPENDEDEDEDVQVEEAEKVLESSAPREVQKAEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLSGFLANQQKKYKYEECKDLIKFMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITYSNSHGSYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNGVLMEVEEREVLQDSLDRCYSTPSMYFELPDSFQHYRSVFYSFEEQHISFALYVDNRFFTLTVTSLHLVFQMGVIFPQ

SEQ ID NO: 56284 - protein, 2819 aa, Homo sapiens
  Payload ID: 11057
  Gene Symbol: NBPF14
  Gene Name: neuroblastoma breakpoint family, member 14
  ENSP ID: ENSP00000482693
MVVSAGPWSSEKAEMNILEINETLRPQLAEKKQQFRNLKEKCFLTQLAGFLANQQKKYKYEECKDLIKFMLRNERQFKEEKLAEQLKQAEELRQYKVLVHSQERELTQLREKLREGRDASRSLYEHLQALLTPYEPDKSQGQDLQEQLAEGCRLAQHLVQKLSPENDEDEDEDVQVEEAEKVLESSAPREVQKAEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLSGFLANQQKKYKYEECKDLIKFMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITYSNSHGSYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDEEEEEDQDPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDEEEEEDQDPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDEEEEEDQDPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLHEKGPEVLQDSLDRCYSTPSGCLELTDSCQPYRSAFYILEQQRVGLAVDMDEIEKYKEVEEDQDPSCPRLSRELLDEKEPEVLQDSLDRCYSTPSGYLELPDLGQPYSSAVYSLEEQYLGLALDVDRFKKDEEEEEDQDPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYKEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYKEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYKEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYKEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKDPEVLQDSLDRCYSTPSGYLELPDLGQPYSSAVYSLEEQYLGLALDVDKIEKKGKGKKRRGRRSKKERRRGRKEGEEDQNPPCPRLNGVLMEVEEREVLQDSLDRCYSTPSMYFELPDSFQHYRSVFYSFEEQHISFALYVDNRFFTLTVTSLHLVFQMGVIFPQ

SEQ ID NO: 56285 - protein, 670 aa, Homo sapiens
  Payload ID: 11058
  Gene Symbol: NBPF15
  Gene Name: neuroblastoma breakpoint family, member 15
  Uniprot ID: Q8N660
  ENSP ID: ENSP00000462600
MVVSAGPLSSEKAEMNILEINEKLRPQLAEKKQQFRNLKEKCFLTQLAGFLANRQKKYKYEECKDLIKFMLRNERQFKEEKLAEQLKQAEELRQYKVLVHAQERELTQLREKLREGRDASRSLNEHLQALLTPDEPDKSQGQDLQEQLAEGCRLTQHLVQKLSPENDNDDDEDVQVEVAEKVQKSSAPREMQKAEEKEVPEDSLEECAITCSNSHGPYDSNQPHKKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKEPEVLQDSLDRCYSTPSGCLELTDSCQPYRSAFYVLEQQRVGLAIDMDEIEKYQEVEEDQDPSCPRLSRELLDEKEPEVLQDSLDRCYSTPSDYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKKRRRGRKEGEDDNPPCPRLYGVLMEVEEPEVLQDSLDRCYSTPSMYFEQPDSFQHYRSVFYSFEEEHISFALYVDNRFFTLTVTSLHLVFQMGVIFPQ

SEQ ID NO: 56286 - protein, 670 aa, Homo sapiens; identical to SEQ ID NO: 56285
  Payload ID: 11058
  Gene Symbol: NBPF15
  Gene Name: neuroblastoma breakpoint family, member 15
  Uniprot ID: Q8N660
  ENSP ID: ENSP00000463178

SEQ ID NO: 56287 - protein, 670 aa, Homo sapiens; identical to SEQ ID NO: 56285
  Payload ID: 11058
  Gene Symbol: NBPF15
  Gene Name: neuroblastoma breakpoint family, member 15
  Uniprot ID: Q8N660
  ENSP ID: ENSP00000481835

SEQ ID NO: 56288 - protein, 921 aa, Homo sapiens
  Payload ID: 11059
  Gene Symbol: NBPF19
  Gene Name: neuroblastoma breakpoint family, member 19
  ENSP ID: ENSP00000358229
MLRNERQFKEEKLAEQLKQAEELRQYKVLFHSQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITYSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAIDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQCVGLAVDMDEIEKYQEVEEDQDPSCPRLSRELLDEKGPEVLQDSLDRCYSTPSGCLELTDSCQPYRSAFYILEQQCVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNSVLMEVEEPEVLQDSLDGCYSTPSMYFELPDSFQHYRSVFYSFEEEHISFALYLDNRFFTLTVTSLHLVFQMLVIFPQ

SEQ ID NO: 56289 - protein, 236 aa, Homo sapiens
  Payload ID: 11059
  Gene Symbol: NBPF19
  Gene Name: neuroblastoma breakpoint family, member 19
  ENSP ID: ENSP00000462298
MCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCLQGFTGQYCDSLYVPCAPSPCVNGGTCRQTGDFTFECNCLPETVRRGTELWERDREVWNGKEHDEN

SEQ ID NO: 56290 - protein, 3843 aa, Homo sapiens
  Payload ID: 11059
  Gene Symbol: NBPF19
  Gene Name: neuroblastoma breakpoint family, member 19
  ENSP ID: ENSP00000478752
MVVSAGPWSSEKAEMNILEINETLRPQLAEKKQQFRNLKEKCFLTQLAGFLANRQKKYKYEECKDLIKFMLRNERQFKEEKLAEQLKQAEELRQYKVLFHSQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITYSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAIDMDEIEKYQEVEEDQDPSCPRLSRELLDEKEPEVLQDSLDRCYSIPSGYLELPDLGQPYSSAVYSLEEQYLGLALDVDRIKKDQEEEEDQDPPCPRLSRELVEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQCVGLAVDMDEIEKYQEVEEDQDPSCPRLSRELLDEKEPEVLQDSLDRCYSIPSGYLELPDLGQPYSSAVYSLEEQYLGLALDVDRIKKDQEEEEDQDPPCPRLSRELVEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQCVGLAIDMDEIEKYQEVEEDQDPSCPRLSRELLDEKEPEVLQDSLDRCYSIPSGYLELPDLGQPYSSAVYSLEEQYLGLALDVDRIKKDQEEEEDQDPPCPRLSRELVEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQCVGLAVDMDEIEKYQEVEEDQDPSCPRLSRELLDEKEPEVLQDSLDRCYSIPSGYLELPDLGQPYSSAVYSLEEQYLGLALDVDRIKKDQEEEEDQDPPCPRLSRELVEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQCVGLAVDMDEIEKYQEVEEDQDPSCPRLSRELLDEKEPEVLQDSLDRCYSIPSGYLELPDLGQPYSSAVYSLEEQYLGLALDVDRIKKDQEEEEDQDPPCPRLSRELVEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQCVGLAVDMDEIEKYQEVEEDQDPSCPRLSRELLDEKEPEVLQDSLDRCYSIPSGYLELPDLGQPYSSAVYSLEEQYLGLALDVDRIKKDQEEEEDQDPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQCVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQCVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQCVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQCVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQCVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQCVGLAVDMDEIEKYQEVEEDQDPSCPRLSRELLAEKEPEVLQDPLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQCVGLAVDMDEIEKYQEVEEDQDPSCPRLSRELLAEKEPEVLQDPLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQCVGLAVDMDEIEKYQEVEEDQDPSCPRLSRELLAEKEPEVLQDPLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNSVLMEVEEPEVLQDSLDGCYSTPSMYFELPDSFQHYRSVFYSFEEEHISFALYLDNRFFTLTVTSLHLVFQMLVIFPQ

SEQ ID NO: 56291 - protein, 299 aa, Homo sapiens
  Payload ID: 11059
  Gene Symbol: NBPF19
  Gene Name: neuroblastoma breakpoint family, member 19
  ENSP ID: ENSP00000480326
MVVSAGPWSSEKAEMNILEINETLRPQLAEKKQQFRNLKEKCFLTQLAGFLANRQKKYKYEECKDLIKFMLRNERQFKEEKLAEQLKQAEELRQYKVLFHSQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITYSNSHGPYDSNQPHRKTKITFEEDKVDSTLIGSSSHVEWEDAVHIIPENESDDEEEEEKGPVSPRTSLGSSEKGGPRGNRSQAQQGAAG

SEQ ID NO: 56292 - protein, 299 aa, Homo sapiens; identical to SEQ ID NO: 56291
  Payload ID: 11059
  Gene Symbol: NBPF19
  Gene Name: neuroblastoma breakpoint family, member 19
  ENSP ID: ENSP00000484655

SEQ ID NO: 56293 - protein, 235 aa, Homo sapiens
  Payload ID: 11059
  Gene Symbol: NBPF19
  Gene Name: neuroblastoma breakpoint family, member 19
  ENSP ID: ENSP00000484787
DQEEEEDQDPPCPRELVEVVEPEVLQDSLDRCYSTPSSCLEQPDSCQPYGSSFYALEEKHVGFSLDVGGERGRKEGEEDQNPPCPRLSRELLDEKGPEVLQDSLDRCYSTPSGCLELTDSCQPYRSAFYILEQQCVGLAVDMDEIEKYQEVEEDQDPSCPRLSRELLDEKEPEVLQDSLDRCYSIPSGYLELPDLGQPYSSAVYSLEEQYLGLALDVDRIKKDQEEEEDQDPPCP

SEQ ID NO: 56294 - protein, 5646 aa, Homo sapiens
  Payload ID: 11060
  Gene Symbol: NBPF20
  Gene Name: neuroblastoma breakpoint family, member 20
  ENSP ID: ENSP00000358380
MVVSAGPWSSEKAEMNILEINEKLRPQLAENKQQFGNLKERCFVTQLAGFLANQQKKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVELAEKVQKSSAPREMQKAEEKEVPEDSQEECAITYSNSHGPYDSNQPHRKTKITFEEDKVDSTLIGSSSHVEWEDAVHIIPGKNESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRIGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQTPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQTPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKKRRRGRKEGEEDQNPPCPRLNGVLMEVEEPEVLQDSLDGCYSTPSMYFELPDSFQHYRSVFYSFEEQHISFALYVDNRFFTLTVTSLHLVFQMGVIFPQ

SEQ ID NO: 56295 - protein, 921 aa, Homo sapiens
  Payload ID: 11060
  Gene Symbol: NBPF20
  Gene Name: neuroblastoma breakpoint family, member 20
  ENSP ID: ENSP00000471335
MLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVELAEKVQKSSAPREMQKAEEKEVPEDSQEECAITYSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNGVLMEVEEPEVLQDSLDGCYSTPSMYFELPDSFQHYRSVFYSFEEQHISFALYVDNRFFTLTVTSLHLVFQMGVIFPQ

SEQ ID NO: 56296 - protein, 299 aa, Homo sapiens
  Payload ID: 11060
  Gene Symbol: NBPF20
  Gene Name: neuroblastoma breakpoint family, member 20
  ENSP ID: ENSP00000478481
MVVSAGPWSSEKAEMNILEINEKLRPQLAENKQQFGNLKERCFVTQLAGFLANQQKKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVELAEKVQKSSAPREMQKAEEKEVPEDSQEECAITYSNSHGPYDSNQPHRKTKITFEEDKVDSTLIGSSSHVEWEDAVHIIPENESDDEEEEEKGPVSPRTSVGSSEKGGPRGNRSQAQQGAAG

SEQ ID NO: 56297 - protein, 5207 aa, Homo sapiens
  Payload ID: 11060
  Gene Symbol: NBPF20
  Gene Name: neuroblastoma breakpoint family, member 20
  ENSP ID: ENSP00000479291
MFRLSRELLDEKGPEVLQDSLDRCYSTPSGCLELTDSCQPYRSAFYVLEQQRIGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQTPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQTPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKKRRRGRKEGEEDQNPPCPRLNGVLMEVEEPEVLQDSLDGCYSTPSMYFELPDSFQHYRSVFYSFEEQHISFALYVDNRFFTLTVTSLHLVFQMGVIFPQ

SEQ ID NO: 56298 - protein, 921 aa, Homo sapiens; identical to SEQ ID NO: 56295
  Payload ID: 11060
  Gene Symbol: NBPF20
  Gene Name: neuroblastoma breakpoint family, member 20
  ENSP ID: ENSP00000481516

SEQ ID NO: 56299 - protein, 921 aa, Homo sapiens
  Payload ID: 11061
  Gene Symbol: NBPF26
  Gene Name: neuroblastoma breakpoint family, member 26
  ENSP ID: ENSP00000476257
MLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDCNQPHRKTKITFEEDKVDSTLIGSSSHVEWEDAVHIIPENESDDEEEEEKGPVSPRNLQESEEEEVPQESWDEGYSTLSIPPEMLASYKSYSSTFHSLEEQQVCMAVDIGRHRWDQVKKEDHEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQRVGLAVDMDEIEKYQEVEEDQDPSCPRLSRELLEVVEPEVLQDSLDRCYSTPSSCLEQPDSCQPYGSSFYALEEKHVGFSLDVGEIEKYQEVEEDQDPSCPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNSMLMEVEEPEVLQDSLDICYSTPSMYFELPDSFQHYRSVFYSFEEEHISFALYVDNRFFTLTVTSLHLVFQMGVIFPQ

SEQ ID NO: 56300 - protein, 535 aa, Homo sapiens
  Payload ID: 11061
  Gene Symbol: NBPF26
  Gene Name: neuroblastoma breakpoint family, member 26
  ENSP ID: ENSP00000477847
MVVSAGHWSSEKAEMNILEINETLRPQLPENKQQLRNLKEMFSNSTGRLPGQPTEEIQQYKVLVHSQERELTQLKEKLREGRDASRSLNEHLQALLTPDEPDKSQGQDLQEQLAEGCRLAQHLVQKLSPENDEDEDEDVQVEEDEKVLESSAPREVQKTEESKVPEDSLEECAITCSNSHGPCDSNQPHKNIKITFEEDEVNSTLVVDRESSHDECQDALNILPVPGPTSSATNVSMVVSAGPLSGEKAAINILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDCNQPHRKTKITFEEDKVDSTLIGSSSHVEWEDAVHIIPENESDDEEEEEKGPVSPRTSVGSSEKGGPRGNRSQAQQGAAG

SEQ ID NO: 56301 - protein, 577 aa, Homo sapiens
  Payload ID: 11061
  Gene Symbol: NBPF26
  Gene Name: neuroblastoma breakpoint family, member 26
  ENSP ID: ENSP00000478334
MVVSAGHWSSEKAEMNILEINETLRPQLPENKQQLRNLKEKCFLTQLAGFLANRQKKYKYEECKDLIKFMLRNERQFKEEKLAEQLKQAEELRQYKVLVHSQERELTQLKEKLREGRDASRSLNEHLQALLTPDEPDKSQGQDLQEQLAEGCRLAQHLVQKLSPENDEDEDEDVQVEEDEKVLESSAPREMQKAEEKEVPEDSLEECAITCSNSHGPYDCNQPHRKTKITFEEDKVDSTLIGSSSHVEWEDAVHIIPENESDDEEEEEKGPVSPRNLQESEEEEVPQESWDEGYSTLSIPPEMLASYKSYSSTFHSLEEQQVCMAVDIGRHRWDQVKKEDHEATGPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKYQEVEEDQDPSCPRLNSMLMEVEEPEVLQDSLDICYSTPSMYFELPDSFQHYRSVFYSFEEEHISFALYVDNRFFTLTVTSLHLVFQMGVIFPQ

SEQ ID NO: 56302 - protein, 299 aa, Homo sapiens
  Payload ID: 11061
  Gene Symbol: NBPF26
  Gene Name: neuroblastoma breakpoint family, member 26
  ENSP ID: ENSP00000479721
MVVSAGPLSGEKAAINILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDCNQPHRKTKITFEEDKVDSTLIGSSSHVEWEDAVHIIPENESDDEEEEEKGPVSPRTSVGSSEKGGPRGNRSQAQQGAAG

SEQ ID NO: 56303 - protein, 942 aa, Homo sapiens
  Payload ID: 11061
  Gene Symbol: NBPF26
  Gene Name: neuroblastoma breakpoint family, member 26
  ENSP ID: ENSP00000480416
MVVSAGHWSSEKAEMNILEINETLRPQLPENKQQLRNLKEKCFLTQLAGFLANRQKKYKYEECKDLIKFMLRNERQFKEEKLAEQLKQAEELRQYKVLVHSQERELTQLKEKLREGRDASRSLNEHLQALLTPDEPDKSQGQDLQEQLAEGCRLAQHLVQKLSPENDEDEDEDVQVEEDEKVLESSAPREVQKTEESKVPEDSLEECAITCSNSHGPCDSNQPHKNIKITFEEDEVNSTLVVDRESSHDECQDALNILPVPGPTSSATNVSMVVSAGPLSGEKAAINILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDCNQPHRKTKITFEEDKVDSTLIGSSSHVEWEDAVHIIPENESDDEEEEEKGPVSPRNLQESEEEEVPQESWDEGYSTLSIPPEMLASYKSYSSTFHSLEEQQVCMAVDIGRHRWDQVKKEDHEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNSMLMEVEEPEVLQDSLDICYSTPSMYFELPDSFQHYRSVFYSFEEEHISFALYVDNRFFTLTVTSLHLVFQMGVIFPQ

SEQ ID NO: 56304 - protein, 1186 aa, Homo sapiens
  Payload ID: 11061
  Gene Symbol: NBPF26
  Gene Name: neuroblastoma breakpoint family, member 26
  ENSP ID: ENSP00000481542
MVVSAGHWSSEKAEMNILEINETLRPQLPENKQQLRNLKEKCFLTQLAGFLANRQKKYKYEECKDLIKFMLRNERQFKEEKLAEQLKQAEELRQYKVLVHSQERELTQLKEKLREGRDASRSLNEHLQALLTPDEPDKSQGQDLQEQLAEGCRLAQHLVQKLSPENDEDEDEDVQVEEDEKVLESSAPREVQKTEESKVPEDSLEECAITCSNSHGPCDSNQPHKNIKITFEEDEVNSTLVVDRESSHDECQDALNILPVPGPTSSATNVSMVVSAGPLSGEKAAINILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDCNQPHRKTKITFEEDKVDSTLIGSSSHVEWEDAVHIIPENESDDEEEEEKGPVSPRNLQESEEEEVPQESWDEGYSTLSIPPEMLASYKSYSSTFHSLEEQQVCMAVDIGRHRWDQVKKEDHEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQRVGLAVDMDEIEKYQEVEEDQDPSCPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNSMLMEVEEPEVLQDSLDICYSTPSMYFELPDSFQHYRSVFYSFEEEHISFALYVDNRFFTLTVTSLHLVFQMGVIFPQ

SEQ ID NO: 56305 - protein, 602 aa, Homo sapiens
  Payload ID: 11061
  Gene Symbol: NBPF26
  Gene Name: neuroblastoma breakpoint family, member 26
  ENSP ID: ENSP00000482516
MLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDCNQPHRKTKITFEEDKVDSTLIGSSSHVEWEDAVHIIPENESDDEEEEEKGPVSPRNLQESEEEEVPQESWDEGYSTLSIPPEMLASYKSYSSTFHSLEEQQVCMAVDIGRHRWDQVKKEDHEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNSMLMEVEEPEVLQDSLDICYSTPSMYFELPDSFQHYRSVFYSFEEEHISFALYVDNRFFTLTVTSLHLVFQMGVIFPQ

SEQ ID NO: 56306 - protein, 867 aa, Homo sapiens
  Payload ID: 11061
  Gene Symbol: NBPF26
  Gene Name: neuroblastoma breakpoint family, member 26
  ENSP ID: ENSP00000482859
MVVSAGHWSSEKAEMNILEINETLRPQLPENKQQLRNLKEKCFLTQLAGFLANRQKKYKYEECKDLIKFMLRNERQFKEEKLAEQLKQAEELRQYKVLVHSQERELTQLKEKLREGRDASRSLNEHLQALLTPDEPDKSQGQDLQEQLAEGCRLAQHLVQKLSPENDEDEDEDVQVEEDEKVLESSAPREVQKTEESKVPEDSLEECAITCSNSHGPCDSNQPHKNIKITFEEDEVNSTLVVDRESSHDECQDALNILPVPGPTSSATNVSMVVSAGPLSGEKAAINILEINEKLRPQLAEKKQQFRNLKEKCFLTQLAGFLANQQNKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDCNQPHRKTKITFEEDKVDSTLIGSSSHVEWEDAVHIIPENESDDEEEEEKGPVSPRNLQESEEEEVPQESWDEGYSTLSIPPEMLASYKSYSSTFHSLEEQQVCMAVDIGRHRWDQVKKEDHEATGPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNSMLMEVEEPEVLQDSLDICYSTPSMYFELPDSFQHYRSVFYSFEEEHISFALYVDNRFFTLTVTSLHLVFQMGVIFPQ

SEQ ID NO: 56307 - protein, 53 aa, Homo sapiens
  Payload ID: 11062
  Gene Symbol: NBPF3
  Gene Name: neuroblastoma breakpoint family, member 3
  ENSP ID: ENSP00000316739
MPLTPTVQGFQWTLRGPDVETSPFGAPRAASHGVGRHQELRDPTGSLGRSPNH

SEQ ID NO: 56308 - protein, 633 aa, Homo sapiens
  Payload ID: 11062
  Gene Symbol: NBPF3
  Gene Name: neuroblastoma breakpoint family, member 3
  Uniprot ID: Q9H094
  ENSP ID: ENSP00000316782
MPLTPTVQGFQWTLRGPDVETSPFGAPRAASHGVGRHQELRDPTVPGPTSSATNVSMVVSAGPWSGEKAEMNILEINKKSRPQLAENKQQFRNLKQKCLVTQVAYFLANRQNNYDYEDCKDLIKSMLRDERLLTEEKLAEELGQAEELRQYKVLVHSQERELTQLREKLQEGRDASRSLNQHLQALLTPDEPDNSQGRDLREQLAEGCRLAQHLVQKLSPENDDDEDEDVKVEEAEKVQELYAPREVQKAEEKEVPEDSLEECAITCSNSHHPCESNQPYGNTRITFEEDQVDSTLIDSSSHDEWLDAVCIIPENESDHEQEEEKGPVSPRNLQESEEEEAPQESWDEGDWTLSIPPDMSASYQSDRSTFHSVEEQQVGLALDIGRHWCDQVKKEDQEATSPRLSRELLDEKEPEVLQDSLDRFYSTPFEYLELPDLCQPYRSDFYSLQEQHLGLALDLDRMKKDQEEEEDQGPPCPRLSRELPEVVEPEDLQDSLDRWYSTPFSYPELPDSCQPYGSCFYSLEEEHVGFSLDVDEIEKYQEGEEDQKPPCPRLNEVLMEAEEPEVLQDSLDRCYSTTSTYFQLHASFQQYRSAFYSFEEQDVSLALDVDNRFFTLTVIRHHLAFQMGVIFPH

SEQ ID NO: 56309 - protein, 621 aa, Homo sapiens
  Payload ID: 11062
  Gene Symbol: NBPF3
  Gene Name: neuroblastoma breakpoint family, member 3
  Uniprot ID: Q9H094
  ENSP ID: ENSP00000340336
MPLTPTVQGFQWTLRGPDVETSPFGAPRAASHGVGRHQELRDPTVPGPTSSATNVSMVVSAGPWSGEKAEMNILEINKKSRPQLAENKQQFRNLKQKCLVTQVAYFLANRQNNYDYEDCKDLIKSMLRDERLLTEEKLAEELGQAEELRQYKVLVHSQERELTQLREKLQEGRDASRSLNQHLQALLTPDEPDNSQGRDLREQLAEGCRLAQHLVQKLSPENDDDEDEDVKVEEAEKVQELYAPREVQKAEEKEVPEDSLEECAITCSNSHHPCESNQPYGNTRITFEEDQVDSTLIDSSSHDEWLDAVCIIPENESDHEQEEEKGPVSPRSSGRFCCLISVGYIFCHPCPAWLIRNLQESEEEEAPQESWDEGHWCDQVKKEDQEATSPRLSRELLDEKEPEVLQDSLDRFYSTPFEYLELPDLCQPYRSDFYSLQEQHLGLALDLDRMKKDQEEEEDQGPPCPRLSRELPEVVEPEDLQDSLDRWYSTPFSYPELPDSCQPYGSCFYSLEEEHVGFSLDVDEIEKYQEGEEDQKPPCPRLNEVLMEAEEPEVLQDSLDRCYSTTSTYFQLHASFQQYRSAFYSFEEQDVSLALDVDNRFFTLTVIRHHLAFQMGVIFPH

SEQ ID NO: 56310 - protein, 53 aa, Homo sapiens
  Payload ID: 11062
  Gene Symbol: NBPF3
  Gene Name: neuroblastoma breakpoint family, member 3
  ENSP ID: ENSP00000391865
MPLTPTVQGFQWTLRGPDVETSPFGAPRAASHGVGRHQELRDPTGGKGSETAT

SEQ ID NO: 56311 - protein, 563 aa, Homo sapiens
  Payload ID: 11062
  Gene Symbol: NBPF3
  Gene Name: neuroblastoma breakpoint family, member 3
  Uniprot ID: Q9H094
  ENSP ID: ENSP00000415711
MPLTPTVQGFQWTLRGPDVETSPFGAPRAASHGVGRHQELRDPTDYEDCKDLIKSMLRDERLLTEEKLAEELGQAEELRQYKVLVHSQERELTQLREKLQEGRDASRSLNQHLQALLTPDEPDNSQGRDLREQLAEGCRLAQHLVQKLSPENDDDEDEDVKVEEAEKVQELYAPREVQKAEEKEVPEDSLEECAITCSNSHHPCESNQPYGNTRITFEEDQVDSTLIDSSSHDEWLDAVCIIPENESDHEQEEEKGPVSPRNLQESEEEEAPQESWDEGDWTLSIPPDMSASYQSDRSTFHSVEEQQVGLALDIGRHWCDQVKKEDQEATSPRLSRELLDEKEPEVLQDSLDRFYSTPFEYLELPDLCQPYRSDFYSLQEQHLGLALDLDRMKKDQEEEEDQGPPCPRLSRELPEVVEPEDLQDSLDRWYSTPFSYPELPDSCQPYGSCFYSLEEEHVGFSLDVDEIEKYQEGEEDQKPPCPRLNEVLMEAEEPEVLQDSLDRCYSTTSTYFQLHASFQQYRSAFYSFEEQDVSLALDVDNRFFTLTVIRHHLAFQMGVIFPH

SEQ ID NO: 56312 - protein, 53 aa, Homo sapiens; identical to SEQ ID NO: 56307
  Payload ID: 11062
  Gene Symbol: NBPF3
  Gene Name: neuroblastoma breakpoint family, member 3
  ENSP ID: ENSP00000478530

SEQ ID NO: 56313 - protein, 46 aa, Homo sapiens
  Payload ID: 11062
  Gene Symbol: NBPF3
  Gene Name: neuroblastoma breakpoint family, member 3
  ENSP ID: ENSP00000479028
MPLTPTVQGFQWTLRGPDVETSPFGAPRAASHGVGRHQELRDPTEM

SEQ ID NO: 56314 - protein, 577 aa, Homo sapiens
  Payload ID: 11062
  Gene Symbol: NBPF3
  Gene Name: neuroblastoma breakpoint family, member 3
  Uniprot ID: Q9H094
  ENSP ID: ENSP00000484028
MVVSAGPWSGEKAEMNILEINKKSRPQLAENKQQFRNLKQKCLVTQVAYFLANRQNNYDYEDCKDLIKSMLRDERLLTEEKLAEELGQAEELRQYKVLVHSQERELTQLREKLQEGRDASRSLNQHLQALLTPDEPDNSQGRDLREQLAEGCRLAQHLVQKLSPENDDDEDEDVKVEEAEKVQELYAPREVQKAEEKEVPEDSLEECAITCSNSHHPCESNQPYGNTRITFEEDQVDSTLIDSSSHDEWLDAVCIIPENESDHEQEEEKGPVSPRNLQESEEEEAPQESWDEGDWTLSIPPDMSASYQSDRSTFHSVEEQQVGLALDIGRHWCDQVKKEDQEATSPRLSRELLDEKEPEVLQDSLDRFYSTPFEYLELPDLCQPYRSDFYSLQEQHLGLALDLDRMKKDQEEEEDQGPPCPRLSRELPEVVEPEDLQDSLDRWYSTPFSYPELPDSCQPYGSCFYSLEEEHVGFSLDVDEIEKYQEGEEDQKPPCPRLNEVLMEAEEPEVLQDSLDRCYSTTSTYFQLHASFQQYRSAFYSFEEQDVSLALDVDNRFFTLTVIRHHLAFQMGVIFPH

SEQ ID NO: 56315 - protein, 638 aa, Homo sapiens
  Payload ID: 11063
  Gene Symbol: NBPF4
  Gene Name: neuroblastoma breakpoint family, member 4
  Uniprot ID: Q96M43
  ENSP ID: ENSP00000389237
MVVSADPLSSERAEMNILEINQELRSQLAESNQQFRDLKEKFLITQATAYSLANQLKKYKCEEYKDIIDSVLRDELQSMEKLAEKLRQAEELRQYKALVHSQAKELTQLREKLREGRDASRWLNKHLKTLLTPDDPDKSQGQDLREQLAEGHRLAEHLVHKLSPENDEDEDEDEDDKDEEVEKVQESPAPREVQKTEEKEVPQDSLEECAVTCSNSHNPSNSNQPHRSTKITFKEHEVDSALVVESEHPHDEEEEALNIPPENQNDHEEEEGKAPVPPRHHDKSNSYRHREVSFLALDEQKVCSAQDVARDYSNPKWDETSLGFLEKQSDLEEVKGQETVAPRLSRGPLRVDKHEIPQESLDGCCLTPSILPDLTPSYHPYWSTLYSFEDKQVSLALVDKIKKDQEEIEDQSPPCPRLSQELPEVKEQEVPEDSVNEVYLTPSVHHDVSDCHQPYSSTLSSLEDQLACSALDVASPTEAACPQGTWSGDLSHHQSEVQVSQAQLEPSTLVPSCLRLQLDQGFHCGNGLAQRGLSSTTCSFSANADSGNQWPFQELVLEPSLGMKNPPQLEDDALEGSASNTQGRQVTGRIRASLVLILKTIRRRLPFSKWRLAFRFAGPHAESAEIPNTAGRTQRMAG

SEQ ID NO: 56316 - protein, 667 aa, Homo sapiens
  Payload ID: 11063
  Gene Symbol: NBPF4
  Gene Name: neuroblastoma breakpoint family, member 4
  ENSP ID: ENSP00000479545
MVVSADPLSSERAEMNILEINQELRSQLAESNQQFRDLKEKFLITQATAYSLANQLKKYKCEEYKDIIDSVLRDELQSMEKLAEKLRQAEELRQYKALVHSQAKELTQLREKLREGRDASRWLNKHLKTLLTPDDPDKSQGQDLREQLAEGHRLAEHLVHKLSPENDEDEDEDEDDKDEEVEKVQESPAPREVQKTEEKEVPQDSLEECAVTCSNSHNPSNSNQPHRSTKITFKEHEVDSALVVESEHPHDEEEEALNIPPENQNDHEEEEGKAPVPPRNRQSLEPGELTNLRDFLISPVVSHVANPGHHDKSNSYRHREVSFLALDEQKVCSAQDVARDYSNPKWDETSLGFLEKQSDLEEVKGQETVAPRLSRGPLRVDKHEIPQESLDGCCLTPSILPDLTPSYHPYWSTLYSFEDKQVSLALVDKIKKDQEEIEDQSPPCPRLSQELPEVKEQEVPEDSVNEVYLTPSVHHDVSDCHQPYSSTLSSLEDQLACSALDVASPTEAACPQGTWSGDLSHHQSEVQVSQAQLEPSTLVPSCLRLQLDQGFHCGNGLAQRGLSSTTCSFSANADSGNQWPFQELVLEPSLGMKNPPQLEDDALEGSASNTQGRQVTGRIRASLVLILKTIRRRLPFSKWRLAFRFAGPHAESAEIPNTAGRTQRMAG

SEQ ID NO: 56317 - protein, 638 aa, Homo sapiens
  Payload ID: 11064
  Gene Symbol: NBPF6
  Gene Name: neuroblastoma breakpoint family, member 6
  Uniprot ID: Q5VWK0
  ENSP ID: ENSP00000294652
MVVSADPLSSERAEMNILEINQELRSQLAESNQQFRDLKEKFLITQATAYSLANQLKKYKCEEYKDIIDSVLRDELQSMEKLAEKLRQAEELRQYKALVHSQAKELTQLREKLREGRDASRWLNKHLKTLLTPDDPDKSQGQDLREQLAEGHRLAEHLVHKLSPENDEDEDEDEDDKDEEVEKVQESPAPREVQKTEEKEVPQDSLEECAVTCSNSHNPSNSNQPHRSTKITFKEHEVDSALVVESEHPHDEEEEALNIPPENQNDHEEEEGKAPVPPRHHDKSNSYRHREVSFLALDEQKVCSAQDVARDYSNPKWDETSLGFLEKQSDLEEVKGQETVAPRLSRGPLRVDKHEIPQESLDGCCLTPSILPDLTPSYHPYWSTLYSFEDKQVSLALVDKIKKDQEEIEDQSPPCPRLSQELPEVKEQEVPEDSVNEVYLTPSVHHDVSDCHQPYSSTLSSLEDQLACSALDVASPTEAACPQGTWSGDLSHHRSEVQISQAQLEPSTLVPSCLRLQLDQGFHCGNGLAQRGLSSTTCSFSANADSGNQWPFQELVLEPSLGMKNPPQLEDDALEGSASNTQGRQVTGRIRASLVLILKTIRRRLPFSKWRLAFRFAGPHAESAEIPNTAERMQRMIG

SEQ ID NO: 56318 - protein, 667 aa, Homo sapiens
  Payload ID: 11064
  Gene Symbol: NBPF6
  Gene Name: neuroblastoma breakpoint family, member 6
  Uniprot ID: Q5VWK0
  ENSP ID: ENSP00000359057
MVVSADPLSSERAEMNILEINQELRSQLAESNQQFRDLKEKFLITQATAYSLANQLKKYKCEEYKDIIDSVLRDELQSMEKLAEKLRQAEELRQYKALVHSQAKELTQLREKLREGRDASRWLNKHLKTLLTPDDPDKSQGQDLREQLAEGHRLAEHLVHKLSPENDEDEDEDEDDKDEEVEKVQESPAPREVQKTEEKEVPQDSLEECAVTCSNSHNPSNSNQPHRSTKITFKEHEVDSALVVESEHPHDEEEEALNIPPENQNDHEEEEGKAPVPPRNRQSLEPGELTNLRDFLISPVVSHVANPGHHDKSNSYRHREVSFLALDEQKVCSAQDVARDYSNPKWDETSLGFLEKQSDLEEVKGQETVAPRLSRGPLRVDKHEIPQESLDGCCLTPSILPDLTPSYHPYWSTLYSFEDKQVSLALVDKIKKDQEEIEDQSPPCPRLSQELPEVKEQEVPEDSVNEVYLTPSVHHDVSDCHQPYSSTLSSLEDQLACSALDVASPTEAACPQGTWSGDLSHHRSEVQISQAQLEPSTLVPSCLRLQLDQGFHCGNGLAQRGLSSTTCSFSANADSGNQWPFQELVLEPSLGMKNPPQLEDDALEGSASNTQGRQVTGRIRASLVLILKTIRRRLPFSKWRLAFRFAGPHAESAEIPNTAERMQRMIG

SEQ ID NO: 56319 - protein, 638 aa, Homo sapiens; identical to SEQ ID NO: 56317
  Payload ID: 11064
  Gene Symbol: NBPF6
  Gene Name: neuroblastoma breakpoint family, member 6
  Uniprot ID: Q5VWK0
  ENSP ID: ENSP00000402703

SEQ ID NO: 56320 - protein, 638 aa, Homo sapiens; identical to SEQ ID NO: 56317
  Payload ID: 11064
  Gene Symbol: NBPF6
  Gene Name: neuroblastoma breakpoint family, member 6
  Uniprot ID: Q5VWK0
  ENSP ID: ENSP00000417277

SEQ ID NO: 56321 - protein, 572 aa, Homo sapiens
  Payload ID: 11064
  Gene Symbol: NBPF6
  Gene Name: neuroblastoma breakpoint family, member 6
  ENSP ID: ENSP00000434735
MVVSADPLSSERAEMNILEINQELRSQLAESNQQFRDLKEKFLITQATAYSLANQLKKYKCEEYKDIIDSVLRDELQSMEKLAEKLRQAEELRQYKALVHSQAKELTQLREKLREGRDASRWLNKHLKTLLTPDDPDKSQGQDLREQLAEGHRLAEHLVHKLSPENDEDEDEDEDDKDEEVEKVQESPAPREVQKTEEKEVPQDSLEECAVTCSNSHNPSNSNQPHRSTKITFKEHEVDSALVVESEHPHDEEEEALNIPPENQNDHEEEEGKAPVPPRNRQSLEPGELTNLRDFLISPVVSHVANPGHHDKSNSYRHREVSFLALDEQKVCSAQDVARDYSNPKWDETSLGFLEKQSDLEEVKGQETVAPRLSRGPLRVDKHEIPQESLDGCCLTPSILPDLTPSYHPYWSTLYSFEDKQVSLALVDKIKKDQEEIEDQSPPCPRLSQELPEVKEQEVPEDSVNEVYLTPSVHHDVSDCHQPYSSTLSSLEDQLACSALDVASPTEAACPQGTWSGDLSHHRSEVQISQAQLEPSTLVPSCLRLQLDQGFHCGNGLAQRGLSSTTCSFSAN

SEQ ID NO: 56322 - protein, 1111 aa, Homo sapiens
  Payload ID: 11065
  Gene Symbol: NBPF9
  Gene Name: neuroblastoma breakpoint family, member 9
  ENSP ID: ENSP00000463665
MVVSAGPWSSEKAEMNILEINEKLRPQLAENKQQFGNLKERCFLTQLAGFLANRQKKYKYEECKDLIKFMLRNERQFKEEKLAEQLKQAEELRQYKVLVHSQERELTQLKEKLREGRDASRSLNEHLQALLTPDEPDKSQGQDLQEQLAEGCRLAQHLVQKLSPENDEDEDEDVQVEEDEKVLESSAPREVQKAEESKVAEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLAGFLANQQNKYKYEECKDLIKFMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQIEVAEKVQKSSAPREMQKAEEKEVPEDSLEECAITYSNSHGPYDSNQPHRKTKITFEEDKVDSTLIGSSSHVEREDAVHIIPENESDDEEEEEKGPVSPRNLQESEEEEVPQESWDEGYSTPSIPPEMLASYKSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLGRWYSTPSGYLELPDLGQPYSSAVYSLEEQYLGLALDLDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKKRRRGRKEGEENQNPPCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNGVLMEVEEPEVLQDSLDGCYSTPSMYFELPDSFQHYRSVFYSFEEQHISFALYVDNRFFTLTVTSLHLVFQMEVIFPQ

SEQ ID NO: 56323 - protein, 1111 aa, Homo sapiens; identical to SEQ ID NO: 56322
  Payload ID: 11065
  Gene Symbol: NBPF9
  Gene Name: neuroblastoma breakpoint family, member 9
  ENSP ID: ENSP00000477979

SEQ ID NO: 56324 - protein, 867 aa, Homo sapiens
  Payload ID: 11065
  Gene Symbol: NBPF9
  Gene Name: neuroblastoma breakpoint family, member 9
  ENSP ID: ENSP00000479415
MVVSAGPWSSEKAEMNILEINEKLRPQLAENKQQFGNLKERCFLTQLAGFLANRQKKYKYEECKDLIKFMLRNERQFKEEKLAEQLKQAEELRQYKVLVHSQERELTQLKEKLREGRDASRSLNEHLQALLTPDEPDKSQGQDLQEQLAEGCRLAQHLVQKLSPENDEDEDEDVQVEEDEKVLESSAPREVQKAEESKVAEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLAGFLANQQNKYKYEECKDLIKFMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQIEVAEKVQKSSAPREMQKAEEKEVPEDSLEECAITYSNSHGPYDSNQPHRKTKITFEEDKVDSTLIGSSSHVEREDAVHIIPENESDDEEEEEKGPVSPRNLQESEEEEVPQESWDEGYSTPSIPPEMLASYKSYSSTFHSLEEQQVCMAVDIGRHRWDQVKKEDQEATGPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNGVLMEVEEPEVLQDSLDGCYSTPSMYFELPDSFQHYRSVFYSFEEQHISFALYVDNRFFTLTVTSLHLVFQMEVIFPQ

SEQ ID NO: 56325 - protein, 942 aa, Homo sapiens
  Payload ID: 11065
  Gene Symbol: NBPF9
  Gene Name: neuroblastoma breakpoint family, member 9
  ENSP ID: ENSP00000481471
MVVSAGPWSSEKAEMNILEINEKLRPQLAENKQQFGNLKERCFLTQLAGFLANRQKKYKYEECKDLIKFMLRNERQFKEEKLAEQLKQAEELRQYKVLVHSQERELTQLKEKLREGRDASRSLNEHLQALLTPDEPDKSQGQDLQEQLAEGCRLAQHLVQKLSPENDEDEDEDVQVEEDEKVLESSAPREVQKAEESKVAEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLAGFLANQQNKYKYEECKDLIKFMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQIEVAEKVQKSSAPREMQKAEEKEVPEDSLEECAITYSNSHGPYDSNQPHRKTKITFEEDKVDSTLIGSSSHVEREDAVHIIPENESDDEEEEEKGPVSPRNLQESEEEEVPQESWDEGYSTPSIPPEMLASYKSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLGRWYSTPSGYLELPDLGQPYSSAVYSLEEQYLGLALDLDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNGVLMEVEEPEVLQDSLDGCYSTPSMYFELPDSFQHYRSVFYSFEEQHISFALYVDNRFFTLTVTSLHLVFQMEVIFPQ

SEQ ID NO: 56326 - protein, 942 aa, Homo sapiens
  Payload ID: 11065
  Gene Symbol: NBPF9
  Gene Name: neuroblastoma breakpoint family, member 9
  ENSP ID: ENSP00000482016
MVVSAGPWSSEKAEMNILEINEKLRPQLAENKQQFGNLKERCFLTQLAGFLANRQKKYKYEECKDLIKFMLRNERQFKEEKLAEQLKQAEELRQYKVLVHSQERELTQLKEKLREGRDASRSLNEHLQALLTPDEPDKSQGQDLQEQLAEGCRLAQHLVQKLSPENDEDEDEDVQVEEDEKVLESSAPREVQKAEESKVAEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLAGFLANQQNKYKYEECKDLIKFMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQIEVAEKVQKSSAPREMQKAEEKEVPEDSLEECAITYSNSHGPYDSNQPHRKTKITFEEDKVDSTLIGSSSHVEREDAVHIIPENESDDEEEEEKGPVSPRNLQESEEEEVPQESWDEGYSTPSIPPEMLASYKSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNGVLMEVEEPEVLQDSLDGCYSTPSMYFELPDSFQHYRSVFYSFEEQHISFALYVDNRFFTLTVTSLHLVFQMEVIFPQ

SEQ ID NO: 56327 - protein, 981 aa, Homo sapiens
  Payload ID: 11065
  Gene Symbol: NBPF9
  Gene Name: neuroblastoma breakpoint family, member 9
  ENSP ID: ENSP00000482587
MVVSAGPWSSEKAEMNILEINEKLRPQLAENKQQFGNLKERCFLTQLAGFLANRQKKYKYEECKDLIKFMLRNERQFKEEKLAEQLKQAEELRQYKVLVHSQERELTQLKEKLREGRDASRSLNEHLQALLTPDEPDKSQGQDLQEQLAEGCRLAQHLVQKLSPENDEDEDEDVQVEEDEKVLESSAPREVQKAEESKVAEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLAGFLANQQNKYKYEECKDLIKFMLRNERQFKEEKLAEQLKQAEELRQYKVLVHAQERELTQLREKLREGRDASRSLNEHLQALLTPDEPDKSQGQDLQEQLAEGCRLAQHLVQKLSPENESDDEEEEEKGPVSPRNLQESEEEEVPQESWDEGHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLGRWYSTPSGYLELPDLGQPYSSAVYSLEEQYLGLALDLDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKKRRRGRKEGEENQNPPCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNGVLMEVEEPEVLQDSLDGCYSTPSMYFELPDSFQHYRSVFYSFEEQHISFALYVDNRFFTLTVTSLHLVFQMEVIFPQ

SEQ ID NO: 56328 - protein, 299 aa, Homo sapiens
  Payload ID: 11065
  Gene Symbol: NBPF9
  Gene Name: neuroblastoma breakpoint family, member 9
  ENSP ID: ENSP00000483736
MVVSAGPLSSEKAEMNILEINEKLRPQLAEKKQQFRNLKEKCFLTQLAGFLANQQNKYKYEECKDLIKFMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQIEVAEKVQKSSAPREMQKAEEKEVPEDSLEECAITYSNSHGPYDSNQPHRKTKITFEEDKVDSTLIGSSSHVEREDAVHIIPENESDDEEEEEKGPVSPRTSVGSSEKGGPRGNRSQAQQGAAG

SEQ ID NO: 56329 - protein, 942 aa, Homo sapiens; identical to SEQ ID NO: 56325
  Payload ID: 11065
  Gene Symbol: NBPF9
  Gene Name: neuroblastoma breakpoint family, member 9
  ENSP ID: ENSP00000483900

SEQ ID NO: 56330 - protein, 189 aa, Homo sapiens
  Payload ID: 11066
  Gene Symbol: NRAS
  Gene Name: neuroblastoma RAS viral (v-ras) oncogene homolog
  Uniprot ID: P01111
  ENSP ID: ENSP00000358548
MTEYKLVVVGAGGVGKSALTIQLIQNHFVDEYDPTIEDSYRKQVVIDGETCLLDILDTAGQEEYSAMRDQYMRTGEGFLCVFAINNSKSFADINLYREQIKRVKDSDDVPMVLVGNKCDLPTRTVDTKQAHELAKSYGIPFIETSAKTRQGVEDAFYTLVREIRQYRMKKLNSSDDGTQGCMGLPCVVM

SEQ ID NO: 56331 - protein, 193 aa, Homo sapiens [sequence omitted]

SEQ ID NO: 56332 - protein, 193 aa, Homo sapiens [sequence omitted]

SEQ ID NO: 56333 - protein, 193 aa, Homo sapiens [sequence omitted]

SEQ ID NO: 56334 - protein, 74 aa, Homo sapiens
  Payload ID: 11067
  Gene Symbol: NCALD
  Gene Name: neurocalcin delta
  ENSP ID: ENSP00000428093
MGKQNSKLRPEVMQDLLESTDFTEHEIQEWYKGFLRDCPSGHLSMEEFKKIYGNFFPYGDASKFAEHVFRTFDA

SEQ ID NO: 56335 - protein, 193 aa, Homo sapiens [sequence omitted]

SEQ ID NO: 56336 - protein, 81 aa, Homo sapiens
  Payload ID: 11067
  Gene Symbol: NCALD
  Gene Name: neurocalcin delta
  ENSP ID: ENSP00000428193
MGKQNSKLRPEVMQDLLESTDFTEHEIQEWYKGFLRDCPSGHLSMEEFKKIYGNFFPYGDASKFAEHVFRTFDANGDGTID

SEQ ID NO: 56337 - protein, 111 aa, Homo sapiens
  Payload ID: 11067
  Gene Symbol: NCALD
  Gene Name: neurocalcin delta
  ENSP ID: ENSP00000428312
MGKQNSKLRPEVMQDLLESTDFTEHEIQEWYKGFLRDCPSGHLSMEEFKKIYGNFFPYGDASKFAEHVFRTFDANGDGTIDFREFIIALSVTSRGKLEQKLKWAFSMYDLD

SEQ ID NO: 56338 - protein, 112 aa, Homo sapiens
  Payload ID: 11067
  Gene Symbol: NCALD
  Gene Name: neurocalcin delta
  ENSP ID: ENSP00000428598
MGKQNSKLRPEVMQDLLESTDFTEHEIQEWYKGFLRDCPSGHLSMEEFKKIYGNFFPYGDASKFAEHVFRTFDANGDGTIDFREFIIALSVTSRGKLEQKLKWAFSMYDLDG

SEQ ID NO: 56339 - protein, 194 aa, Homo sapiens
  Payload ID: 11067
  Gene Symbol: NCALD
  Gene Name: neurocalcin delta
  ENSP ID: ENSP00000428781
MGKQNSKLRPEVMQDLLESTDFTEHEIQEWYKGFLRDCPSGHLSMEEFKKIYGNFFPYGDASKFAEHVFRTFDANGDGTIDFREFIIALSVTSRGKLEQKLKWAFSMYDLDGNGYISKAEMLEIVQAIYKMVSSVMKMPEDESTPEKRTEKIFRQMDTNRDASFVVDASWECPEPQCACGEHGQTSWCSLFDDF

SEQ ID NO: 56340 - protein, 14 aa, Homo sapiens
  Payload ID: 11067
  Gene Symbol: NCALD
  Gene Name: neurocalcin delta
  ENSP ID: ENSP00000429162
MGKQNSKLRPEVMQ

SEQ ID NO: 56341 - protein, 105 aa, Homo sapiens
  Payload ID: 11067
  Gene Symbol: NCALD
  Gene Name: neurocalcin delta
  ENSP ID: ENSP00000429245
MGKQNSKLRPEVMQDLLESTDFTEHEIQEWYKGFLRDCPSGHLSMEEFKKIYGNFFPYGDASKFAEHVFRTFDANGDGTIDFREFIIALSVTSRGKLEQKLKWAF

SEQ ID NO: 56342 - protein, 136 aa, Homo sapiens
  Payload ID: 11067
  Gene Symbol: NCALD
  Gene Name: neurocalcin delta
  ENSP ID: ENSP00000429255
MGKQNSKLRPEVMQDLLESTDFTEHEIQEWYKGFLRDCPSGHLSMEEFKKIYGNFFPYGDASKFAEHVFRTFDANGDGTIDFREFIIALSVTSRGKLEQKLKWAFSMYDLDGNGYISKAEMLEIVQAIYKMVSSVM

SEQ ID NO: 56343 - protein, 52 aa, Homo sapiens
  Payload ID: 11067
  Gene Symbol: NCALD
  Gene Name: neurocalcin delta
  ENSP ID: ENSP00000429296
MGKQNSKLRPEVMQDLLESTDFTEHEIQEWYKGFLRDCPSGHLSMEEFKKIY

SEQ ID NO: 56344 - protein, 3 aa, Homo sapiens
  Payload ID: 11067
  Gene Symbol: NCALD
  Gene Name: neurocalcin delta
  ENSP ID: ENSP00000429347
MGK

SEQ ID NO: 56345 - protein, 152 aa, Homo sapiens
  Payload ID: 11067
  Gene Symbol: NCALD
  Gene Name: neurocalcin delta
  ENSP ID: ENSP00000429466
MGKQNSKLRPEVMQDLLESTDFTEHEIQEWYKGFLRDCPSGHLSMEEFKKIYGNFFPYGDASKFAEHVFRTFDANGDGTIDFREFIIALSVTSRGKLEQKLKWAFSMYDLDGNGYISKAEMLEIVQERKKMAQLFFHRFTLVELICVSLEIK

SEQ ID NO: 56346 - protein, 105 aa, Homo sapiens; identical to SEQ ID NO: 56341
  Payload ID: 11067
  Gene Symbol: NCALD
  Gene Name: neurocalcin delta
  ENSP ID: ENSP00000429493

SEQ ID NO: 56347 - protein, 116 aa, Homo sapiens
  Payload ID: 11067
  Gene Symbol: NCALD
  Gene Name: neurocalcin delta
  ENSP ID: ENSP00000429522
MGKQNSKLRPEVMQDLLESTDFTEHEIQEWYKGFLRDCPSGHLSMEEFKKIYGNFFPYGDASKFAEHVFRTFDANGDGTIDFREFIIALSVTSRGKLEQKLKWAFSMYDLDGNGYI

SEQ ID NO: 56348 - protein, 87 aa, Homo sapiens
  Payload ID: 11067
  Gene Symbol: NCALD
  Gene Name: neurocalcin delta
  ENSP ID: ENSP00000430064
MGKQNSKLRPEVMQDLLESTDFTEHEIQEWYKGFLRDCPSGHLSMEEFKKIYGNFFPYGDASKFAEHVFRTFDANGDGTIDFREFII

SEQ ID NO: 56349 - protein, 77 aa, Homo sapiens
  Payload ID: 11067
  Gene Symbol: NCALD
  Gene Name: neurocalcin delta
  ENSP ID: ENSP00000430365
MGKQNSKLRPEVMQDLLESTDFTEHEIQEWYKGFLRDCPSGHLSMEEFKKIYGNFFPYGDASKFAEHVFRTFDANGD

SEQ ID NO: 56350 - protein, 193 aa, Homo sapiens [sequence omitted]

SEQ ID NO: 56351 - protein, 85 aa, Homo sapiens
  Payload ID: 11067
  Gene Symbol: NCALD
  Gene Name: neurocalcin delta
  ENSP ID: ENSP00000430534
MGKQNSKLRPEVMQDLLESTDFTEHEIQEWYKGFLRDCPSGHLSMEEFKKIYGNFFPYGDASKFAEHVFRTFDANGDGTIDFREF

SEQ ID NO: 56352 - protein, 15 aa, Homo sapiens
  Payload ID: 11067
  Gene Symbol: NCALD
  Gene Name: neurocalcin delta
  ENSP ID: ENSP00000430578
MGKQNSKLRPEVMQD

SEQ ID NO: 56353 - protein, 121 aa, Homo sapiens
  Payload ID: 11067
  Gene Symbol: NCALD
  Gene Name: neurocalcin delta
  ENSP ID: ENSP00000430731
MGKQNSKLRPEVMQDLLESTDFTEHEIQEWYKGFLRDCPSGHLSMEEFKKIYGNFFPYGDASKFAEHVFRTFDANGDGTIDFREFIIALSVTSRGKLEQKLKWAFSMYDLDGNGYISKAEM

SEQ ID NO: 56354 - protein, 120 aa, Homo sapiens
  Payload ID: 11067
  Gene Symbol: NCALD
  Gene Name: neurocalcin delta
  ENSP ID: ENSP00000430925
MGKQNSKLRPEVMQDLLESTDFTEHEIQEWYKGFLRDCPSGHLSMEEFKKIYGNFFPYGDASKFAEHVFRTFDANGDGTIDFREFIIALSVTSRGKLEQKLKWAFSMYDLDGNGYISKAE

SEQ ID NO: 56355 - protein, 1321 aa, Homo sapiens
  Payload ID: 11068
  Gene Symbol: NCAN
  Gene Name: neurocan
  Uniprot ID: O14594
  ENSP ID: ENSP00000252575
MGAPFVWALGLLMLQMLLFVAGEQGTQDITDASERGLHMQKLGSGSVQAALAELVALPCLFTLQPRPSAARDAPRIKWTKVRTASGQRQDLPILVAKDNVVRVAKSWQGRVSLPSYPRRRANATLLLGPLRASDSGLYRCQVVRGIEDEQDLVPLEVTGVVFHYRSARDRYALTFAEAQEACRLSSAIIAAPRHLQAAFEDGFDNCDAGWLSDRTVRYPITQSRPGCYGDRSSLPGVRSYGRRNPQELYDVYCFARELGGEVFYVGPARRLTLAGARAQCRRQGAALASVGQLHLAWHEGLDQCDPGWLADGSVRYPIQTPRRRCGGPAPGVRTVYRFANRTGFPSPAERFDAYCFRAHHPTSQHGDLETPSSGDEGEILSAEGPPVRELEPTLEEEEVVTPDFQEPLVSSGEEETLILEEKQESQQTLSPTPGDPMLASWPTGEVWLSTVAPSPSDMGAGTAASSHTEVAPTDPMPRRRGRFKGLNGRYFQQQEPEPGLQGGMEASAQPPTSEAAVNQMEPPLAMAVTEMLGSGQSRSPWADLTNEVDMPGAGSAGGKSSPEPWLWPPTMVPPSISGHSRAPVLELEKAEGPSARPATPDLFWSPLEATVSAPSPAPWEAFPVATSPDLPMMAMLRGPKEWMLPHPTPISTEANRVEAHGEATATAPPSPAAETKVYSLPLSLTPTGQGGEAMPTTPESPRADFRETGETSPAQVNKAEHSSSSPWPSVNRNVAVGFVPTETATEPTGLRGIPGSESGVFDTAESPTSGLQATVDEVQDPWPSVYSKGLDASSPSAPLGSPGVFLVPKVTPNLEPWVATDEGPTVNPMDSTVTPAPSDASGIWEPGSQVFEEAESTTLSPQVALDTSIVTPLTTLEQGDKVGVPAMSTLGSSSSQPHPEPEDQVETQGTSGASVPPHQSSPLGKPAVPPGTPTAASVGESASVSSGEPTVPWDPSSTLLPVTLGIEDFELEVLAGSPGVESFWEEVASGEEPALPGTPMNAGAEEVHSDPCENNPCLHGGTCNANGTMYGCSCDQGFAGENCEIDIDDCLCSPCENGGTCIDEVNGFVCLCLPSYGGSFCEKDTEGCDRGWHKFQGHCYRYFAHRRAWEDAEKDCRRRSGHLTSVHSPEEHSFINSFGHENTWIGLNDRIVERDFQWTDNTGLQFENWRENQPDNFFAGGEDCVVMVAHESGRWNDVPCNYNLPYVCKKGTVLCGPPPAVENASLIGARKAKYNVHATVRYQCNEGFAQHHVATIRCRSNGKWDRPQIVCTKPRRSHRMRRHHHHHQHHHQHHHHKSRKERRKHKKHPTEDWEKDEGNFC

SEQ ID NO: 56356 - protein, 175 aa, Homo sapiens
  Payload ID: 11068
  Gene Symbol: NCAN
  Gene Name: neurocan
  ENSP ID: ENSP00000465599
  MOD_RES (1)..(1): Any amino acid
XGCDRGWHKFQGHCYRYFAHRRAWEDAEKDCRRRSGHLTSVHSPEEHSFINSFGHENTWIGLNDRIVERDFQWTDNTGLQFENWRENQPDNFFAGGEDCVVMVAHESGRWNDVPCNYNLPYVCKKGTARRSHRMRRHHHHHQHHHQHHHHKSRKERRKHKKHPTEDWEKDEGNFC

SEQ ID NO: 56357 - protein, 729 aa, Homo sapiens
  Payload ID: 11069
  Gene Symbol: NCDN
  Gene Name: neurochondrin
  Uniprot ID: Q9UBB6
  ENSP ID: ENSP00000348394
MSCCDLAAAGQLGKASIMASDCEPALNQAEGRNPTLERYLGALREAKNDSEQFAALLLVTKAVKAGDIDAKTRRRIFDAVGFTFPNRLLTTKEAPDGCPDHVLRALGVALLACFCSDPELAAHPQVLNKIPILSTFLTARGDPDDAARRSMIDDTYQCLTAVAGTPRGPRHLIAGGTVSALCQAYLGHGYGFDQALALLVGLLAAAETQCWKEAEPDLLAVLRGLSEDFQKAEDASKFELCQLLPLFLPPTTVPPECYRDLQAGLARILGSKLSSWQRNPALKLAARLAHACGSDWIPAGSSGSKFLALLVNLACVEVRLALEETGTEVKEDVVTACYALMELGIQECTRCEQSLLKEPQKVQLVSVMKEAIGAVIHYLLQVGSEKQKEPFVFASVRILGAWLAEETSSLRKEVCQLLPFLVRYAKTLYEEAEEANDLSQQVANLAISPTTPGPTWPGDALRLLLPGWCHLTVEDGPREILIKEGAPSLLCKYFLQQWELTSPGHDTSVLPDSVEIGLQTCCHIFLNLVVTAPGLIKRDACFTSLMNTLMTSLPALVQQQGRLLLAANVATLGLLMARLLSTSPALQGTPASRGFFAAAILFLSQSHVARATPGSDQAVLALSPEYEGIWADLQELWFLGMQAFTGCVPLLPWLAPAALRSRWPQELLQLLGSVSPNSVKPEMVAAYQGVLVELARANRLCREAMRLQAGEETASHYRMAALEQCLSEP

SEQ ID NO: 56358 - protein, 729 aa, Homo sapiens; identical to SEQ ID NO: 56357
  Payload ID: 11069
  Gene Symbol: NCDN
  Gene Name: neurochondrin
  Uniprot ID: Q9UBB6
  ENSP ID: ENSP00000362340

SEQ ID NO: 56359 - protein, 712 aa, Homo sapiens
  Payload ID: 11069
  Gene Symbol: NCDN
  Gene Name: neurochondrin
  Uniprot ID: Q9UBB6
  ENSP ID: ENSP00000362350
MASDCEPALNQAEGRNPTLERYLGALREAKNDSEQFAALLLVTKAVKAGDIDAKTRRRIFDAVGFTFPNRLLTTKEAPDGCPDHVLRALGVALLACFCSDPELAAHPQVLNKIPILSTFLTARGDPDDAARRSMIDDTYQCLTAVAGTPRGPRHLIAGGTVSALCQAYLGHGYGFDQALALLVGLLAAAETQCWKEAEPDLLAVLRGLSEDFQKAEDASKFELCQLLPLFLPPTTVPPECYRDLQAGLARILGSKLSSWQRNPALKLAARLAHACGSDWIPAGSSGSKFLALLVNLACVEVRLALEETGTEVKEDVVTACYALMELGIQECTRCEQSLLKEPQKVQLVSVMKEAIGAVIHYLLQVGSEKQKEPFVFASVRILGAWLAEETSSLRKEVCQLLPFLVRYAKTLYEEAEEANDLSQQVANLAISPTTPGPTWPGDALRLLLPGWCHLTVEDGPREILIKEGAPSLLCKYFLQQWELTSPGHDTSVLPDSVEIGLQTCCHIFLNLVVTAPGLIKRDACFTSLMNTLMTSLPALVQQQGRLLLAANVATLGLLMARLLSTSPALQGTPASRGFFAAAILFLSQSHVARATPGSDQAVLALSPEYEGIWADLQELWFLGMQAFTGCVPLLPWLAPAALRSRWPQELLQLLGSVSPNSVKPEMVAAYQGVLVELARANRLCREAMRLQAGEETASHYRMAALEQCLSEP

SEQ ID NO: 56360 - protein, 244 aa, Homo sapiens
  Payload ID: 11069
  Gene Symbol: NCDN
  Gene Name: neurochondrin
  ENSP ID: ENSP00000406511
MASDCEPALNQAEGRNPTLERYLGALREAKNDSEQFAALLLVTKAVKAGDIDAKTRRRIFDAVGFTFPNRLLTTKEAPDGCPDHVLRALGVALLACFCSDPELAAHPQVLNKIPILSTFLTARGDPDDAARRSMIDDTYQCLTAVAGTPRGPRHLIAGGTVSALCQAYLGHGYGFDQALALLVGLLAAAETQCWKEAEPDLLAVLRGLSEDFQKAEDASKFELCQLLPLFLPPTTVPPECYRDL

SEQ ID NO: 56361 - protein, 193 aa, Homo sapiens
  Payload ID: 11069
  Gene Symbol: NCDN
  Gene Name: neurochondrin
  ENSP ID: ENSP00000407339
  MOD_RES (1)..(1): Any amino acid
XSSLRKEVCQLLPFLVRYAKTLYEEAEEANDLSQQVANLAISPTTPGPTWPGDALRLLLPGWCHLTVEDGPREILIKEGAPSLLCKYFLQQWELTSPGHDTSVLPDSVEIGLQTCCHIFLNLVVTAPGLIKRDACFTSLMNTLMTSLPALVQQQGRLLLAANVATLGLLMARLLSTSPGSISSQLPGAEHMPC

SEQ ID NO: 56362 - protein, 596 aa, Homo sapiens
  Payload ID: 11070
  Gene Symbol: NET1
  Gene Name: neuroepithelial cell transforming 1
  Uniprot ID: Q7Z628
  ENSP ID: ENSP00000347134
MEPELAAQKQPRPRRRSRRASGLSTEGATGPSADTSGSELDGRCSLRRGSSFTFLTPGPNWDFTLKRKRREKDDDVVSLSSLDLKEPSNKRVRPLARVTSLANLISPVRNGAVRRFGQTIQSFTLRGDHRSPASAQKFSSRSTVPTPAKRRSSALWSEMLDITMKESLTTREIRRQEAIYEMSRGEQDLIEDLKLARKAYHDPMLKLSIMSEEELTHIFGDLDSYIPLHEDLLTRIGEATKPDGTVEQIGHILVSWLPRLNAYRGYCSNQLAAKALLDQKKQDPRVQDFLQRCLESPFSRKLDLWSFLDIPRSRLVKYPLLLKEILKHTPKEHPDVQLLEDAILIIQGVLSDINLKKGESECQYYIDKLEYLDEKQRDPRIEASKVLLCHGELRSKSGHKLYIFLFQDILVLTRPVTRNERHSYQVYRQPIPVQELVLEDLQDGDVRMGGSFRGAFSNSEKAKNIFRIRFHDPSPAQSHTLQANDVFHKQQWFNCIRAAIAPFQSAGSPPELQGLPELHEECEGNHPSARKLTAQRRASTVSSVTQVEVDENAYRCGSGMQMAEDSKSLKTHQTQPGIRRARDKALSGGKRKETLV

SEQ ID NO: 56363 - protein, 542 aa, Homo sapiens
  Payload ID: 11070
  Gene Symbol: NET1
  Gene Name: neuroepithelial cell transforming 1
  Uniprot ID: Q7Z628
  ENSP ID: ENSP00000369717
MVAHDETGGLLPIKRTIRVLDVNNQSFREQEEPSNKRVRPLARVTSLANLISPVRNGAVRRFGQTIQSFTLRGDHRSPASAQKFSSRSTVPTPAKRRSSALWSEMLDITMKESLTTREIRRQEAIYEMSRGEQDLIEDLKLARKAYHDPMLKLSIMSEEELTHIFGDLDSYIPLHEDLLTRIGEATKPDGTVEQIGHILVSWLPRLNAYRGYCSNQLAAKALLDQKKQDPRVQDFLQRCLESPFSRKLDLWSFLDIPRSRLVKYPLLLKEILKHTPKEHPDVQLLEDAILIIQGVLSDINLKKGESECQYYIDKLEYLDEKQRDPRIEASKVLLCHGELRSKSGHKLYIFLFQDILVLTRPVTRNERHSYQVYRQPIPVQELVLEDLQDGDVRMGGSFRGAFSNSEKAKNIFRIRFHDPSPAQSHTLQANDVFHKQQWFNCIRAAIAPFQSAGSPPELQGLPELHEECEGNHPSARKLTAQRRASTVSSVTQVEVDENAYRCGSGMQMAEDSKSLKTHQTQPGIRRARDKALSGGKRKETLV

SEQ ID NO: 56364 - protein, 160 aa, Homo sapiens
  Payload ID: 11070
  Gene Symbol: NET1
  Gene Name: neuroepithelial cell transforming 1
  ENSP ID: ENSP00000403101
MVAHDETGGLLPIKRTIRVLDVNNQSFREQEELTHIFGDLDSYIPLHEDLLTRIGEATKPDGTVEQIGHILVSWLPRLNAYRGYCSNQLAAKALLDQKKQDPRVQDFLQRCLESPFSRKLDLWSFLDIPRSRLVKYPLLLKEILKHTPKEHPDVQLLEDA

SEQ ID NO: 56365 - protein, 1240 aa, Homo sapiens
  Payload ID: 11071
  Gene Symbol: NFASC
  Gene Name: neurofascin
  Uniprot ID: O94856
  ENSP ID: ENSP00000344786
MARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDLPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEATPTAAPPTLPPTTVGATGAVSSTDATAIAATTEATTVPIIPTVAPTTIATTTTVATTTTTTAAATTTTESPPTTTSGTKIHESAPDEQSIWNVTVLPNSKWANITWKHNFGPGTDFVVEYIDSNHTKKTVPVKAQAQPIQLTDLYPGMTYTLRVYSRDNEGISSTVITFMTSTAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 56366 - protein, 1169 aa, Homo sapiens
  Payload ID: 11071
  Gene Symbol: NFASC
  Gene Name: neurofascin
  Uniprot ID: O94856
  ENSP ID: ENSP00000353154
MARQPPPPWVHAAFLLCLLSLGGAIEIPMDLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTNHPYNDSSLRNHPDMYSARGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 56367 - protein, 1041 aa, Homo sapiens
  Payload ID: 11071
  Gene Symbol: NFASC
  Gene Name: neurofascin
  ENSP ID: ENSP00000356141
  MOD_RES (1)..(1): Any amino acid
XSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDLPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEATPTAAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 56368 - protein, 1174 aa, Homo sapiens
  Payload ID: 11071
  Gene Symbol: NFASC
  Gene Name: neurofascin
  Uniprot ID: O94856
  ENSP ID: ENSP00000384061
MARQPPPPWVHAAFLLCLLSLGGAIEIPMDLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTNHPYNDSSLRNHPDMYSARGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEATPTAAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 56369 - protein, 619 aa, Homo sapiens
  Payload ID: 11071
  Gene Symbol: NFASC
  Gene Name: neurofascin
  Uniprot ID: O94856
  ENSP ID: ENSP00000384875
MARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLGNCPCSPWH

SEQ ID NO: 56370 - protein, 1240 aa, Homo sapiens; identical to SEQ ID NO: 56365
  Payload ID: 11071
  Gene Symbol: NFASC
  Gene Name: neurofascin
  Uniprot ID: O94856
  ENSP ID: ENSP00000385637

SEQ ID NO: 56371 - protein, 1157 aa, Homo sapiens
  Payload ID: 11071
  Gene Symbol: NFASC
  Gene Name: neurofascin
  Uniprot ID: O94856
  ENSP ID: ENSP00000385676
MARQPPPPWVHAAFLLCLLSLGGAIEIPMDLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTTRGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEATPTAAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 56372 - protein, 237 aa, Homo sapiens
  Payload ID: 11071
  Gene Symbol: NFASC
  Gene Name: neurofascin
  ENSP ID: ENSP00000393290
  MOD_RES (1)..(1): Any amino acid
XENFSPNQTKFTVQRTDPVSRYRFTLSARTQVGSGEAVTEESPAPPNEATPTAAPDEQSIWNVTVLPNSKWANITWKHNFGPGTDFVVEYIDSNHTKKTVPVKAQAQPIQLTDLYPGMTYTLRVYSRDNEGISSTVITFMTSTAYTNNQADIATQGWFIGLMCAIALLVLILLIVCFIKRSRGGKYPVREKKDVPLGPEDPKEEDGSFDYSDEDNKPLQGSQTSLDGTIKQQESDDS

SEQ ID NO: 56373 - protein, 298 aa, Homo sapiens
  Payload ID: 11071
  Gene Symbol: NFASC
  Gene Name: neurofascin
  ENSP ID: ENSP00000395664
  MOD_RES (1)..(1): Any amino acid
XRETREAWNNVTVWGSRYVVGQTPVYVPYEIRVQAENDFGKGPEPESVIGYSGEDLPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 56374 - protein, 1165 aa, Homo sapiens
  Payload ID: 11071
  Gene Symbol: NFASC
  Gene Name: neurofascin
  ENSP ID: ENSP00000415031
IEIPMDLTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTNHPYNDSSLRNHPDMYSARGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRWFKNGQGSNLDGGNYHVYENGSLEIKMIRKEDQGIYTCVATNILGKAENQVRLEVKDPTRIYRMPEDQVARRGTTVQLECRVKHDPSLKLTVSWLKDDEPLYIGNRMKKEDDSLTIFGVAERDQGSYTCVASTELDQDLAKAYLTVLADQATPTNRLAALPKGRPDRPRDLELTDLAERSVRLTWIPGDANNSPITDYVVQFEEDQFQPGVWHDHSKYPGSVNSAVLRLSPYVNYQFRVIAINEVGSSHPSLPSERYRTSGAPPESNPGDVKGEGTRKNNMEITWTPMNATSAFGPNLRYIVKWRRRETREAWNNVTVWGSRYVVGQTPVYVPYEIRVQAENDFGKGPEPESVIGYSGEDYPRAAPTEVKVRVMNSTAISLQWNRVYSDTVQGQLREYRAYYWRESSLLKNLWVSQKRQQASFPGDRLRGVVSRLFPYSNYKLEMVVVNGRGDGPRSETKEFTTPEGVPSAPRRFRVRQPNLETINLEWDHPEHPNGIMIGYTLKYVAFNGTKVGKQIVENFSPNQTKFTVQRTDPVSRYRFTLSARTQVGSGEAVTEESPAPPNEATPTAAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 56375 - protein, 218 aa, Homo sapiens
  Payload ID: 11071
  Gene Symbol: NFASC
  Gene Name: neurofascin
  ENSP ID: ENSP00000416891
PPTTVGATGAVSSTDATAIAATTEATTVPIIPTVAPTTIATTTTVATTTTTTAAATTTTESPPTTTSGTKIHESAYTNNQADIATQGWFIGLMCAIALLVLILLIVCFIKRSRGGKYPVREKKDVPLGPEDPKEEDGSFDYSDEDNKPLQGSQTSLDGTIKQQESDDSLVDYGEGGEGQFNEDGSFIGQYTVKKDKEETEGNESSEATSPVNAIYSLA

SEQ ID NO: 56376 - protein, 486 aa, Homo sapiens
  Payload ID: 11071
  Gene Symbol: NFASC
  Gene Name: neurofascin
  ENSP ID: ENSP00000422524
MARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALSNRIRLQVSKSPLWPKENLDPVVVQEGAPLTLQCNPPPGLPSPVIFWMSSSMEPITQDKRVSQGHNGDLYFSNVMLQDMQTDYSCNARFHFTHTIQQKNPFTLKVLTNHPYNDSSLRNHPDMYSARGVAERTPSFMYPQGTASSQMVLRGMDLLLECIASGVPTPDIAWYKKGGDLPSDKAKFENFNKALRITNVSEEDSGEYFCLASNKMGSIRHTISVRVKAAPYWLDEPKNLILAPGEDGRLVCRANGNPKPTVQWMVNGEPLQSAPPNPNREVAGDTIIFRDTQISSRAVYQCNTSNEHGYLLANAFVSVLDVPPRMLSPRNQLIRVILYNRTRLDCPFFGSPIPTLRCPHGLS

SEQ ID NO: 56377 - protein, 1169 aa, Homo sapiens; identical to SEQ ID NO: 56366
  Payload ID: 11071
  Gene Symbol: NFASC
  Gene Name: neurofascin
  Uniprot ID: O94856
  ENSP ID: ENSP00000425908

SEQ ID NO: 56378 - protein, 129 aa, Homo sapiens
  Payload ID: 11071
  Gene Symbol: NFASC
  Gene Name: neurofascin
  ENSP ID: ENSP00000427586
MARQPPPPWVHAAFLLCLLSLGGAIEIPMDPSIQNELTQPPTITKQSAKDHIVDPRDNILIECEAKGNPAPSFHWTRNSRFFNIAKDPRVSMRRRSGTLVIDFRSGGRPEEYEGEYQCFARNKFGTALS

SEQ ID NO: 56379 - protein, 1174 aa, Homo sapiens; identical to SEQ ID NO: 56368
  Payload ID: 11071
  Gene Symbol: NFASC
  Gene Name: neurofascin
  Uniprot ID: O94856
  ENSP ID: ENSP00000438614

SEQ ID NO: 56380 - protein, 2818 aa, Homo sapiens
  Payload ID: 11072
  Gene Symbol: NF1
  Gene Name: neurofibromin 1
  Uniprot ID: P21359
  ENSP ID: ENSP00000348498
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPGIDKENVELSPTTGHCNSGRTRHGSASQVQKQRSAGSFKRNSIKKIV

SEQ ID NO: 56381 - protein, 2839 aa, Homo sapiens
  Payload ID: 11072
  Gene Symbol: NF1
  Gene Name: neurofibromin 1
  Uniprot ID: P21359
  ENSP ID: ENSP00000351015
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQATCHSLLNKATVKEKKENKKSVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPGIDKENVELSPTTGHCNSGRTRHGSASQVQKQRSAGSFKRNSIKKIV

SEQ ID NO: 56382 - protein, 2502 aa, Homo sapiens
  Payload ID: 11072
  Gene Symbol: NF1
  Gene Name: neurofibromin 1
  ENSP ID: ENSP00000389907
NWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRFKTGQINGDLLIYHVLLTLKPYYAKPYEIVVDLTHTGPSNRFKTDFLSKWFVVFPGFAYDNVSAVYIYNCNSWVREYTKYHERLLTGLKGSKRLVFIDCPGKLAEHIEHEQQKLPAATLALEEDLKVFHNALKLAHKDTKVSIKVGSTAVQVTSAERTKVLGQSVFLNDIYYASEIEEICLVDENQFTLTIANQGTPLTFMHQECEAIVQSIIHIRTRWELSQPDSIPQHTKIRPKDVPGTLLNIALLNLGSSDPSLRSAAYNLLCALTCTFNLKIEGQLLETSGLCIPANNTLFIVSISKTLAANEPHLTLEFLEECISGFSKSSIELKHLCLEYMTPWLSNLVRFCKHNDDAKRQRVTAILDKLITMTINEKQMYPSIQAKIWGSLGQITDLLDVVLDSFIKTSATGGLGSIKAEVMADTAVALASGNVKLVSSKVIGRMCKIIDKTCLSPTPTLEQHLMWDDIAILARYMLMLSFNNSLDVAAHLPYLFHVVTFLVATGPLSLRASTHGLVINIIHSLCTCSQLHFSEETKQVLRLSLTEFSLPKFYLLFGISKVKSAAVIAFRSSYRDRSFSPGSYERETFALTSLETVTEALLEIMEACMRDIPTCKWLDQWTELAQRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPASLPCSKSAVFMQLFPHQGIDKENVELSPTTGHCNSGRTRHGSASQVQKQRSAGSFKRNSIKKIV

SEQ ID NO: 56383 - protein, 593 aa, Homo sapiens
  Payload ID: 11072
  Gene Symbol: NF1
  Gene Name: neurofibromin 1
  Uniprot ID: P21359
  ENSP ID: ENSP00000412921
MAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEIRYMYFYFLNSTFKFYFVFLS

SEQ ID NO: 56384 - protein, 206 aa, Homo sapiens
  Payload ID: 11072
  Gene Symbol: NF1
  Gene Name: neurofibromin 1
  ENSP ID: ENSP00000462157
  MOD_RES (1)..(1): Any amino acid
XRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQVPKNSHPSMV

SEQ ID NO: 56385 - protein, 1656 aa, Homo sapiens
  Payload ID: 11072
  Gene Symbol: NF1
  Gene Name: neurofibromin 1
  ENSP ID: ENSP00000462408
SLPLPSPQPPLPALFPAQGAGPPFPPPPPGRGEDMAAHRPVEWVQAVVSRFDEQLPIKTGQQNTHTKVSTEHNKECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYINVDCAKLKRLLKETAFKFKALKKVAQLAVINSLEKAFWNWVENYPDEFTKLYQIPQTDMAECAEKLFDLVDGFAESTKRKAAVWPLQIILLILCPEIIQDISKDVVDENNMNKKLFLDSLRKALAGHGGSRQLTESAAIACVKLCKASTYINWEDNSVIFLLVQSMVVDLKNLLFNPSKPFSRGSQPADVDLMIDCLVSCFRISPHNNQHFKICLAQNSPSTFHYVLVNSLHRIITNSALDWWPKIDAVYCHSVELRNMFGETLHKAVQGCGAHPAIRMAPSLTFKEKVTSLKFKEKPTDLETRSYKYLLLSMVKLIHADPKLLLCNPRKQGPETQGSTAELITGLVQLVPQSHMPEIAQEAMEALLVLHQLDSIDLWNPDAPVETFWEISSQMLFYICKKLTSHQMLSSTEILKWLREILICRNKFLLKNKQADRSSCHFLLFYGVGCDIPSSGNTSQMSMDHEELLRTPGASLRKGKGNSSMDSAAGCSGTPPICRQAQTKLEVALYMFLWNPDTEAVLVAMSCFRHLCEEADIRCGVDEVSVHNLLPNYNTFMEFASVSNMMSTGRAALQKRVMALLRRIEHPTAGNTEAWEDTHAKWEQATKLILNYPKAKMEDGQAAESLHKTIVKRRMSHVSGGGSIDLSDTDSLQEWINMTGFLCALGGVCLQQRSNSGLATYSPPMGPVSERKGSMISVMSSEGNADTPVSKFMDRLLSLMVCNHEKVGLQIRTNVKDLVGLELSPALYPMLFNKLKNTISKFFDSQGQVLLTDTNTQFVEQTIAIMKNLLDNHTEGSSEHLGQASIETMMLNLVRYVRVLGNMVHAIQIKTKLCQLVEVMMARRDDLSFCQEMKFRNKMVEYLTDWVMGTSNQAADDDVKCLTRDLDQASMEAVVSLLAGLPLQPEEGDGVELMEAKSQLFLKYFTLFMNLLNDCSEVEDESAQTGGRKRGMSRRLASLRHCTVLAMSNLLNANVDSGLMHSIGLGYHKDLQTRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQVVSQRFPQNSIGAVGSAMFLRFINPAIVSPYEAGILDKKPPPRIERGLKLMSKILQSIANHVLFTKEEHMRPFNDFVKSNFDAARRFFLDIASDCPTSDAVNHSLSFISDGNVLALHRLLWNNQEKIGQYLSSNRDHKAVGRRPFDKMATLLAYLGPPEHKPVADTHWSSLNLTSSKFEEFMTRHQVHEKEEFKALKTLSIFYQAGTSKAGNPIFYYVARRIYYPNIVKGITKHLPRNSYPTLISGFSFPLL

SEQ ID NO: 56386 - protein, 206 aa, Homo sapiens
  Payload ID: 11072
  Gene Symbol: NF1
  Gene Name: neurofibromin 1
  ENSP ID: ENSP00000462700
  MOD_RES (1)..(1): Any amino acid
XGMHERYSNVQVAGPVDRTSSKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRNKEKF

SEQ ID NO: 56387 - protein, 124 aa, Homo sapiens
  Payload ID: 11072
  Gene Symbol: NF1
  Gene Name: neurofibromin 1
  ENSP ID: ENSP00000463682
  MOD_RES (1)..(1): Any amino acid
XECLINISKYKFSLVISGLTTILKNVNNMRIFGEAAEKNLYLSQLIILDTLEKCLAGQPKDTMRLDETMLVKQLLPEICHFLHTCREGNQHAAELRNSASGVLFSLSCNNFNAVFSRISTRNSI

SEQ ID NO: 56388 - protein, 227 aa, Homo sapiens
  Payload ID: 11072
  Gene Symbol: NF1
  Gene Name: neurofibromin 1
  ENSP ID: ENSP00000463819
  MOD_RES (1)..(1): Any amino acid
XRATFMEVLTKILQQGTEFDTLAETVLADRFERLVELVTMMGDQGELPIAMALANVVPCSQWDELARVLVTLFDSRHLLYQLLWNMFSKEVELADSMQTLFRGNSLASKIMTFCFKVYGATYLQKLLDPLLRIVITSSDWQHVSFEVDPTRLEPSESLEENQRNLLQMTEKFFHAIISSSSEFPPQLRSVCHCLYQATCHSLLNKATVKEKKENKKSVPKNSHPSMV

SEQ ID NO: 56389 - protein, 640 aa, Homo sapiens
  Payload ID: 11072
  Gene Symbol: NF1
  Gene Name: neurofibromin 1
  ENSP ID: ENSP00000464678
  MOD_RES (1)..(1): Any amino acid
XGMHERYSNVQVAGPVDRTSSKFCGSFNCRFAFQYNPSLQPRALVVFGCISKRVSHGQIKQIIRILSKALESCLKGPDTYNSQVLIEATVIALTKLQPLLNKDSPLHKALFWVAVAVLQLDEVNLYSAGTALLEQNLHTLDSLRIFNDKSPEEVFMAIRNPLEWHCKQMDHFVGLNFNSNFNFALVGHLLKGYRHPSPAIVARTVRILHTLLTLVNKHRNCDKFEVNTQSVAYLAALLTVSEEVRSRCSLKHRKSLLLTDISMENVPMDTYPIHHGDPSYRTLKETQPWSSPKGSEGYLAATYPTVGQTSPRARKSMSLDMGQPSQANTKKLLGTRKSFDHLISDTKAPKRQEMESGITTPPKMRRVAETDYEMETQRISSSQQHPHLRKVSVSESNVLLDEEVLTDPKIQALLLTVLATLVKYTTDEFDQRILYEYLAEASVVFPKVFPVVHNLLDSKINTLLSLCQDPNLLNPIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPGIDKENVELSPTTGHCNSGRTRHGSASQVQKQRSAGSFKLALLNLLTAHQNSL

SEQ ID NO: 56390 - protein, 115 aa, Homo sapiens
  Payload ID: 11072
  Gene Symbol: NF1
  Gene Name: neurofibromin 1
  ENSP ID: ENSP00000464702
  MOD_RES (1)..(1): Any amino acid
XIHGIVQSVVYHEESPPQYQTSYLQSFGFNGLWRFAGPFSKQTQIPDYAELIVKFLDALIDTYLPGIDEETSEESLLTPTSPYPPALQSQLSITANLNLSNSMTSLATSQHSPGQ

SEQ ID NO: 56391 - protein, 13 aa, Homo sapiens
  Payload ID: 11072
  Gene Symbol: NF1
  Gene Name: neurofibromin 1
  ENSP ID: ENSP00000465138
  MOD_RES (1)..(1): Any amino acid
XLLNLLTAHQNSL

SEQ ID NO: 56392 - protein, 81 aa, Homo sapiens
  Payload ID: 11072
  Gene Symbol: NF1
  Gene Name: neurofibromin 1
  ENSP ID: ENSP00000467080
  MOD_RES (1)..(1): Any amino acid
XCTFNLKIEGQLLETSGLCIPANNTLFIVSISKTLAANEPHLTLEFLEECISGFSKSRLFFLRLYKNIFAKCLFSRPDSRY

SEQ ID NO: 56393 - protein, 117 aa, Homo sapiens
  Payload ID: 11072
  Gene Symbol: NF1
  Gene Name: neurofibromin 1
  ENSP ID: ENSP00000467284
MRIFGEAAEKNLYLSQLIILDTLEKCLAGQPKDTMRLDETMLVKQLLPEICHFLHTCREGNQHAAELRNSASGVLFSLSCNNFNAVFSRISTRLQELTVCSEDNVDVHDIELLQYIN

SEQ ID NO: 56394 - protein, 507 aa, Homo sapiens
  Payload ID: 11073
  Gene Symbol: NF2
  Gene Name: neurofibromin 2 (merlin)
  Uniprot ID: P35240
  ENSP ID: ENSP00000335652
MAGAIASRMSFSSLKRKQPKTFTVRIVTMDAEMEFNCEVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMERQRLAREKQMREEAERTRDELERRLLQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKPQAQGRRPICI

SEQ ID NO: 56395 - protein, 507 aa, Homo sapiens; identical to SEQ ID NO: 56394
  Payload ID: 11073
  Gene Symbol: NF2
  Gene Name: neurofibromin 2 (merlin)
  Uniprot ID: P35240
  ENSP ID: ENSP00000340626

SEQ ID NO: 56396 - protein, 595 aa, Homo sapiens
  Payload ID: 11073
  Gene Symbol: NF2
  Gene Name: neurofibromin 2 (merlin)
  Uniprot ID: P35240
  ENSP ID: ENSP00000344666
MAGAIASRMSFSSLKRKQPKTFTVRIVTMDAEMEFNCEMKWKGKDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMERQRLAREKQMREEAERTRDELERRLLQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKLTLQSAKSRVAFFEEL

SEQ ID NO: 56397 - protein, 590 aa, Homo sapiens
  Payload ID: 11073
  Gene Symbol: NF2
  Gene Name: neurofibromin 2 (merlin)
  Uniprot ID: P35240
  ENSP ID: ENSP00000354529
MAGAIASRMSFSSLKRKQPKTFTVRIVTMDAEMEFNCEMKWKGKDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMERQRLAREKQMREEAERTRDELERRLLQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKPQAQGRRPICI

SEQ ID NO: 56398 - protein, 549 aa, Homo sapiens
  Payload ID: 11073
  Gene Symbol: NF2
  Gene Name: neurofibromin 2 (merlin)
  Uniprot ID: P35240
  ENSP ID: ENSP00000354897
MAGAIASRMSFSSLKRKQPKTFTVRIVTMDAEMEFNCEMKWKGKDLFDLVCRTLGLRETWFFGLQYTIKDTVAWLKMDKKVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMERQRLAREKQMREEAERTRDELERRLLQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKPQAQGRRPICI

SEQ ID NO: 56399 - protein, 548 aa, Homo sapiens
  Payload ID: 11073
  Gene Symbol: NF2
  Gene Name: neurofibromin 2 (merlin)
  Uniprot ID: P35240
  ENSP ID: ENSP00000355183
MAGAIASRMSFSSLKRKQPKTFTVRIVTMDAEMEFNCEVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMERQRLAREKQMREEAERTRDELERRLLQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKPQAQGRRPICI

SEQ ID NO: 56400 - protein, 590 aa, Homo sapiens; identical to SEQ ID NO: 56397
  Payload ID: 11073
  Gene Symbol: NF2
  Gene Name: neurofibromin 2 (merlin)
  Uniprot ID: P35240
  ENSP ID: ENSP00000380891

SEQ ID NO: 56401 - protein, 561 aa, Homo sapiens
  Payload ID: 11073
  Gene Symbol: NF2
  Gene Name: neurofibromin 2 (merlin)
  Uniprot ID: P35240
  ENSP ID: ENSP00000384029
MAGAIASRMSFSSLKRKQPKTFTVRIVTMDAEMEFNCEMKWKGKDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQMKEEATMANEALMRSEETADLLAEKAQITEEEAKLLAQKAAEAEQEMQRIKATAIRTEEEKRLMEQKVLEAEVLALKMAEESERRAKEADQLKQDLQEAREAERRAKQKLLEIATKPTYPPMNPIPAPLPPDIPSFNLIGDSLSFDFKDTDMKRLSMEIEKEKVEYMEKSKHLQEQLNELKTEIEALKLKERETALDILHNENSDRGGSSKHNTIKKPQAQGRRPICI

SEQ ID NO: 56402 - protein, 590 aa, Homo sapiens; identical to SEQ ID NO: 56397
  Payload ID: 11073
  Gene Symbol: NF2
  Gene Name: neurofibromin 2 (merlin)
  Uniprot ID: P35240
  ENSP ID: ENSP00000384797

SEQ ID NO: 56403 - protein, 220 aa, Homo sapiens
  Payload ID: 11073
  Gene Symbol: NF2
  Gene Name: neurofibromin 2 (merlin)
  Uniprot ID: P35240
  ENSP ID: ENSP00000395885
MAGAIASRMSFSSLKRKQPKTFTVRIVTMDAEMEFNCEVKKQILDEKIYCPPEASVLLASYAVQAKNKKGTELLLGVDALGLHIYDPENRLTPKISFPWNEIRNISYSDKEFTIKPLDKKIDVFKFNSSKLRVNKLILQLCIGNHDLFMRRRKADSLEVQQMKAQAREEKARKQGQRGRSAEAGPAGSTRGGAKSQAEAPGDCHQAHVPAHEPNSSTVAS

SEQ ID NO: 56404 - protein, 165 aa, Homo sapiens
  Payload ID: 11073
  Gene Symbol: NF2
  Gene Name: neurofibromin 2 (merlin)
  Uniprot ID: P35240
  ENSP ID: ENSP00000409921
MAGAIASRMSFSSLKRKQPKTFTVRIVTMDAEMEFNCEMKWKGKDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKLTLQSAKSRVAFFEEL

SEQ ID NO: 56405 - protein, 1020 aa, Homo sapiens
  Payload ID: 11074
  Gene Symbol: NEFH
  Gene Name: neurofilament, heavy polypeptide
  Uniprot ID: P12036
  ENSP ID: ENSP00000311997
MMSFGGADALLGAPFAPLHGGGSLHYALARKGGAGGTRSAAGSSSGFHSWTRTSVSSVSASPSRFRGAGAASSTDSLDTLSNGPEGCMVAVATSRSEKEQLQALNDRFAGYIDKVRQLEAHNRSLEGEAAALRQQQAGRSAMGELYEREVREMRGAVLRLGAARGQLRLEQEHLLEDIAHVRQRLDDEARQREEAEAAARALARFAQEAEAARVDLQKKAQALQEECGYLRRHHQEEVGELLGQIQGSGAAQAQMQAETRDALKCDVTSALREIRAQLEGHAVQSTLQSEEWFRVRLDRLSEAAKVNTDAMRSAQEEITEYRRQLQARTTELEALKSTKDSLERQRSELEDRHQADIASYQEAIQQLDAELRNTKWEMAAQLREYQDLLNVKMALDIEIAAYRKLLEGEECRIGFGPIPFSLPEGLPKIPSVSTHIKVKSEEKIKVVEKSEKETVIVEEQTEETQVTEEVTEEEEKEAKEEEGKEEEGGEEEEAEGGEEETKSPPAEEAASPEKEAKSPVKEEAKSPAEAKSPEKEEAKSPAEVKSPEKAKSPAKEEAKSPPEAKSPEKEEAKSPAEVKSPEKAKSPAKEEAKSPAEAKSPEKAKSPVKEEAKSPAEAKSPVKEEAKSPAEVKSPEKAKSPTKEEAKSPEKAKSPEKEEAKSPEKAKSPVKAEAKSPEKAKSPVKAEAKSPEKAKSPVKEEAKSPEKAKSPVKEEAKSPEKAKSPVKEEAKTPEKAKSPVKEEAKSPEKAKSPEKAKTLDVKSPEAKTPAKEEARSPADKFPEKAKSPVKEEVKSPEKAKSPLKEDAKAPEKEIPKKEEVKSPVKEEEKPQEVKVKEPPKKAEEEKAPATPKTEEKKDSKKEEAPKKEAPKPKVEEKKEPAVEKPKESKVEAKKEEAEDKKKVPTPEKEAPAKVEVKEDAKPKEKTEVAKKEPDDAKAKEPSKPAEKKEAAPEKKDTKEEKAKKPEEKPKTEAKAKEDDKTLSKEPSKPKAEKAEKSSSTDQKDSKPPEKATEDKAAKGK

SEQ ID NO: 56406 - protein, 543 aa, Homo sapiens
  Payload ID: 11075
  Gene Symbol: NEFL
  Gene Name: neurofilament, light polypeptide
  Uniprot ID: P07196
  ENSP ID: ENSP00000482169
MSSFSYEPYYSTSYKRRYVETPRVHISSVRSGYSTARSAYSSYSAPVSSSLSVRRSYSSSSGSLMPSLENLDLSQVAAISNDLKSIRTQEKAQLQDLNDRFASFIERVHELEQQNKVLEAELLVLRQKHSEPSRFRALYEQEIRDLRLAAEDATNEKQALQGEREGLEETLRNLQARYEEEVLSREDAEGRLMEARKGADEAALARAELEKRIDSLMDEISFLKKVHEEEIAELQAQIQYAQISVEMDVTKPDLSAALKDIRAQYEKLAAKNMQNAEEWFKSRFTVLTESAAKNTDAVRAAKDEVSESRRLLKAKTLEIEACRGMNEALEKQLQELEDKQNADISAMQDTINKLENELRTTKSEMARYLKEYQDLLNVKMALDIEIAAYRKLLEGEETRLSFTSVGSITSGYSQSSQVFGRSAYGGLQTSSYLMSTRSFPSYYTSHVQEEQIEVEETIEAAKAEEAKDEPPSEGEAEEEEKDKEEAEEEEAAEEEEAAKEESEEAKEEEEGGEGEEGEETKEAEEEEKKVEGAGEEQAAKKKD

SEQ ID NO: 56407 - protein, 284 aa, Homo sapiens
  Payload ID: 11075
  Gene Symbol: NEFL
  Gene Name: neurofilament, light polypeptide
  ENSP ID: ENSP00000483690
MSSFSYEPYYSTSYKRRYVETPRVHISSVRSGYSTARSAYSSYSAPVSSSLSVRRSYSSSSGSLMPSLENLDLSQVAAISNDLKSIRTQEKAQLQDLNDRFASFIERVHELEQQNKVLEAELLVLRQKHSEPSRFRALYEQEIRDLRLAAEDATNEKQALQGEREGLEETLRNLQARYEEEVLSREDAEGRLMEARKAAKNTDAVRAAKDEVSESRRLLKAKTLEIEACRGMNEALEKQLQELEDKQNADISAMQDTINKLENELRTTKSEMARYLKEYQDLLT

SEQ ID NO: 56408 - protein, 916 aa, Homo sapiens
  Payload ID: 11076
  Gene Symbol: NEFM
  Gene Name: neurofilament, medium polypeptide
  Uniprot ID: P07197
  ENSP ID: ENSP00000221166
MSYTLDSLGNPSAYRRVTETRSSFSRVSGSPSSGFRSQSWSRGSPSTVSSSYKRSMLAPRLAYSSAMLSSAESSLDFSQSSSLLNGGSGPGGDYKLSRSNEKEQLQGLNDRFAGYIEKVHYLEQQNKEIEAEIQALRQKQASHAQLGDAYDQEIRELRATLEMVNHEKAQVQLDSDHLEEDIHRLKERFEEEARLRDDTEAAIRALRKDIEEASLVKVELDKKVQSLQDEVAFLRSNHEEEVADLLAQIQASHITVERKDYLKTDISTALKEIRSQLESHSDQNMHQAEEWFKCRYAKLTEAAEQNKEAIRSAKEEIAEYRRQLQSKSIELESVRGTKESLERQLSDIEERHNHDLSSYQDTIQQLENELRGTKWEMARHLREYQDLLNVKMALDIEIAAYRKLLEGEETRFSTFAGSITGPLYTHRPPITISSKIQKPKVEAPKLKVQHKFVEEIIEETKVEDEKSEMEEALTAITEELAVSMKEEKKEAAEEKEEEPEAEEEEVAAKKSPVKATAPEVKEEEGEKEEEEGQEEEEEEDEGAKSDQAEEGGSEKEGSSEKEEGEQEEGETEAEAEGEEAEAKEEKKVEEKSEEVATKEELVADAKVEKPEKAKSPVPKSPVEEKGKSPVPKSPVEEKGKSPVPKSPVEEKGKSPVPKSPVEEKGKSPVSKSPVEEKAKSPVPKSPVEEAKSKAEVGKGEQKEEEEKEVKEAPKEEKVEKKEEKPKDVPEKKKAESPVKEEAVAEVVTITKSVKVHLEKETKEEGKPLQQEKEKEKAGGEGGSEEEGSDKGAKGSRKEDIAVNGEVEGKEEVEQETKEKGSGREEEKGVVTNGLDLSPADEKKGGDKSEEKVVVTKTVEKITSEGGDGATKYITKSVTVTQKVEEHEETFEEKLVSTKKVEKVTSHAIVKEVTQSD

SEQ ID NO: 56409 - protein, 877 aa, Homo sapiens
  Payload ID: 11076
  Gene Symbol: NEFM
  Gene Name: neurofilament, medium polypeptide
  ENSP ID: ENSP00000410137
MSYTLDSLGNPSAYRRVTETRSSFSRVSGSPSSGFRSQSWSRGSPSTVSSSYKRSMLAPRLAYSSAMLSSAESSLDFSQSSSLLNGGSGPGGDYKLSRSNEKEQLQGLNDRFAGYIEKVHYLEQQNKEIEAEIQALRQKQASHAQLGDAYDQEIRELRATLEMVNHEKAQVQLDSDHLEEDIHRLKERFEEEARLRDDTEAAIRALRKDIEEASLVKVELDKKVQSLQDEVAFLRSNHEEEVADLLAQIQASHITVERKDYLKTDISTALKEIRSQLESHSDQNMHQAEEWFKCRYAKLTEAAEQNKEAIRSAKEEIAEYRRQLQSKSIELESVRGTKESLERQLSDIEERHNHDLSSYQDTIQQLENELRGTKWEMARHLREYQDLLNVKMALDIEIAAYRKLLEGEETRFSTFAGSITGPLYTHRPPITISSKIQKPKVEAPKLKVQHKFVEEIIEETKVEDEKSEMEEALTAITEELAVSMKEEKKEAAEEKEEEPEAEEEEVAAKKSPVKATAPEVKEEEGEKEEEEGQEEEEEEDEGAKSDQAEEGGSEKEGSSEKEEGEQEEGETEAEAEGEEAEAKEEKKVEEKSEEVATKEELVADAKVEKPEKAKSPVPKSPVEEKGKSPVSKSPVEEKAKSPVPKSPVEEAKSKAEVGKGEQKEEEEKEVKEAPKEEKVEKKEEKPKDVPEKKKAESPVKEEAVAEVVTITKSVKVHLEKETKEEGKPLQQEKEKEKAGGEGGSEEEGSDKGAKGSRKEDIAVNGEVEGKEEVEQETKEKGSGREEEKGVVTNGLDLSPADEKKGGDKSEEKVVVTKTVEKITSEGGDGATKYITKSVTVTQKVEEHEETFEEKLVSTKKVEKVTSHAIVKEVTQSD

SEQ ID NO: 56410 - protein, 540 aa, Homo sapiens
  Payload ID: 11076
  Gene Symbol: NEFM
  Gene Name: neurofilament, medium polypeptide
  Uniprot ID: P07197
  ENSP ID: ENSP00000412295
MARHLREYQDLLNVKMALDIEIAAYRKLLEGEETRFSTFAGSITGPLYTHRPPITISSKIQKPKVEAPKLKVQHKFVEEIIEETKVEDEKSEMEEALTAITEELAVSMKEEKKEAAEEKEEEPEAEEEEVAAKKSPVKATAPEVKEEEGEKEEEEGQEEEEEEDEGAKSDQAEEGGSEKEGSSEKEEGEQEEGETEAEAEGEEAEAKEEKKVEEKSEEVATKEELVADAKVEKPEKAKSPVPKSPVEEKGKSPVPKSPVEEKGKSPVPKSPVEEKGKSPVPKSPVEEKGKSPVSKSPVEEKAKSPVPKSPVEEAKSKAEVGKGEQKEEEEKEVKEAPKEEKVEKKEEKPKDVPEKKKAESPVKEEAVAEVVTITKSVKVHLEKETKEEGKPLQQEKEKEKAGGEGGSEEEGSDKGAKGSRKEDIAVNGEVEGKEEVEQETKEKGSGREEEKGVVTNGLDLSPADEKKGGDKSEEKVVVTKTVEKITSEGGDGATKYITKSVTVTQKVEEHEETFEEKLVSTKKVEKVTSHAIVKEVTQSD

SEQ ID NO: 56411 - protein, 698 aa, Homo sapiens
  Payload ID: 11076
  Gene Symbol: NEFM
  Gene Name: neurofilament, medium polypeptide
  ENSP ID: ENSP00000427872
MSYTLDSLGNPSAYRRVTETRSSFSRVSGSPSSGFRSQSWSRGSPSTVSSSYKRSMLAPRLAYSSAMLSSAESSLDFSQSSSLLNGGSGPGGDYKLSRSNEKEQLQGLNDRFAGYIEKVHYLEQQNKEIEAEIQALRQKQASHAQLGDAYDQEIRELRATLEMVNHEKAQVQLDSDHLEEDIHRLKERFEEEARLRDDTEAAIRALRKDIEEASLVKVELDKKVQSLQDEVAFLRSNHEEEVADLLAQIQASHITVERKDYLKTDISTALKEIRSQLESHSDQNMHQAEEWFKCRYAKLTEAAEQNKEAIRSAKEEIAEYRRQLQSKSIELESVRGTKESLERQLSDIEERHNHDLSSYQDTIQQLENELRGTKWEMARHLREYQDLLNVKMALDIEIAAYRKLLEGEETRFSTFAGSITGPLYTHRPPITISSKIQKPKVEAPKLKVQHKFVEEIIEETKVEDEKSEMEEALTAITEELAVSMKEEKKEAAEEKEEEPEAEEEEVAAKKSPVKATAPEVKEEEGEKEEEEGQEEEEEEDEGAKSDQAEEGGSEKEGSSEKEEGEQEEGETEAEAEGEEAEAKEEKKVEGKEEVEQETKEKGSGREEEKGVVTNGLDLSPADEKKGGDKSEEKVVVTKTVEKITSEGGDGATKYITKSVTVTQKVEEHEETFEEKLVSTKKVEKVTSHAIVKEVTQSD

SEQ ID NO: 56412 - protein, 237 aa, Homo sapiens
  Payload ID: 11077
  Gene Symbol: NEUROG1
  Gene Name: neurogenin 1
  Uniprot ID: Q92886
  ENSP ID: ENSP00000317580
MPARLETCISDLDCASSSGSDLSGFLTDEEDCARLQQAASASGPPAPARRGAPNISRASEVPGAQDDEQERRRRRGRTRVRSEALLHSLRRSRRVKANDRERNRMHNLNAALDALRSVLPSFPDDTKLTKIETLRFAYNYIWALAETLRLADQGLPGGGARERLLPPQCVPCLPGPPSPASDAESWGSGAAAASPLSDPSSPAASEDFTYRPGDPVFSFPSLPKDLLHTTPCFIPYH

SEQ ID NO: 56413 - protein, 272 aa, Homo sapiens
  Payload ID: 11078
  Gene Symbol: NEUROG2
  Gene Name: neurogenin 2
  Uniprot ID: Q9H2A3
  ENSP ID: ENSP00000317333
MFVKSETLELKEEEDVLVLLGSASPALAALTPLSSSADEEEEEEPGASGGARRQRGAEAGQGARGGVAAGAEGCRPARLLGLVHDCKRRPSRARAVSRGAKTAETVQRIKKTRRLKANNRERNRMHNLNAALDALREVLPTFPEDAKLTKIETLRFAHNYIWALTETLRLADHCGGGGGGLPGALFSEAVLLSPGGASAALSSSGDSPSPASTWSCTNSPAPSSSVSSNSTSPYSCTLSPASPAGSDMDYWQPPPPDKHRYAPHLPIARDCI

SEQ ID NO: 56414 - protein, 214 aa, Homo sapiens
  Payload ID: 11079
  Gene Symbol: NEUROG3
  Gene Name: neurogenin 3
  Uniprot ID: Q9Y4Z2
  ENSP ID: ENSP00000242462
MTPQPSGAPTVQVTRETERSFPRASEDEVTCPTSAPPSPTRTRGNCAEAEEGGCRGAPRKLRARRGGRSRPKSELALSKQRRSRRKKANDRERNRMHNLNSALDALRGVLPTFPDDAKLTKIETLRFAHNYIWALTQTLRIADHSLYALEPPAPHCGELGSPGGSPGDWGSLYSPVSQAGSLSPAASLEERPGLLGATFSACLSPGSLAFSDFL

SEQ ID NO: 56415 - protein, 151 aa, Homo sapiens
  Payload ID: 11080
  Gene Symbol: NGB
  Gene Name: neuroglobin
  Uniprot ID: Q9NPG2
  ENSP ID: ENSP00000298352
MERPEPELIRQSWRAVSRSPLEHGTVLFARLFALEPDLLPLFQYNCRQFSSPEDCLSSPEFLDHIRKVMLVIDAAVTNVEDLSSLEEYLASLGRKHRAVGVKLSSFSTVGESLLYMLEKCLGPAFTPATRAAWSQLYGAVVQAMSRGWDGE

SEQ ID NO: 56416 - protein, 78 aa, Homo sapiens
  Payload ID: 11081
  Gene Symbol: NRGN
  Gene Name: neurogranin (protein kinase C substrate, RC3)
  Uniprot ID: Q92686
  ENSP ID: ENSP00000284292
MDCCTENACSKPDDDILDIPLDDPGANAAAAKIQASFRGHMARKKIKSGERGRKGPGPGGPGGAGVARGGAGGGPSGD

SEQ ID NO: 56417 - protein, 78 aa, Homo sapiens; identical to SEQ ID NO: 56416
  Payload ID: 11081
  Gene Symbol: NRGN
  Gene Name: neurogranin (protein kinase C substrate, RC3)
  Uniprot ID: Q92686
  ENSP ID: ENSP00000399591

SEQ ID NO: 56418 - protein, 311 aa, Homo sapiens
  Payload ID: 11082
  Gene Symbol: NGDN
  Gene Name: neuroguidin, EIF4E binding protein
  Uniprot ID: Q8NEJ9
  ENSP ID: ENSP00000380340
MAALGVLESDLPSAVTLLKNLQEQVMAVTAQVKSLTQKVQAGAYPTEKGLSFLEVKDQLLLMYLMDLTHLILDKASGGSLQGHDAVLRLVEIRTVLEKLRPLDQKLKYQIDKLIKTAVTGSLSENDPLRFKPHPSNMMSKLSSEDEEEDEAEDDQSEASGKKSVKGVSKKYVPPRLVPVHYDETEAEREKKRLERAKRRALSSSVIRELKEQYSDAPEEIRDARHPHVTRQSQEDQHRINYEESMMVRLSVSKREKGRRKRANVMSSQLHSLTHFSDISALTGGTVHLDEDQNPIKKRKKIPQKGRKKKGQ

SEQ ID NO: 56419 - protein, 315 aa, Homo sapiens
  Payload ID: 11082
  Gene Symbol: NGDN
  Gene Name: neuroguidin, EIF4E binding protein
  Uniprot ID: Q8NEJ9
  ENSP ID: ENSP00000386134
MAALGVLESDLPSAVTLLKNLQEQVMAVTAQVKSLTQKVQAGAYPTEKGLSFLEVKDQLLLMYLMDLTHLILDKASGGSLQGHDAVLRLVEIRTVLEKLRPLDQKLKYQIDKLIKTAVTGSLSENDPLRFKPHPSNMMSKLSSEDEEEDEAEDDQSEASGKKSVKGVSKKYVPPRLVPVHYDETEAEREKKRLERAKRRALSSSVIRELKEQYSDAPEEIRDARHPHVTRQSQEDQHRINYEESMMVRLSVSKREKGRRKRANVMSSQLHSLTHFSDISALTGGTVHLDEDQNPIKKRKKIPQKGRKKKGFRRRR

SEQ ID NO: 56420 - protein, 263 aa, Homo sapiens
  Payload ID: 11082
  Gene Symbol: NGDN
  Gene Name: neuroguidin, EIF4E binding protein
  ENSP ID: ENSP00000450659
  MOD_RES (1)..(1): Any amino acid
XESDLPSAVTLLKNLQEQVMAVTAQVKSLTQKVQAGAYPTEKGLSFLEVKDQLLLMYLMDLTHLILDKASGGSLQGHDAVLRLVEIRTLSSEDEEEDEAEDDQSEASGKKSVKGVSKKYVPPRLVPVHYDETEAEREKKRLERAKRRALSSSVIRELKEQYSDAPEEIRDARHPHVTRQSQEDQHRINYEESMMVRLSVSKREKGRRKRANVMSSQLHSLTHFSDISALTGGTVHLDEDQNPIKKRKKIPQKGRKKKGFRRRR

SEQ ID NO: 56421 - protein, 141 aa, Homo sapiens
  Payload ID: 11082
  Gene Symbol: NGDN
  Gene Name: neuroguidin, EIF4E binding protein
  ENSP ID: ENSP00000451779
MAVTAQVKSLTQKVQAGAYPTEKGLSFLEVKDQLLLMYLMDLTHLILDKASGGSLQGHDAVLRLVEIRTVLEKLRPLDQKLKYQIDKLIKTAVTGSLSENDPLRFKPHPSNMMSKLSSEDEEEDEAEDDQSEASGKKSVKG

SEQ ID NO: 56422 - protein, 74 aa, Homo sapiens
  Payload ID: 11082
  Gene Symbol: NGDN
  Gene Name: neuroguidin, EIF4E binding protein
  ENSP ID: ENSP00000451942
ESMMVRLSVSKREKGRRKRANVMSSQLHSLTHFSDISALTGGTVHLDEDQNPIKKRKKIPQKGRKKKALECLCY

SEQ ID NO: 56423 - protein, 823 aa, Homo sapiens
  Payload ID: 11083
  Gene Symbol: NLGN1
  Gene Name: neuroligin 1
  Uniprot ID: Q8N2Q7
  ENSP ID: ENSP00000354541
MALPRCTWPNYVWRAVMACLVHRGLGAPLTLCMLGCLLQAGHVLSQKLDDVDPLVATNFGKIRGIKKELNNEILGPVIQFLGVPYAAPPTGERRFQPPEPPSPWSDIRNATQFAPVCPQNIIDGRLPEVMLPVWFTNNLDVVSSYVQDQSEDCLYLNIYVPTEDDIRDSGGPKPVMVYIHGGSYMEGTGNLYDGSVLASYGNVIVITVNYRLGVLGFLSTGDQAAKGNYGLLDLIQALRWTSENIGFFGGDPLRITVFGSGAGGSCVNLLTLSHYSEGNRWSNSTKGLFQRAIAQSGTALSSWAVSFQPAKYARMLATKVGCNVSDTVELVECLQKKPYKELVDQDIQPARYHIAFGPVIDGDVIPDDPQILMEQGEFLNYDIMLGVNQGEGLKFVENIVDSDDGISASDFDFAVSNFVDNLYGYPEGKDVLRETIKFMYTDWADRHNPETRRKTLLALFTDHQWVAPAVATADLHSNFGSPTYFYAFYHHCQTDQVPAWADAAHGDEVPYVLGIPMIGPTELFPCNFSKNDVMLSAVVMTYWTNFAKTGDPNQPVPQDTKFIHTKPNRFEEVAWTRYSQKDQLYLHIGLKPRVKEHYRANKVNLWLELVPHLHNLNDISQYTSTTTKVPSTDITFRPTRKNSVPVTSAFPTAKQDDPKQQPSPFSVDQRDYSTELSVTIAVGASLLFLNILAFAALYYKKDKRRHDVHRRCSPQRTTTNDLTHAQEEEIMSLQMKHTDLDHECESIHPHEVVLRTACPPDYTLAMRRSPDDVPLMTPNTITMIPNTIPGIQPLHTFNTFTGGQNNTLPHPHPHPHSHSTTRV

SEQ ID NO: 56424 - protein, 608 aa, Homo sapiens
  Payload ID: 11083
  Gene Symbol: NLGN1
  Gene Name: neuroligin 1
  ENSP ID: ENSP00000385750
GFLSTGDQAAKGNYGLLDLIQALRWTSENIGFFGGDPLRITVFGSGAGGSCVNLLTLSHYSEGNRWSNSTKGLFQRAIAQSGTALSSWAVSFQPAKYARMLATKVGCNVSDTVELVECLQKKPYKELVDQDIQPARYHIAFGPVIDGDVIPDDPQILMEQGEFLNYDIMLGVNQGEGLKFVENIVDSDDGISASDFDFAVSNFVDNLYGYPEGKDVLRETIKFMYTDWADRHNPETRRKTLLALFTDHQWVAPAVATADLHSNFGSPTYFYAFYHHCQTDQVPAWADAAHGDEVPYVLGIPMIGPTELFPCNFSKNDVMLSAVVMTYWTNFAKTGDPNQPVPQDTKFIHTKPNRFEEVAWTRYSQKDQLYLHIGLKPRVKEHYRANKVNLWLELVPHLHNLNDISQYTSTTTKVPSTDITFRPTRKNSVPVTSAFPTAKQDDPKQQPSPFSVDQRDYSTELSVTIAVGASLLFLNILAFAALYYKKDKRRHDVHRRCSPQRTTTNDLTHAQEEEIMSLQMKHTDLDHECESIHPHEVVLRTACPPDYTLAMRRSPDDVPLMTPNTITMIPNTIPGIQPLHTFNTFTGGQNNTLPHPHPHPHSHSTTRV

SEQ ID NO: 56425 - protein, 823 aa, Homo sapiens; identical to SEQ ID NO: 56423
  Payload ID: 11083
  Gene Symbol: NLGN1
  Gene Name: neuroligin 1
  Uniprot ID: Q8N2Q7
  ENSP ID: ENSP00000392500

SEQ ID NO: 56426 - protein, 10 aa, Homo sapiens
  Payload ID: 11083
  Gene Symbol: NLGN1
  Gene Name: neuroligin 1
  ENSP ID: ENSP00000401843
MALPRCTWPN

SEQ ID NO: 56427 - protein, 13 aa, Homo sapiens
  Payload ID: 11083
  Gene Symbol: NLGN1
  Gene Name: neuroligin 1
  ENSP ID: ENSP00000407255
MALPRCTWPNYVW

SEQ ID NO: 56428 - protein, 367 aa, Homo sapiens
  Payload ID: 11083
  Gene Symbol: NLGN1
  Gene Name: neuroligin 1
  ENSP ID: ENSP00000410374
MALPRCTWPNYVWRAVMACLVHRGLGAPLTLCMLGCLLQAGHVLSQKLDDVDPLVATNFGKIRGIKKELNNEILGPVIQFLGVPYAAPPTGERRFQPPEPPSPWSDIRNATQFAPVCPQNIIDGRLPEVMLPVWFTNNLDVVSSYVQDQSEDCLYLNIYVPTEDVKRISKECARKPGKKICRKGGPLTKKQTDDLGDNDGAEDEDIRDSGGPKPVMVYIHGGSYMEGTGNLYDGSVLASYGNVIVITVNYRLGVLGFLSTGDQAAKGNYGLLDLIQALRWTSENIGFFGGDPLRITVFGSGAGGSCVNLLTLSHYSEGNRWSNSTKGLFQRAIAQSGTALSSWAVSFQPAKYARMLATKVGCNVSDT

SEQ ID NO: 56429 - protein, 835 aa, Homo sapiens
  Payload ID: 11084
  Gene Symbol: NLGN2
  Gene Name: neuroligin 2
  Uniprot ID: Q8NFZ4
  ENSP ID: ENSP00000305288
MWLLALCLVGLAGAQRGGGGPGGGAPGGPGLGLGSLGEERFPVVNTAYGRVRGVRRELNNEILGPVVQFLGVPYATPPLGARRFQPPEAPASWPGVRNATTLPPACPQNLHGALPAIMLPVWFTDNLEAAATYVQNQSEDCLYLNLYVPTEDGPLTKKRDEATLNPPDTDIRDPGKKPVMLFLHGGSYMEGTGNMFDGSVLAAYGNVIVATLNYRLGVLGFLSTGDQAAKGNYGLLDQIQALRWLSENIAHFGGDPERITIFGSGAGASCVNLLILSHHSEGLFQKAIAQSGTAISSWSVNYQPLKYTRLLAAKVGCDREDSAEAVECLRRKPSRELVDQDVQPARYHIAFGPVVDGDVVPDDPEILMQQGEFLNYDMLIGVNQGEGLKFVEDSAESEDGVSASAFDFTVSNFVDNLYGYPEGKDVLRETIKFMYTDWADRDNGEMRRKTLLALFTDHQWVAPAVATAKLHADYQSPVYFYTFYHHCQAEGRPEWADAAHGDELPYVFGVPMVGATDLFPCNFSKNDVMLSAVVMTYWTNFAKTGDPNQPVPQDTKFIHTKPNRFEEVVWSKFNSKEKQYLHIGLKPRVRDNYRANKVAFWLELVPHLHNLHTELFTTTTRLPPYATRWPPRPPAGAPGTRRPPPPATLPPEPEPEPGPRAYDRFPGDSRDYSTELSVTVAVGASLLFLNILAFAALYYKRDRRQELRCRRLSPPGGSGSGVPGGGPLLPAAGRELPPEEELVSLQLKRGGGVGADPAEALRPACPPDYTLALRRAPDDVPLLAPGALTLLPSGLGPPPPPPPPSLHPFGPFPPPPPTATSHNNTLPHPHSTTRV

SEQ ID NO: 56430 - protein, 194 aa, Homo sapiens
  Payload ID: 11084
  Gene Symbol: NLGN2
  Gene Name: neuroligin 2
  ENSP ID: ENSP00000461092
  MOD_RES (1)..(1): Any amino acid
XAATYVQNQSEDCLYLNLYVPTEDDIRDPGKKPVMLFLHGGSYMEGTGNMFDGSVLAAYGNVIVATLNYRLGVLGFLSTGDQAAKGNYGLLDQIQALRWLSENIAHFGGDPERITIFGSGAGASCVNLLILSHHSEGLFQKAIAQSGTAISSWSVNYQPLKYTRLLAAKVGCDREDSAEAVECLRRKPSRELVD

SEQ ID NO: 56431 - protein, 835 aa, Homo sapiens; identical to SEQ ID NO: 56429
  Payload ID: 11084
  Gene Symbol: NLGN2
  Gene Name: neuroligin 2
  Uniprot ID: Q8NFZ4
  ENSP ID: ENSP00000461168

SEQ ID NO: 56432 - protein, 848 aa, Homo sapiens
  Payload ID: 11085
  Gene Symbol: NLGN3
  Gene Name: neuroligin 3
  Uniprot ID: Q9NZ94
  ENSP ID: ENSP00000351591
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDVKRISKECARKPNKKICRKGGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 56433 - protein, 828 aa, Homo sapiens
  Payload ID: 11085
  Gene Symbol: NLGN3
  Gene Name: neuroligin 3
  Uniprot ID: Q9NZ94
  ENSP ID: ENSP00000363163
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 56434 - protein, 513 aa, Homo sapiens
  Payload ID: 11085
  Gene Symbol: NLGN3
  Gene Name: neuroligin 3
  ENSP ID: ENSP00000379196
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVML

SEQ ID NO: 56435 - protein, 808 aa, Homo sapiens
  Payload ID: 11085
  Gene Symbol: NLGN3
  Gene Name: neuroligin 3
  Uniprot ID: Q9NZ94
  ENSP ID: ENSP00000445298
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 56436 - protein, 351 aa, Homo sapiens
  Payload ID: 11085
  Gene Symbol: NLGN3
  Gene Name: neuroligin 3
  ENSP ID: ENSP00000479877
MLPVWFTANLDIVATYIQEPNEDCLYLNVYVPTEDGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSILWTICMAILRVRTPCERPSSSCIQTGQTVTTLRPAVKHWWHSSLTTSGWSPQW

SEQ ID NO: 56437 - protein, 816 aa, Homo sapiens
  Payload ID: 11086
  Gene Symbol: NLGN4X
  Gene Name: neuroligin 4, X-linked
  Uniprot ID: Q8N0W4
  ENSP ID: ENSP00000275857
MSRPQGLLWLPLLFTPVCVMLNSNVLLWLTALAIKFTLIDSQAQYPVVNTNYGKIRGLRTPLPNEILGPVEQYLGVPYASPPTGERRFQPPEPPSSWTGIRNTTQFAAVCPQHLDERSLLHDMLPIWFTANLDTLMTYVQDQNEDCLYLNIYVPTEDDIHDQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLRNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRRPSPQRNTTNDIAHIQNEEIMSLQMKQLEHDHECESLQAHDTLRLTCPPDYTLTLRRSPDDIPLMTPNTITMIPNTLTGMQPLHTFNTFSGGQNSTNLPHGHSTTRV

SEQ ID NO: 56438 - protein, 816 aa, Homo sapiens; identical to SEQ ID NO: 56437
  Payload ID: 11086
  Gene Symbol: NLGN4X
  Gene Name: neuroligin 4, X-linked
  Uniprot ID: Q8N0W4
  ENSP ID: ENSP00000370482

SEQ ID NO: 56439 - protein, 816 aa, Homo sapiens; identical to SEQ ID NO: 56437
  Payload ID: 11086
  Gene Symbol: NLGN4X
  Gene Name: neuroligin 4, X-linked
  Uniprot ID: Q8N0W4
  ENSP ID: ENSP00000370483

SEQ ID NO: 56440 - protein, 816 aa, Homo sapiens; identical to SEQ ID NO: 56437
  Payload ID: 11086
  Gene Symbol: NLGN4X
  Gene Name: neuroligin 4, X-linked
  Uniprot ID: Q8N0W4
  ENSP ID: ENSP00000370485

SEQ ID NO: 56441 - protein, 817 aa, Homo sapiens
  Payload ID: 11086
  Gene Symbol: NLGN4X
  Gene Name: neuroligin 4, X-linked
  ENSP ID: ENSP00000439203
MLNSNVLLWLTALAIKFTLIDSQAQYPVVNTNYGKIRGLRTPLPNEILGPVEQYLGVPYASPPTGERRFQPPEPPSSWTGIRNTTQFAAVCPQHLDERSLLHDMLPIWFTANLDTLMTYVQDQNEDCLYLNIYVPTEDGANTKKNADDITSNDRGEDEDIHDQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLRNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRRPSPQRNTTNDIAHIQNEEIMSLQMKQLEHDHECESLQAHDTLRLTCPPDYTLTLRRSPDDIPLMTPNTITMIPNTLTGMQPLHTFNTFSGGQNSTNLPHGHSTTRV

SEQ ID NO: 56442 - protein, 256 aa, Homo sapiens
  Payload ID: 11087
  Gene Symbol: NLGN4Y
  Gene Name: neuroligin 4, Y-linked
  Uniprot ID: Q8NFZ3
  ENSP ID: ENSP00000297967
MLRPQGLLWLPLLFTSVCVMLNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDGTNIKRNADDITSNDHGEDKDIHEQNSKKPVMVYIHGGSYMEGTGNMIDGSILASYGNVIVITINYRLGILGMQEARLCGSSKMFNYFKSPFTNLINFF

SEQ ID NO: 56443 - protein, 816 aa, Homo sapiens
  Payload ID: 11087
  Gene Symbol: NLGN4Y
  Gene Name: neuroligin 4, Y-linked
  Uniprot ID: Q8NFZ3
  ENSP ID: ENSP00000342535
MLRPQGLLWLPLLFTSVCVMLNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDDIHEQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLKNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRHPSPQRNTTNDITHIQNEEIMSLQMKQLEHDHECESLQAHDTLRLTCPPDYTLTLRRSPDDIPFMTPNTITMIPNTLMGMQPLHTFKTFSGGQNSTNLPHGHSTTRV

SEQ ID NO: 56444 - protein, 816 aa, Homo sapiens; identical to SEQ ID NO: 56443
  Payload ID: 11087
  Gene Symbol: NLGN4Y
  Gene Name: neuroligin 4, Y-linked
  Uniprot ID: Q8NFZ3
  ENSP ID: ENSP00000348169

SEQ ID NO: 56445 - protein, 873 aa, Homo sapiens
  Payload ID: 11087
  Gene Symbol: NLGN4Y
  Gene Name: neuroligin 4, Y-linked
  ENSP ID: ENSP00000372320
MLRPQGLLWLPLLFTSVCVMLNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDGTNIKRNADDITSNDHGEDKDIHEQNSKKPVMVYIHGGSYMEGTGNMIDGSILASYGNVIVITINYRLGILAQNTLAHGNCKHRCQLHLQAPRDCKSAYPFRNEDEIRGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLKNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRHPSPQRNTTNDITHIQNEEIMSLQMKQLEHDHECESLQAHDTLRLTCPPDYTLTLRRSPDDIPFMTPNTITMIPNTLMGMQPLHTFKTFSGGQNSTNLPHGHSTTRV

SEQ ID NO: 56446 - protein, 648 aa, Homo sapiens
  Payload ID: 11087
  Gene Symbol: NLGN4Y
  Gene Name: neuroligin 4, Y-linked
  Uniprot ID: Q8NFZ3
  ENSP ID: ENSP00000372325
MVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLKNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRHPSPQRNTTNDITHIQNEEIMSLQMKQLEHDHECESLQAHDTLRLTCPPDYTLTLRRSPDDIPFMTPNTITMIPNTLMGMQPLHTFKTFSGGQNSTNLPHGHSTTRV

SEQ ID NO: 56447 - protein, 236 aa, Homo sapiens
  Payload ID: 11087
  Gene Symbol: NLGN4Y
  Gene Name: neuroligin 4, Y-linked
  ENSP ID: ENSP00000412638
  MOD_RES (1)..(1): Any amino acid
XNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDGTNIKRNADDITSNDHGEDKDIHEQNSKKPVMVYIHGGSYMEGTGNMIDGSILASYGNVIVITINYRLGILGMQEARLCGSSKMFNYFKSPFTNLINFF

SEQ ID NO: 56448 - protein, 704 aa, Homo sapiens
  Payload ID: 11088
  Gene Symbol: NLN
  Gene Name: neurolysin (metallopeptidase M3 family)
  Uniprot ID: Q9BYT8
  ENSP ID: ENSP00000370372
MIARCLLAVRSLRRVGGSRILLRMTLGREVMSPLQAMSSYTVAGRNVLRWDLSPEQIKTRTEELIVQTKQVYDAVGMLGIEEVTYENCLQALADVEVKYIVERTMLDFPQHVSSDKEVRAASTEADKRLSRFDIEMSMRGDIFERIVHLQETCDLGKIKPEARRYLEKSIKMGKRNGLHLPEQVQNEIKSMKKRMSELCIDFNKNLNEDDTFLVFSKAELGALPDDFIDSLEKTDDDKYKITLKYPHYFPVMKKCCIPETRRRMEMAFNTRCKEENTIILQQLLPLRTKVAKLLGYSTHADFVLEMNTAKSTSRVTAFLDDLSQKLKPLGEAEREFILNLKKKECKDRGFEYDGKINAWDLYYYMTQTEELKYSIDQEFLKEYFPIEVVTEGLLNTYQELLGLSFEQMTDAHVWNKSVTLYTVKDKATGEVLGQFYLDLYPREGKYNHAACFGLQPGCLLPDGSRMMAVAALVVNFSQPVAGRPSLLRHDEVRTYFHEFGHVMHQICAQTDFARFSGTNVETDFVEVPSQMLENWVWDVDSLRRLSKHYKDGSPIADDLLEKLVASRLVNTGLLTLRQIVLSKVDQSLHTNTSLDAASEYAKYCSEILGVAATPGTNMPATFGHLAGGYDGQYYGYLWSEVFSMDMFYSCFKKEGIMNPEVGMKYRNLILKPGGSLDGMDMLHNFLKREPNQKAFLMSRGLHAP

SEQ ID NO: 56449 - protein, 48 aa, Homo sapiens
  Payload ID: 11088
  Gene Symbol: NLN
  Gene Name: neurolysin (metallopeptidase M3 family)
  ENSP ID: ENSP00000422822
MIARCLLAVRSLRRWSLALLPRLVCSGVILAHCSLCLPGSSDSPASAT

SEQ ID NO: 56450 - protein, 600 aa, Homo sapiens
  Payload ID: 11088
  Gene Symbol: NLN
  Gene Name: neurolysin (metallopeptidase M3 family)
  ENSP ID: ENSP00000423214
MLDFPQHVSSDKEVRAASTEADKRLSRFDIEMSMRGDIFERIVHLQETCDLGKIKPEARRYLEKSIKMGKRNGLHLPEQVQNEIKSMKKRMSELCIDFNKNLNEDDTFLVFSKAELGALPDDFIDSLEKTDDDKYKITLKYPHYFPVMKKCCIPETRRRMEMAFNTRCKEENTIILQQLLPLRTKVAKLLGYSTHADFVLEMNTAKSTSRVTAFLDDLSQKLKPLGEAEREFILNLKKKECKDRGFEYDGKINAWDLYYYMTQTEELKYSIDQEFLKEYFPIEVVTEGLLNTYQELLGLSFEQMTDAHVWNKSVTLYTVKDKATGEVLGQFYLDLYPREGKYNHAACFGLQPGCLLPDGSRMMAVAALVVNFSQPVAGRPSLLRHDEVRTYFHEFGHVMHQICAQTDFARFSGTNVETDFVEVPSQMLENWVWDVDSLRRLSKHYKDGSPIADDLLEKLVASRLVNTGLLTLRQIVLSKVDQSLHTNTSLDAASEYAKYCSEILGVAATPGTNMPATFGHLAGGYDGQYYGYLWSEVFSMDMFYSCFKKEGIMNPEVGMKYRNLILKPGGSLDGMDMLHNFLKREPNQKAFLMSRGLHAP

SEQ ID NO: 56451 - protein, 283 aa, Homo sapiens
  Payload ID: 11088
  Gene Symbol: NLN
  Gene Name: neurolysin (metallopeptidase M3 family)
  ENSP ID: ENSP00000426959
GLSFEQMTDAHVWNKSVTLYTVKDKATGEVLGQFYLDLYPREGKYNHAACFGLQPGCLLPDGSRMMAVAALVVNFSQPVAGRPSLLRHDEVRTYFHEFGHVMHQICAQTDFARFSGTNVETDFVEVPSQMLENWVWDVDSLRRLSKHYKDGSPIADDLLEKLVASRLVNTGLLTLRQIVLSKVDQSLHTNTSLDAASEYAKYCSEILGVAATPGTNMPATFGHLAGGYDGQYYGYLWSEVFSMDMFYSCFKKEGIMNPETSKHHGISLIMFHYSKGEVDLVPF

SEQ ID NO: 56452 - protein, 414 aa, Homo sapiens
  Payload ID: 11088
  Gene Symbol: NLN
  Gene Name: neurolysin (metallopeptidase M3 family)
  ENSP ID: ENSP00000427417
KEENTIILQQLLPLRTKVAKLLGYSTHADFVLEMNTAKSTSRVTAFLDDLSQKLKPLGEAEREFILNLKKKECKDRGFEYDGKINAWDLYYYMTQTEELKYSIDQEFLKEYFPIEVVTEGLLNTYQELLGLSFEQMTDAHVWNKSVTLYTVKDKATGEVLGQFYLDLYPREGKYNHAACFGLQPGCLLPDGSRMMAVAALVVNFSQPVAGRPSLLRHDETDFARFSGTNVETDFVEVPSQMLENWVWDVDSLRRLSKHYKDGSPIADDLLEKLVASRLVNTGLLTLRQIVLSKVDQSLHTNTSLDAASEYAKYCSEILGVAATPGTNMPATFGHLAGGYDGQYYGYLWSEVFSMDMFYSCFKKEGIMNPEVGMKYRNLILKPGGSLDGMDMLHNFLKREPNQKAFLMSRGLHAP

SEQ ID NO: 56453 - protein, 121 aa, Homo sapiens
  Payload ID: 11089
  Gene Symbol: NMB
  Gene Name: neuromedin B
  Uniprot ID: P08949
  ENSP ID: ENSP00000353664
MARRAGGARMFGSLLLFALLAAGVAPLSWDLPEPRSRASKIRVHSRGNLWATGHFMGKKSLEPSSPSPLGTAPHTSLRDQRLQLSHDLLGILLLKKALGVSLSRPAPQIQYRRLLVQILQK

SEQ ID NO: 56454 - protein, 154 aa, Homo sapiens
  Payload ID: 11089
  Gene Symbol: NMB
  Gene Name: neuromedin B
  Uniprot ID: P08949
  ENSP ID: ENSP00000378089
MARRAGGARMFGSLLLFALLAAGVAPLSWDLPEPRSRASKIRVHSRGNLWATGHFMGKKSLEPSSPSPLGTAPHTSLRDQRLQLSHDLLGILLLKKALGVSLSRPAPQIQEAAGTNTAEMTPIMGQTQQRGLDCAHPGKVLNGTLLMAPSGCKS

SEQ ID NO: 56455 - protein, 390 aa, Homo sapiens
  Payload ID: 11090
  Gene Symbol: NMBR
  Gene Name: neuromedin B receptor
  Uniprot ID: P28336
  ENSP ID: ENSP00000258042
MPSKSLSNLSVTTGANESGSVPEGWERDFLPASDGTTTELVIRCVIPSLYLLIITVGLLGNIMLVKIFITNSAMRSVPNIFISNLAAGDLLLLLTCVPVDASRYFFDEWMFGKVGCKLIPVIQLTSVGVSVFTLTALSADRYRAIVNPMDMQTSGALLRTCVKAMGIWVVSVLLAVPEAVFSEVARISSLDNSSFTACIPYPQTDELHPKIHSVLIFLVYFLIPLAIISIYYYHIAKTLIKSAHNLPGEYNEHTKKQMETRKRLAKIVLVFVGCFIFCWFPNHILYMYRSFNYNEIDPSLGHMIVTLVARVLSFGNSCVNPFALYLLSESFRRHFNSQLCCGRKSYQERGTSYLLSSSAVRMTSLKSNAKNMVTNSVLLNGHSMKQEMAL

SEQ ID NO: 56456 - protein, 153 aa, Homo sapiens
  Payload ID: 11091
  Gene Symbol: NMS
  Gene Name: neuromedin S
  Uniprot ID: Q5H8A3
  ENSP ID: ENSP00000366061
MKHLRPQFPLILAIYCFCMLQIPSSGFPQPLADPSDGLDIVQLEQLAYCLSQWAPLSRQPKDNQDIYKRFLFHYSRTQEATHPVKTGFPPVHPLMHLAAKLANRRMKRILQRGSGTAAVDFTKKDHTATWGRPFFLFRPRNGRNIEDEAQIQW

SEQ ID NO: 56457 - protein, 174 aa, Homo sapiens
  Payload ID: 11092
  Gene Symbol: NMU
  Gene Name: neuromedin U
  Uniprot ID: P48645
  ENSP ID: ENSP00000264218
MLRTESCRPRSPAGQVAAASPLLLLLLLLAWCAGACRGAPILPQGLQPEQQLQLWNEIDDTCSSFLSIDSQPQASNALEELCFMIMGMLPKPQEQDEKDNTKRFLFHYSKTQKLGKSNVVSSVVHPLLQLVPHLHERRMKRFRVDEEFQSPFASQSRGYFLFRPRNGRRSAGFI

SEQ ID NO: 56458 - protein, 158 aa, Homo sapiens
  Payload ID: 11092
  Gene Symbol: NMU
  Gene Name: neuromedin U
  ENSP ID: ENSP00000422399
MLRTESCRPRSPAGQVAAASPLLLLLLLLAWCAGACRGAPILPQGLQPEQQLQLWNEASNALEELCFMIMGMLPKPQEQDEKDNTKRFLFHYSKTQKLGKSNVVSSVVHPLLQLVPHLHERRMKRFRVDEEFQSPFASQSRGYFLFRPRNGRRSAGFI

SEQ ID NO: 56459 - protein, 149 aa, Homo sapiens
  Payload ID: 11092
  Gene Symbol: NMU
  Gene Name: neuromedin U
  ENSP ID: ENSP00000422870
MLRTESCRPRSPAGQVAAASPLLLLLLLLAWCAGACRGAPILPQGLQPEQQLQLWNEIDDTCSSFLSIDSQPQASNALEELCFMIMGMLPKPQEQDEKDNTKRFLFHYSKTQKLGKSNVVEEFQSPFASQSRGYFLFRPRNGRRSAGFI

SEQ ID NO: 56460 - protein, 147 aa, Homo sapiens
  Payload ID: 11092
  Gene Symbol: NMU
  Gene Name: neuromedin U
  ENSP ID: ENSP00000424246
MLRTESCRPRSPAGQVAAASPLLLLLLLLAWCAGACRGAPILPQGLQPEQQLQLWNEIDDTCSSFLSIDSQPQASNALEELCFMIMGMLPKPQSSVVHPLLQLVPHLHERRMKRFRVDEEFQSPFASQSRGYFLFRPRNGRRSAGFI

SEQ ID NO: 56461 - protein, 426 aa, Homo sapiens
  Payload ID: 11093
  Gene Symbol: NMUR1
  Gene Name: neuromedin U receptor 1
  Uniprot ID: Q9HB89
  ENSP ID: ENSP00000305877
MTPLCLNCSVLPGDLYPGGARNPMACNGSAARGHFDPEDLNLTDEALRLKYLGPQQTELFMPICATYLLIFVVGAVGNGLTCLVILRHKAMRTPTNYYLFSLAVSDLLVLLVGLPLELYEMWHNYPFLLGVGGCYFRTLLFEMVCLASVLNVTALSVERYVAVVHPLQARSMVTRAHVRRVLGAVWGLAMLCSLPNTSLHGIRQLHVPCRGPVPDSAVCMLVRPRALYNMVVQTTALLFFCLPMAIMSVLYLLIGLRLRRERLLLMQEAKGRGSAAARSRYTCRLQQHDRGRRQVTKMLFVLVVVFGICWAPFHADRVMWSVVSQWTDGLHLAFQHVHVISGIFFYLGSAANPVLYSLMSSRFRETFQEALCLGACCHRLRPRHSSHSLSRMTTGSTLCDVGSLGSWVHPLAGNDGPEAQQETDPS

SEQ ID NO: 56462 - protein, 415 aa, Homo sapiens
  Payload ID: 11094
  Gene Symbol: NMUR2
  Gene Name: neuromedin U receptor 2
  Uniprot ID: Q9GZQ4
  ENSP ID: ENSP00000255262
MSGMEKLQNASWIYQQKLEDPFQKHLNSTEEYLAFLCGPRRSHFFLPVSVVYVPIFVVGVIGNVLVCLVILQHQAMKTPTNYYLFSLAVSDLLVLLLGMPLEVYEMWRNYPFLFGPVGCYFKTALFETVCFASILSITTVSVERYVAILHPFRAKLQSTRRRALRILGIVWGFSVLFSLPNTSIHGIKFHYFPNGSLVPGSATCTVIKPMWIYNFIIQVTSFLFYLLPMTVISVLYYLMALRLKKDKSLEADEGNANIQRPCRKSVNKMLFVLVLVFAICWAPFHIDRLFFSFVEEWSESLAAVFNLVHVVSGVFFYLSSAVNPIIYNLLSRRFQAAFQNVISSFHKQWHSQHDPQLPPAQRNIFLTECHFVELTEDIGPQFPCQSSMHNSHLPAALSSEQMSRTNYQSFHFNKT

SEQ ID NO: 56463 - protein, 1483 aa, Homo sapiens
  Payload ID: 11095
  Gene Symbol: NAV1
  Gene Name: neuron navigator 1
  Uniprot ID: Q8NEY1
  ENSP ID: ENSP00000356264
MLHLPLPRSGRTVNFPRSWDESSSISSGLSDASDNLSSEEFNASSSLNSLPSTPTASRRNSTIVLRTDSEKRSLAESGLSWFSESEEKAPKKLEYDSGSLKMEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVSPTAATTPRITRSNSIPTHEAAFELYSGSQMGSTLSLAERPKGMIRSGSFRDPTDDVHGSVLSLASSASSTYSSAEERMQSEQIRKLRRELESSQEKVATLTSQLSANANLVAAFEQSLVNMTSRLRHLAETAEEKDTELLDLRETIDFLKKKNSEAQAVIQGALNASETTPKELRIKRQNSSDSISSLNSITSHSSIGSSKDADAKKKKKKSWLRSSFNKAFSIKKGPKSASSYSDIEEIATPDSSAPSSPKLQHGSTETASPSIKSSTSSSVGTDVTEGPAHPAPHTRLFHANEEEEPEKKEVSELRSELWEKEMKLTDIRLEALNSAHQLDQLRETMHNMQLEVDLLKAENDRLKVAPGPSSGSTPGQVPGSSALSSPRRSLGLALTHSFGPSLADTDLSPMDGISTCGPKEEVTLRVVVRMPPQHIIKGDLKQQEFFLGCSKVSGKVDWKMLDEAVFQVFKDYISKMDPASTLGLSTESIHGYSISHVKRVLDAEPPEMPPCRRGVNNISVSLKGLKEKCVDSLVFETLIPKPMMQHYISLLLKHRRLVLSGPSGTGKTYLTNRLAEYLVERSGREVTEGIVSTFNMHQQSCKDLQLYLSNLANQIDRETGIGDVPLVILLDDLSEAGSISELVNGALTCKYHKCPYIIGTTNQPVKMTPNHGLHLSFRMLTFSNNVEPANGFLVRYLRRKLVESDSDINANKEELLRVLDWVPKLWYHLHTFLEKHSTSDFLIGPCFFLSCPIGIEDFRTWFIDLWNNSIIPYLQEGAKDGIKVHGQKAAWEDPVEWVRDTLPWPSAQQDQSKLYHLPPPTVGPHSIASPPEDRTVKDSTPSSLDSDPLMAMLLKLQEAANYIESPDRETILDPNLQATL

SEQ ID NO: 56464 - protein, 1877 aa, Homo sapiens
  Payload ID: 11095
  Gene Symbol: NAV1
  Gene Name: neuron navigator 1
  Uniprot ID: Q8NEY1
  ENSP ID: ENSP00000356265
MLGSSVKSVQPEVELSSGGGDEGADEPRGAGRKAAAADGRGMLPKRAKAPGGGGGMAKASAAELKVFKSGSVDSRVPGGPPASNLRKQKSLTNLSFLTDSEKKLQLYEPEWSDDMAKAPKGLGKVGSKGREAPLMSKTLSKSEHSLFQAKGSPAGGAKTPLAPLAPNLGKPSRIPRGPYAEVKPLSKAPEAAVSEDGKSDDELLSSKAKAQKSSGPVPSAKGQEERAFLKVDPELVVTVLGDLEQLLFSQMLDPESQRKRTVQNVLDLRQNLEETMSSLRGSQVTHSSLEMTCYDSDDANPRSVSSLSNRSSPLSWRYGQSSPRLQAGDAPSVGGSCRSEGTPAWYMHGERAHYSHTMPMRSPSKLSHISRLELVESLDSDEVDLKSGYMSDSDLMGKTMTEDDDITTGWDESSSISSGLSDASDNLSSEEFNASSSLNSLPSTPTASRRNSTIVLRTDSEKRSLAESGLSWFSESEEKAPKKLEYDSGSLKMEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVSPTAATTPRITRSNSIPTHEAAFELYSGSQMGSTLSLAERPKGMIRSGSFRDPTDDVHGSVLSLASSASSTYSSAEERMQSEQIRKLRRELESSQEKVATLTSQLSANANLVAAFEQSLVNMTSRLRHLAETAEEKDTELLDLRETIDFLKKKNSEAQAVIQGALNASETTPKELRIKRQNSSDSISSLNSITSHSSIGSSKDADAKKKKKKSWVYELRSSFNKAFSIKKGPKSASSYSDIEEIATPDSSAPSSPKLQHGSTETASPSIKSSTSSSVGTDVTEGPAHPAPHTRLFHANEEEEPEKKEVSELRSELWEKEMKLTDIRLEALNSAHQLDQLRETMHNMQLEVDLLKAENDRLKVAPGPSSGSTPGQVPGSSALSSPRRSLGLALTHSFGPSLADTDLSPMDGISTCGPKEEVTLRVVVRMPPQHIIKGDLKQQEFFLGCSKVSGKVDWKMLDEAVFQVFKDYISKMDPASTLGLSTESIHGYSISHVKRVLDAEPPEMPPCRRGVNNISVSLKGLKEKCVDSLVFETLIPKPMMQHYISLLLKHRRLVLSGPSGTGKTYLTNRLAEYLVERSGREVTEGIVSTFNMHQQSCKDLQLYLSNLANQIDRETGIGDVPLVILLDDLSEAGSISELVNGALTCKYHKCPYIIGTTNQPVKMTPNHGLHLSFRMLTFSNNVEPANGFLVRYLRRKLVESDSDINANKEELLRVLDWVPKLWYHLHTFLEKHSTSDFLIGPCFFLSCPIGIEDFRTWFIDLWNNSIIPYLQEGAKDGIKVHGQKAAWEDPVEWVRDTLPWPSAQQDQSKLYHLPPPTVGPHSIASPPEDRTVKDSTPSSLDSDPLMAMLLKLQEAANYIESPDRETILDPNLQATL

SEQ ID NO: 56465 - protein, 1830 aa, Homo sapiens
  Payload ID: 11095
  Gene Symbol: NAV1
  Gene Name: neuron navigator 1
  ENSP ID: ENSP00000356271
MDARIVHALLAGRMLGSSVKSVQPEVELSSGGGDEGADEPRGAGRKAAAADGRGMLPKRAKAPGGGGGMAKASAAELKVFKSGSVDSRVPGGPPASNLRKQKSLTNLSFLTDSEKKLQLYEPEWSDDMAKAPKGLGKVGSKGREAPLMSKTLSKSEHSLFQAKGSPAGGAKTPLAPLAPNLGKPSRIPRGPYAEVKPLSKAPEAAVSEDGKSDDELLSSKAKAQKSSGPVPSAKGQEERAFLKVDPELVVTVLGDLEQLLFSQMLDPESQRKRTVQNVLDLRQNLEETMSSLRGSQVTHSSLEMTCYDSDDANPRSVSSLSNRSSPLSWRYGQSSPRLQAGDAPSVGGSCRSEGTPAWYMHGERAHYSHTMPMRSPSKLSHISRLELVESLDSDEVDLKSGYMSDSDLMGKTMTEDDDITTGWDESSSISSGLSDASDNLSSEEFNASSSLNSLPSTPTASRRNSTIVLRTDSEKRSLAESGLSWFSESEEKAPKKLEYDSGSLKMEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVHGSVLSLASSASSTYSSAEERMQSEQIRKLRRELESSQEKVATLTSQLSANANLVAAFEQSLVNMTSRLRHLAETAEEKDTELLDLRETIDFLKKKNSEAQAVIQGALNASETTPKELRIKRQNSSDSISSLNSITSHSSIGSSKDADAKKKKKKSWLRSSFNKAFSIKKGPKSASSYSDIEEIATPDSSAPSSPKLQHGSTETASPSIKSSTSSSVGTDVTEGPAHPAPHTRLFHANEEEEPEKKEVSELRSELWEKEMKLTDIRLEALNSAHQLDQLRETMHNMQLEVDLLKAENDRLKVAPGPSSGSTPGQVPGSSALSSPRRSLGLALTHSFGPSLADTDLSPMDGISTCGPKEEVTLRVVVRMPPQHIIKGDLKQQEFFLGCSKVSGKVDWKMLDEAVFQVFKDYISKMDPASTLGLSTESIHGYSISHVKRVLDAEPPEMPPCRRGVNNISVSLKGLKEKCVDSLVFETLIPKPMMQHYISLLLKHRRLVLSGPSGTGKTYLTNRLAEYLVERSGREVTEGIVSTFNMHQQSCKDLQLYLSNLANQIDRETGIGDVPLVILLDDLSEAGSISELVNGALTCKYHKCPYIIGTTNQPVKMTPNHGLHLSFRMLTFSNNVEPANGFLVRYLRRKLVESDSDINANKEELLRVLDWVPKLWYHLHTFLEKHSTSDFLIGPCFFLSCPIGIEDFRTWFIDLWNNSIIPYLQEGAKDGIKVHGQKAAWEDPVEWVRDTLPWPSAQQDQSKLYHLPPPTVGPHSIASPPEDRTVKDSTPSSLDSDPLMAMLLKLQEAANYIESPDRETILDPNLQATL

SEQ ID NO: 56466 - protein, 227 aa, Homo sapiens
  Payload ID: 11095
  Gene Symbol: NAV1
  Gene Name: neuron navigator 1
  ENSP ID: ENSP00000389123
  MOD_RES (1)..(1): Any amino acid
XSQEETKERRHSHTIGGLPESDDQSELPSPPALPMSLSAKGQLTNIVHGSVLSLASSASSTYSSQIRKLRRELESSQEKVATLTSQLSANANLVAAFEQSLVNMTSRLRHLAETAEEKDTELLDLRETIDFLKKKNSEAQAVIQGALNASETTPKELRIKRQNSSDSISSLNSITSHSSIGSSKDADAKKKKKKSWLRSSFNKAFSIKKGPKSASSYSDIEEIATPD

SEQ ID NO: 56467 - protein, 755 aa, Homo sapiens
  Payload ID: 11095
  Gene Symbol: NAV1
  Gene Name: neuron navigator 1
  ENSP ID: ENSP00000405437
  MOD_RES (1)..(1): Any amino acid
XTPTASRRNSTIVLRTDSEKRSLAESGLSWFSESEEKAPKKLEYDSGSLKMEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVSPTAATTPRITRSNSIPTHEAAFELYSGSQMGSTLSLAERPKGMIRSGSFRDPTDDVHGSVLSLASSASSTYSSQIRKLRRELESSQEKVATLTSQLSANANLVAAFEQSLVNMTSRLRHLAETAEEKDTELLDLRETIDFLKKKNSEAQAVIQGALNASETTPKELRIKRQNSSDSISSLNSITSHSSIGSSKDADA

SEQ ID NO: 56468 - protein, 26 aa, Homo sapiens
  Payload ID: 11095
  Gene Symbol: NAV1
  Gene Name: neuron navigator 1
  ENSP ID: ENSP00000426436
SAKGQLTNIGLYGQIRHPPACMEAEE

SEQ ID NO: 56469 - protein, 241 aa, Homo sapiens
  Payload ID: 11095
  Gene Symbol: NAV1
  Gene Name: neuron navigator 1
  Uniprot ID: M0R1G4
  ENSP ID: ENSP00000471857
MNGMANVNPASRPHYASAIPVPRASSQTRIPTPGASPQLRPRQAGLALSPQRAASPRLGKAAGPSRNSSPRAFRGRGSPKFAGAVRESAEDGEGPFSSPWNSPRTTPKAALSSRAGSGRIGERQGTQGKKKKAQEGTPVCQTRGRSPSRTSFHGETQIPGAPEGRKPPSCPGKDQRDINYKSSGTPRSLEPDEGAASWASSPVCSPVQGKRPSPSPGAISFSSVHQQSQPVTATVAPFQYR

SEQ ID NO: 56470 - protein, 2429 aa, Homo sapiens
  Payload ID: 11096
  Gene Symbol: NAV2
  Gene Name: neuron navigator 2
  Uniprot ID: Q8IVL1
  ENSP ID: ENSP00000309577
MPAILVASKMKSGLPKPVHSAAPILHVPPARAGPQPCYLKLGSKVEVSKTTYPSQIPLKSQVLQGLQEPAGEGLPLRKSGSVENGFDTQIYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSSPLPPAVSQVAGAPSQCQAGTPQQQVPVTPQAPCQPHQPAPHQQSKAQAEMQSRLPGPTARVSAAGSEAKTRGGSTTANNRRSQSFNNYDKSKPVTSPPPPPSSHEKEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKEKQQREKDKEKSKDLAKRASVTERLDLKEEPKEDPSGAAVPEMPKKSSKIASFIPKGGKLNSAKKEPMAPSHSGIPKPGMKSMPGKSPSAPAPSKEGERSRSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEDPEARRLRTVKNIADLRQNLEETMSSLRGTQVTHSTLETTFDTNVTTEMSGRSILSLTGRPTPLSWRLGQSSPRLQAGDAPSMGNGYPPRANASRFINTESGRYVYSAPLRRQLASRGSSVCHVDVSDKAGDEMDLEGISMDAPGYMSDGDVLSKNIRTDDITSGYMTDGGLGLYTRRLNRLPDGMAVVRETLQRNTSLGLGDADSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWLRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 56471 - protein, 2365 aa, Homo sapiens
  Payload ID: 11096
  Gene Symbol: NAV2
  Gene Name: neuron navigator 2
  Uniprot ID: Q8IVL1
  ENSP ID: ENSP00000353871
MESVSESSQQQKRKPVIHGLEDQKRIYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSSPLPPAVSQVAGAPSQCQAGTPQQQVPVTPQAPCQPHQPAPHQQSKAQAEMQSRLPGPTARVSAAGSEAKTRGGSTTANNRRSQSFNNYDKSKPVTSPPPPPSSHEKEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKEKQQREKDKEKSKDLAKRASVTERLDLKEEPKEDPSGAAVPEMPKKSSKIASFIPKGGKLNSAKKEPMAPSHSGIPKPGMKSMPGKSPSAPAPSKEGERSRSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEDPEARRLRTVKNIADLRQNLEETMSSLRGTQVTHSTLETTFDTNVTTEMSGRSILSLTGRPTPLSWRLGQSSPRLQAGDAPSMGNGYPPRANASRFINTESGRYVYSAPLRRQLASRGSSVCHVDVSDKAGDEMDLEGISMDAPGYMSDGDVLSKNIRTDDITSGYMTDGGLGLYTRRLNRLPDGMAVVRETLQRNTSLGLGDADSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWLRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 56472 - protein, 2432 aa, Homo sapiens
  Payload ID: 11096
  Gene Symbol: NAV2
  Gene Name: neuron navigator 2
  Uniprot ID: Q8IVL1
  ENSP ID: ENSP00000379394
MPAILVASKMKSGLPKPVHSAAPILHVPPARAGPQPCYLKLGSKVEVSKTTYPSQIPLKSQVLQGLQEPAGEGLPLRKSGSVENGFDTQIYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSSPLPPAVSQVAGAPSQCQAGTPQQQVPVTPQAPCQPHQPAPHQQSKAQAEMQSRLPGPTARVSAAGSEAKTRGGSTTANNRRSQSFNNYDKSKPVTSPPPPPSSHEKEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKEKQQREKDKEKSKDLAKRASVTERLDLKEEPKEDPSGAAVPEMPKKSSKIASFIPKGGKLNSAKKEPMAPSHSGIPKPGMKSMPGKSPSAPAPSKEGERSRSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEDPEARRLRTVKNIADLRQNLEETMSSLRGTQVTHSTLETTFDTNVTTEMSGRSILSLTGRPTPLSWRLGQSSPRLQAGDAPSMGNGYPPRANASRFINTESGRYVYSAPLRRQLASRGSSVCHVDVSDKAGDEMDLEGISMDAPGYMSDGDVLSKNIRTDDITSGYMTDGGLGLYTRRLNRLPDGMAVVRETLQRNTSLGLGDADSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWVNELRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 56473 - protein, 2488 aa, Homo sapiens
  Payload ID: 11096
  Gene Symbol: NAV2
  Gene Name: neuron navigator 2
  Uniprot ID: Q8IVL1
  ENSP ID: ENSP00000379396
MPAILVASKMKSGLPKPVHSAAPILHVPPARAGPQPCYLKLGSKVEVSKTTYPSQIPLKSQVLQGLQEPAGEGLPLRKSGSVENGFDTQIYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSSPLPPAVSQVAGAPSQCQAGTPQQQVPVTPQAPCQPHQPAPHQQSKAQAEMQSSASSKDSSQSKIIRFTLGQKKISRLPGPTARVSAAGSEAKTRGGSTTANNRRSQSFNNYDKSKPVTSPPPPPSSHEKEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKEKQQREKDKEKSKDLAKRASVTERLDLKEEPKEDPSGAAVPEMPKKSSKIASFIPKGGKLNSAKKEPMAPSHSGIPKPGMKSMPGKSPSAPAPSKEGERSRSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEDPEARRLRTVKNIADLRQNLEETMSSLRGTQVTHSTLETTFDTNVTTEMSGRSILSLTGRPTPLSWRLGQSSPRLQAGDAPSMGNGYPPRANASRFINTESGRYVYSAPLRRQLASRGSSVCHVDVSDKAGDEMDLEGISMDAPGYMSDGDVLSKNIRTDDITSGYMTDGGLGLYTRRLNRLPDGMAVVRETLQRNTSLGLGDADSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEESWEKSSVDNFVSRLHSSLHFSLPLFHHARYELVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWVNELRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 56474 - protein, 160 aa, Homo sapiens
  Payload ID: 11096
  Gene Symbol: NAV2
  Gene Name: neuron navigator 2
  ENSP ID: ENSP00000431276
MLWPRNLTSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKV

SEQ ID NO: 56475 - protein, 2489 aa, Homo sapiens
  Payload ID: 11096
  Gene Symbol: NAV2
  Gene Name: neuron navigator 2
  ENSP ID: ENSP00000435395
MPAILVASKMKSGLPKPVHSAAPILHVPPARAGPQPCYLKLGSKVEVSKTTYPSQIPLKSQVLQGLQEPAGEGLPLRKSGSVENGFDTQIYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSSPLPPAVSQVAGAPSQCQAGTPQQQVPVTPQAPCQPHQPAPHQQSKAQAEMQSSASSKDSSQSKIIRFTLGQKKISRLPGPTARVSAAGSEAKTRGGSTTANNRRSQSFNNYDKSKPVTSPPPPPSSHEKEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKEKQQREKDKEKSKDLAKRASVTERLDLKEEPKEDPSGAAVPEMPKKSSKIASFIPKGGKLNSAKKEPMAPSHSGIPKPGMKSMPGKSPSAPAPSKEGERSRSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEDPEARRLRTVKNIADLRQNLEETMSSLRGTQVTHSTLETTFDTNVTTEMSGRSILSLTGRPTPLSWRLGQSSPRLQAGDAPSMGNGYPPRANASRFINTESGRYVYSAPLRRQLASRGSSVCHVDVSDKAGDEMDLEGISMDAPGYMSDGDVLSKNIRTDDITSGYMTDGGLGLYTRRLNRLPDGMAVVRETLQRNTSLGLGDADSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEESWEKSSVDNFVSRLHSSLHFSLPLFHHARYELVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWVNIQLRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 56476 - protein, 815 aa, Homo sapiens
  Payload ID: 11096
  Gene Symbol: NAV2
  Gene Name: neuron navigator 2
  ENSP ID: ENSP00000437136
MLWPRNLTSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSERYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESD

SEQ ID NO: 56477 - protein, 1493 aa, Homo sapiens
  Payload ID: 11096
  Gene Symbol: NAV2
  Gene Name: neuron navigator 2
  Uniprot ID: Q8IVL1
  ENSP ID: ENSP00000437316
MLWPRNLTSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWLRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 56478 - protein, 2433 aa, Homo sapiens
  Payload ID: 11096
  Gene Symbol: NAV2
  Gene Name: neuron navigator 2
  ENSP ID: ENSP00000443489
MPAILVASKMKSGLPKPVHSAAPILHVPPARAGPQPCYLKLGSKVEVSKTTYPSQIPLKSQVLQGLQEPAGEGLPLRKSGSVENGFDTQIYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSSPLPPAVSQVAGAPSQCQAGTPQQQVPVTPQAPCQPHQPAPHQQSKAQAEMQSRLPGPTARVSAAGSEAKTRGGSTTANNRRSQSFNNYDKSKPVTSPPPPPSSHEKEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKEKQQREKDKEKSKDLAKRASVTERLDLKEEPKEDPSGAAVPEMPKKSSKIASFIPKGGKLNSAKKEPMAPSHSGIPKPGMKSMPGKSPSAPAPSKEGERSRSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEDPEARRLRTVKNIADLRQNLEETMSSLRGTQVTHSTLETTFDTNVTTEMSGRSILSLTGRPTPLSWRLGQSSPRLQAGDAPSMGNGYPPRANASRFINTESGRYVYSAPLRRQLASRGSSVCHVDVSDKAGDEMDLEGISMDAPGYMSDGDVLSKNIRTDDITSGYMTDGGLGLYTRRLNRLPDGMAVVRETLQRNTSLGLGDADSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWVNIQLRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 56479 - protein, 2385 aa, Homo sapiens
  Payload ID: 11097
  Gene Symbol: NAV3
  Gene Name: neuron navigator 3
  Uniprot ID: Q8IVL0
  ENSP ID: ENSP00000381007
MPVLGVASKLRQPAVGSKPVHTALPIPNLGTTGSQHCSSRPLELTETESSMLSCQLALKSTCEFGEKKPLQGKAKEKEDSKIYTDWANHYLAKSGHKRLIKDLQQDIADGVLLAEIIQIIANEKVEDINGCPRSQSQMIENVDVCLSFLAARGVNVQGLSAEEIRNGNLKAILGLFFSLSRYKQQQHHQQQYYQSLVELQQRVTHASPPSEASQAKTQQDMQSSLAARYATQSNHSGIATSQKKPTRLPGPSRVPAAGSSSKVQGASNLNRRSQSFNSIDKNKPPNYANGNEKDSSKGPQSSSGVNGNVQPPSTAGQPPASAIPSPSASKPWRSKSMNVKHSATSTMLTVKQSSTATSPTPSSDRLKPPVSEGVKTAPSGQKSMLEKFKLVNARTALRPPQPPSSGPSDGGKDDDAFSESGEMEGFNSGLNSGGSTNSSPKVSPKLAPPKAGSKNLSNKKSLLQPKEKEEKNRDKNKVCTEKPVKEEKDQVTEMAPKKTSKIASLIPKGSKTTAAKKESLIPSSSGIPKPGSKVPTVKQTISPGSTASKESEKFRTTKGSPSQSLSKPITMEKASASSCPAPLEGREAGQASPSGSCTMTVAQSSGQSTGNGAVQLPQQQQHSHPNTATVAPFIYRAHSENEGTALPSADSCTSPTKMDLSYSKTAKQCLEEISGEDPETRRMRTVKNIADLRQNLEETMSSLRGTQISHSTLETTFDSTVTTEVNGRTIPNLTSRPTPMTWRLGQACPRLQAGDAPSLGAGYPRSGTSRFIHTDPSRFMYTTPLRRAAVSRLGNMSQIDMSEKASSDLDMSSEVDVGGYMSDGDILGKSLRTDDINSGYMTDGGLNLYTRSLNRIPDTATSRDIIQRGVHDVTVDADSWDDSSSVSSGLSDTLDNISTDDLNTTSSVSSYSNITVPSRKNTQLRTDSEKRSTTDETWDSPEELKKPEEDFDSHGDAGGKWKTVSSGLPEDPEKAGQKASLSVSQTGSWRRGMSAQGGAPSRQKAGTSALKTPGKTDDAKASEKGKAPLKGSSLQRSPSDAGKSSGDEGKKPPSGIGRSTATSSFGFKKPSGVGSSAMITSSGATITSGSATLGKIPKSAAIGGKSNAGRKTSLDGSQNQDDVVLHVSSKTTLQYRSLPRPSKSSTSGIPGRGGHRSSTSSIDSNVSSKSAGATTSKLREPTKIGSGRSSPVTVNQTDKEKEKVAVSDSESVSLSGSPKSSPTSASACGAQGLRQPGSKYPDIASPTFRRLFGAKAGGKSASAPNTEGVKSSSVMPSPSTTLARQGSLESPSSGTGSMGSAGGLSGSSSPLFNKPSDLTTDVISLSHSLASSPASVHSFTSGGLVWAANMSSSSAGSKDTPSYQSMTSLHTSSESIDLPLSHHGSLSGLTTGTHEVQSLLMRTGSVRSTLSESMQLDRNTLPKKGLRYTPSSRQANQEEGKEWLRSHSTGGLQDTGNQSPLVSPSAMSSSAAGKYHFSNLVSPTNLSQFNLPGPSMMRSNSIPAQDSSFDLYDDSQLCGSATSLEERPRAISHSGSFRDSMEEVHGSSLSLVSSTSSLYSTAEEKAHSEQIHKLRRELVASQEKVATLTSQLSANAHLVAAFEKSLGNMTGRLQSLTMTAEQKESELIELRETIEMLKAQNSAAQAAIQGALNGPDHPPKDLRIRRQHSSESVSSINSATSHSSIGSGNDADSKKKKKKNWVNSRGSELRSSFKQAFGKKKSTKPPSSHSDIEELTDSSLPASPKLPHNAGDCGSASMKPSQSASASPLVWPPKKRQNGPVIYKHRSRICECTEAEAEIILQLKSELREKELKLTDIRLEALSSAHHLDQIREAMNRMQNEIEILKAENDRLKAETGNTAKPTRPPSESSSSTSSSSSRQSLGLSLNNLNITEAVSSDILLDDAGDATGHKDGRSVKIIVSISKGYGRAKDQKSQAYLIGSIGVSGKTKWDVLDGVIRRLFKEYVFRIDTSTSLGLSSDCIASYCIGDLIRSHNLEVPELLPCGYLVGDNNIITVNLKGVEENSLDSFVFDTLIPKPITQRYFNLLMEHHRIILSGPSGTGKTYLANKLAEYVITKSGRKKTEDAIATFNVDHKSSKELQQYLANLAEQCSADNNGVELPVVIILDNLHHVGSLSDIFNGFLNCKYNKCPYIIGTMNQGVSSSPNLELHHNFRWVLCANHTEPVKGFLGRYLRRKLIEIEIERNIRNNDLVKIIDWIPKTWHHLNSFLETHSSSDVTIGPRLFLPCPMDVEGSRVWFMDLWNYSLVPYILEAVREGLQMYGKRTPWEDPSKWVLDTYPWSSATLPQESPALLQLRPEDVGYESCTSTKEATTSKHIPQTDTEGDPLMNMLMKLQEAANYSSTQSCDSESTSHHEDILDSSLESTL

SEQ ID NO: 56480 - protein, 2363 aa, Homo sapiens
  Payload ID: 11097
  Gene Symbol: NAV3
  Gene Name: neuron navigator 3
  Uniprot ID: Q8IVL0
  ENSP ID: ENSP00000446132
MPVLGVASKLRQPAVGSKPVHTALPIPNLGTTGSQHCSSRPLELTETESSMLSCQLALKSTCEFGEKKPLQGKAKEKEDSKIYTDWANHYLAKSGHKRLIKDLQQDIADGVLLAEIIQIIANEKVEDINGCPRSQSQMIENVDVCLSFLAARGVNVQGLSAEEIRNGNLKAILGLFFSLSRYKQQQHHQQQYYQSLVELQQRVTHASPPSEASQAKTQQDMQSSLAARYATQSNHSGIATSQKKPTRLPGPSRVPAAGSSSKVQGASNLNRRSQSFNSIDKNKPPNYANGNEKDSSKGPQSSSGVNGNVQPPSTAGQPPASAIPSPSASKPWRSKSMNVKHSATSTMLTVKQSSTATSPTPSSDRLKPPVSEGVKTAPSGQKSMLEKFKLVNARTALRPPQPPSSGPSDGGKDDDAFSESGEMEGFNSGLNSGGSTNSSPKVSPKLAPPKAGSKNLSNKKSLLQPKEKEEKNRDKNKVCTEKPVKEEKDQVTEMAPKKTSKIASLIPKGSKTTAAKKESLIPSSSGIPKPGSKVPTVKQTISPGSTASKESEKFRTTKGSPSQSLSKPITMEKASASSCPAPLEGREAGQASPSGSCTMTVAQSSGQSTGNGAVQLPQQQQHSHPNTATVAPFIYRAHSENEGTALPSADSCTSPTKMDLSYSKTAKQCLEEISGEDPETRRMRTVKNIADLRQNLEETMSSLRGTQISHSTLETTFDSTVTTEVNGRTIPNLTSRPTPMTWRLGQACPRLQAGDAPSLGAGYPRSGTSRFIHTDPSRFMYTTPLRRAAVSRLGNMSQIDMSEKASSDLDMSSEVDVGGYMSDGDILGKSLRTDDINSGYMTDGGLNLYTRSLNRIPDTATSRDIIQRGVHDVTVDADSWDDSSSVSSGLSDTLDNISTDDLNTTSSVSSYSNITVPSRKNTQLRTDSEKRSTTDETWDSPEELKKPEEDFDSHGDAGGKWKTVSSGLPEDPEKAGQKASLSVSQTGSWRRGMSAQGGAPSRQKAGTSALKTPGKTDDAKASEKGKAPLKGSSLQRSPSDAGKSSGDEGKKPPSGIGRSTATSSFGFKKPSGVGSSAMITSSGATITSGSATLGKIPKSAAIGGKSNAGRKTSLDGSQNQDDVVLHVSSKTTLQYRSLPRPSKSSTSGIPGRGGHRSSTSSIDSNVSSKSAGATTSKLREPTKIGSGRSSPVTVNQTDKEKEKVAVSDSESVSLSGSPKSSPTSASACGAQGLRQPGSKYPDIASPTFRRLFGAKAGGKSASAPNTEGVKSSSVMPSPSTTLARQGSLESPSSGTGSMGSAGGLSGSSSPLFNKPSDLTTDVISLSHSLASSPASVHSFTSGGLVWAANMSSSSAGSKDTPSYQSMTSLHTSSESIDLPLSHHGSLSGLTTGTHEVQSLLMRTGSVRSTLSESMQLDRNTLPKKGLRYTPSSRQANQEEGKEWLRSHSTGGLQDTGNQSPLVSPSAMSSSAAGKYHFSNLVSPTNLSQFNLPGPSMMRSNSIPAQDSSFDLYDDSQLCGSATSLEERPRAISHSGSFRDSMEEVHGSSLSLVSSTSSLYSTAEEKAHSEQIHKLRRELVASQEKVATLTSQLSANAHLVAAFEKSLGNMTGRLQSLTMTAEQKESELIELRETIEMLKAQNSAAQAAIQGALNGPDHPPKDLRIRRQHSSESVSSINSATSHSSIGSGNDADSKKKKKKNWVNSRGSELRSSFKQAFGKKKSTKPPSSHSDIEELTDSSLPASPKLPHNAGDCGSASMKPSQSASAICECTEAEAEIILQLKSELREKELKLTDIRLEALSSAHHLDQIREAMNRMQNEIEILKAENDRLKAETGNTAKPTRPPSESSSSTSSSSSRQSLGLSLNNLNITEAVSSDILLDDAGDATGHKDGRSVKIIVSISKGYGRAKDQKSQAYLIGSIGVSGKTKWDVLDGVIRRLFKEYVFRIDTSTSLGLSSDCIASYCIGDLIRSHNLEVPELLPCGYLVGDNNIITVNLKGVEENSLDSFVFDTLIPKPITQRYFNLLMEHHRIILSGPSGTGKTYLANKLAEYVITKSGRKKTEDAIATFNVDHKSSKELQQYLANLAEQCSADNNGVELPVVIILDNLHHVGSLSDIFNGFLNCKYNKCPYIIGTMNQGVSSSPNLELHHNFRWVLCANHTEPVKGFLGRYLRRKLIEIEIERNIRNNDLVKIIDWIPKTWHHLNSFLETHSSSDVTIGPRLFLPCPMDVEGSRVWFMDLWNYSLVPYILEAVREGLQMYGKRTPWEDPSKWVLDTYPWSSATLPQESPALLQLRPEDVGYESCTSTKEATTSKHIPQTDTEGDPLMNMLMKLQEAANYSSTQSCDSESTSHHEDILDSSLESTL

SEQ ID NO: 56481 - protein, 679 aa, Homo sapiens
  Payload ID: 11097
  Gene Symbol: NAV3
  Gene Name: neuron navigator 3
  ENSP ID: ENSP00000446628
MPVLGVASKLRQPAVGSKPVHTALPIPNLGTTGSQHCSSRPLELTETESSMLSCQLALKSTCEFGEKKPLQGKAKEKEDSKIYTDWANHYLAKSGHKRLIKDLQQDIADGVLLAEIIQIIANEKVEDINGCPRSQSQMIENVDVCLSFLAARGVNVQGLSAEEIRNGNLKAILGLFFSLSRYKQQQHHQQQYYQSLVELQQRVTHASPPSEASQAKTQQDMQSSLAARYATQSNHSGIATSQKKPTRLPGPSRVPAAGSSSKVQGASNLNRRSQSFNSIDKNKPPNYANGNEKDSSKGPQSSSGVNGNVQPPSTAGQPPASAIPSPSASKPWRSKSMNVKHSATSTMLTVKQSSTATSPTPSSDRLKPPVSEGVKTAPSGQKSMLEKFKLVNARTALRPPQPPSSGPSDGGKDDDAFSESGEMEGFNSGLNSGGSTNSSPKVSPKLAPPKAGSKNLSNKKSLLQPKEKEEKNRDKNKVCTEKPVKEEKDQVTEMAPKKTSKIASLIPKGSKTTAAKKESLIPSSSGIPKPGSKVPTVKQTISPGSTASKESEKFRTTKGSPSQSLSKPITMEKASASSCPAPLEGREAGQASPSGSCTMTVAQSSGQSTGNGAVQLPQQQQHSHPNTATVAPFIYRAHSENEGTALPSADSCTSPTKMDLSYSKTAKQCLEEISGEDPE

SEQ ID NO: 56482 - protein, 1258 aa, Homo sapiens
  Payload ID: 11097
  Gene Symbol: NAV3
  Gene Name: neuron navigator 3
  ENSP ID: ENSP00000446644
  MOD_RES (1)..(1): Any amino acid
XKRSTTDETWDSPEELKKPEEDFDSHGDAGGKWKTVSSGLPEDPEKAGQKASLSVSQTGSWRRGMSAQGGAPSRQKAGTSALKTPGKTDDAKASEKGKAPLKGSSLQRSPSDAGKSSGDEGKKPPSGIGRSTATSSFGFKKPSGVGSSAMITSSGATITSGSATLGKIPKSAAIGGKSNAGRKTSLDGSQNQDDVVLHVSSKTTLQYRSLPRPSKSSTSGIPGRGGHRSSTSSIDSNVSSKSAGATTSKLREPTKIGSGRSSPVTVNQTDKEKEKVAVSDSESVSLSGSPKSSPTSASACGAQGLRQPGSKYPDIASPTFRRYTPSSRQANQEEGKEWLRSHSTGGLQDTGNQSPLVSPSAMSSSAAGKYHFSNLVSPTNLSQFNLPGPSMMRSNSIPAQDSSFDLYDDSQLCGSATSLEERPRAISHSGSFRDSMEEVHGSSLSLVSSTSSLYSTAEEKAHSEQIHKLRRELVASQEKVATLTSQLSANAHLVAAFEKSLGNMTGRLQSLTMTAEQKESELIELRETIEMLKAQNSAAQAAIQGALNGPDHPPKDLRIRRQHSSESVSSINSATSHSSIGSGNDADSKKKKKKNWVNSRGSELRSSFKQAFGKKKSTKPPSSHSDIEELTDSSLPASPKLPHNAGDCGSASMKPSQSASAICECTEAEAEIILQLKSELREKELKLTDIRLEALSSAHHLDQIREAMNRMQNEIEILKAENDRLKAETGNTAKPTRPPSESSSSTSSSSSRQSLGLSLNNLNITEAVSSDILLDDAGDATGHKDGRSVKIIVSISKGYGRAKDQKSQAYLIGSIGVSGKTKWDVLDGVIRRLFKEYVFRIDTSTSLGLSSDCIASYCIGDLIRSHNLEVPELLPCGYLVGDNNIITVNLKGVEENSLDSFVFDTLIPKPITQRYFNLLMEHHRIILSGPSGTGKTYLANKLAEYVITKSGRKKTEDAIATFNVDHKSSKELQQYLANLAEQCSADNNGVELPVVIILDNLHHVGSLSDIFNGFLNCKYNKCPYIIGTMNQGVSSSPNLELHHNFRWVLCANHTEPVKGFLGRYLRRKLIEIEIERNIRNNDLVKIIDWIPKTWHHLNSFLETHSSSDVTIGPRLFLPCPMDVEGSRVWFMDLWNYSLVPYILEAVREGLQMYGKRTPWEDPSKWVLDTYPWSSATLPQESPALLQLRPEDVGYESCTSTKEATTSKHIPQTDTEGDPLMNMLMKLQEAANYSSTQSCDSESTSHHEDILDSSLESTL

SEQ ID NO: 56483 - protein, 233 aa, Homo sapiens
  Payload ID: 11097
  Gene Symbol: NAV3
  Gene Name: neuron navigator 3
  ENSP ID: ENSP00000448037
  MOD_RES (1)..(1): Any amino acid
XNVQGLSAEEIRNGNLKAILGLFFSLSRYKQQQHHQQQYYQSLVELQQRVTHASPPSEASQAKTQQDMQSRLPGPSRVPAAGSSSKVQGASNLNRRSQSFNSIDKNKPPNYANGNEKDSSKGPQSSSGVNGNVQPPSTAGQPPASAIPSPSASKPWRSKSMNVKHSATSTMLTVKQSSTATSPTPSSDRLKPPVSEGVKTAPSGQKSMLEKFKLVNARTALRPPQPPSSGPSD

SEQ ID NO: 56484 - protein, 253 aa, Homo sapiens
  Payload ID: 11097
  Gene Symbol: NAV3
  Gene Name: neuron navigator 3
  ENSP ID: ENSP00000448243
  MOD_RES (1)..(1): Any amino acid
XAFRLPLTSDAHELLFSSKSRVSYIIALILVDLLTPLIMKRWVLCANHTEPVKGFLGRYLRRKLIEIEIERNIRNNDLVKIIDWIPKTWHHLNSFLETHSSSDVTIGPRLFLPCPMDVEGSRVWFMDLWNYSLVPYILEAVREGLQMYGKRTPWEDPSKWVLDTYPWSSATLPQESPALLQLRPEDVGYESCTSTKEATTSKHIPQTDTEGDPLMNMLMKLQEAANYSSTQSCDSESTSHHEDILDSSLESTL

SEQ ID NO: 56485 - protein, 799 aa, Homo sapiens
  Payload ID: 11097
  Gene Symbol: NAV3
  Gene Name: neuron navigator 3
  ENSP ID: ENSP00000448303
KDTPSYQSMTSLHTSSESIDLPLSHHGSLSGLTTGTHEVQSLLMRTGSVRSTLSERYTPSSRQANQEEGKEWLRSHSTGGLQDTGNQSPLVSPSAMSSSAAGKYHFSNLVSPTNLSQFNLPGPSMMRSNSIPAQDSSFDLYDDSQLCGSATSLEERPRAISHSGSFRDSMEEVHGSSLSLVSSTSSLYSTAEEKAHSEQIHKLRRELVASQEKVATLTSQLSANAHLVAAFEKSLGNMTGRLQSLTMTAEQKESELIELRETIEMLKAQNSAAQAAIQGALNGPDHPPKDLRIRRQHSSESVSSINSATSHSSIGSGNDADSKKKKKKNWLRSSFKQAFGKKKSTKPPSSHSDIEELTDSSLPASPKLPHNAGDCGSASMKPSQSASAICECTEAEAEIILQLKSELREKELKLTDIRLEALSSAHHLDQIREAMNRMQNEIEILKAENDRLKAETGNTAKPTRPPSESSSSTSSSSSRQSLGLSLNNLNITEAVSSDILLDDAGDATGHKDGRSVKIIVSISKGYGRAKDQKSQAYLIGSIGVSGKTKWDVLDGVIRRLFKEYVFRIDTSTSLGLSSDCIASYCIGDLIRSHNLEVPELLPCGYLVGDNNIITVNLKGVEENSLDSFVFDTLIPKPITQRYFNLLMEHHRIILSGPSGTGKTYLANKLAEYVITKSGRKKTEDAIATFNVDHKSSKELQQYLANLAEQCSADNNGVELPVVIILDNLHHVGSLSDIFNGFLNCKYNKCPYIIGTMNQGVSSSPNLELHHNFRWVLCANHTEPVKGFLGRYLRRKLIEI

SEQ ID NO: 56486 - protein, 185 aa, Homo sapiens
  Payload ID: 11098
  Gene Symbol:
  Gene Name: neuron specific gene family member 1 [Source:EntrezGene
  Acc:27065]
  Uniprot ID: P42857
  ENSP ID: ENSP00000381049
MVKLGNNFAEKGTKQPLLEDGFDTIPLMTPLDVNQLQFPPPDKVVVKTKTEYEPDRKKGKARPPQIAEFTVSITEGVTERFKVSVLVLFALAFLTCVVFLVVYKVYKYDRACPDGFVLKNTQCIPEGLESYYAEQDSSAREKFYTVINHYNLAKQSITRSVSPWMSVLSEEKLSEQETEAAEKSA

SEQ ID NO: 56487 - protein, 185 aa, Homo sapiens; identical to SEQ ID NO: 56486
  Payload ID: 11098
  Gene Symbol:
  Gene Name: neuron specific gene family member 1 [Source:EntrezGene
  Acc:27065]
  Uniprot ID: P42857
  ENSP ID: ENSP00000388823

SEQ ID NO: 56488 - protein, 185 aa, Homo sapiens; identical to SEQ ID NO: 56486
  Payload ID: 11098
  Gene Symbol:
  Gene Name: neuron specific gene family member 1 [Source:EntrezGene
  Acc:27065]
  Uniprot ID: P42857
  ENSP ID: ENSP00000408833

SEQ ID NO: 56489 - protein, 185 aa, Homo sapiens; identical to SEQ ID NO: 56486
  Payload ID: 11098
  Gene Symbol:
  Gene Name: neuron specific gene family member 1 [Source:EntrezGene
  Acc:27065]
  Uniprot ID: P42857
  ENSP ID: ENSP00000421841

SEQ ID NO: 56490 - protein, 185 aa, Homo sapiens; identical to SEQ ID NO: 56486
  Payload ID: 11098
  Gene Symbol:
  Gene Name: neuron specific gene family member 1 [Source:EntrezGene
  Acc:27065]
  Uniprot ID: P42857
  ENSP ID: ENSP00000425345

SEQ ID NO: 56491 - protein, 185 aa, Homo sapiens; identical to SEQ ID NO: 56486
  Payload ID: 11098
  Gene Symbol:
  Gene Name: neuron specific gene family member 1 [Source:EntrezGene
  Acc:27065]
  Uniprot ID: P42857
  ENSP ID: ENSP00000425423

SEQ ID NO: 56492 - protein, 146 aa, Homo sapiens
  Payload ID: 11098
  Gene Symbol:
  Gene Name: neuron specific gene family member 1 [Source:EntrezGene
  Acc:27065]
  ENSP ID: ENSP00000425803
MVKLGNNFAEKGTKQPLLEDGFDTIPLMTPLDVNQLQFPPPDKVSVLVLFALAFLTCVVFLVVYKVYKYDRACPDGFVLKNTQCIPEGLESYYAEQDSSAREKFYTVINHYNLAKQSITRSVSPWMSVLSEEKLSEQETEAAEKSA

SEQ ID NO: 56493 - protein, 185 aa, Homo sapiens; identical to SEQ ID NO: 56486
  Payload ID: 11098
  Gene Symbol:
  Gene Name: neuron specific gene family member 1 [Source:EntrezGene
  Acc:27065]
  Uniprot ID: P42857
  ENSP ID: ENSP00000426358

SEQ ID NO: 56494 - protein, 185 aa, Homo sapiens; identical to SEQ ID NO: 56486
  Payload ID: 11098
  Gene Symbol:
  Gene Name: neuron specific gene family member 1 [Source:EntrezGene
  Acc:27065]
  Uniprot ID: P42857
  ENSP ID: ENSP00000480081

SEQ ID NO: 56495 - protein, 190 aa, Homo sapiens [sequence omitted]

SEQ ID NO: 56496 - protein, 172 aa, Homo sapiens
  Payload ID: 11099
  Gene Symbol: NCS1
  Gene Name: neuronal calcium sensor 1
  Uniprot ID: P62166
  ENSP ID: ENSP00000486695
MATITEKEVQQWYKGFIKDCPSGQLDAAGFQKIYKQFFPFGDPTKFATFVFNVFDENKDGRIEFSEFIQALSVTSRGTLDEKLRWAFKLYDLDNDGYITRNEMLDIVDAIYQMVGNTVELPEEENTPEKRVDRIFAMMDKNADGKLTLQEFQEGSKADPSIVQALSLYDGLV

SEQ ID NO: 56497 - protein, 1183 aa, Homo sapiens
  Payload ID: 11100
  Gene Symbol: NRCAM
  Gene Name: neuronal cell adhesion molecule
  Uniprot ID: Q92823
  ENSP ID: ENSP00000325269
MQLKIMPKKKRLSAGRVPLILFLCQMISALEVPLDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 56498 - protein, 1299 aa, Homo sapiens
  Payload ID: 11100
  Gene Symbol: NRCAM
  Gene Name: neuronal cell adhesion molecule
  ENSP ID: ENSP00000368308
MPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITRIHHEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKVQAVNPRISNLTAAAAETYANISWEYEGPEHVNFYVEYGVAGSKEEWRKEIVNGSRSFFGLKGLMPGTAYKVRVGAVGDSGFVSSEDVFETGPAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 56499 - protein, 1192 aa, Homo sapiens
  Payload ID: 11100
  Gene Symbol: NRCAM
  Gene Name: neuronal cell adhesion molecule
  Uniprot ID: Q92823
  ENSP ID: ENSP00000368310
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 56500 - protein, 1304 aa, Homo sapiens
  Payload ID: 11100
  Gene Symbol: NRCAM
  Gene Name: neuronal cell adhesion molecule
  Uniprot ID: Q92823
  ENSP ID: ENSP00000368314
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKVQAVNPRISNLTAAAAETYANISWEYEGPEHVNFYVEYGVAGSKEEWRKEIVNGSRSFFGLKGLMPGTAYKVRVGAVGDSGFVSSEDVFETGPAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 56501 - protein, 431 aa, Homo sapiens
  Payload ID: 11100
  Gene Symbol: NRCAM
  Gene Name: neuronal cell adhesion molecule
  ENSP ID: ENSP00000390421
MQLKIMPKKKRLSAGRVPLILFLCQMISALEVPLDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNE

SEQ ID NO: 56502 - protein, 118 aa, Homo sapiens
  Payload ID: 11100
  Gene Symbol: NRCAM
  Gene Name: neuronal cell adhesion molecule
  ENSP ID: ENSP00000390868
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYE

SEQ ID NO: 56503 - protein, 61 aa, Homo sapiens
  Payload ID: 11100
  Gene Symbol: NRCAM
  Gene Name: neuronal cell adhesion molecule
  ENSP ID: ENSP00000393663
MQLKIMPKKKRLSAGRVPLILFLCQMISALEVPLDPKLLEDLVQPPTITQQSPKDYIIDPR

SEQ ID NO: 56504 - protein, 106 aa, Homo sapiens
  Payload ID: 11100
  Gene Symbol: NRCAM
  Gene Name: neuronal cell adhesion molecule
  ENSP ID: ENSP00000397544
MQLKIMPKKKRLSAGRVPLILFLCQMISALEVPLDLVQPPTITQQSPKDYIIDPRENIVIQCEAKGKPPPSFSWTRNGTHFDIDKDPLVTMKPGTGTLIINIMSEG

SEQ ID NO: 56505 - protein, 190 aa, Homo sapiens
  Payload ID: 11100
  Gene Symbol: NRCAM
  Gene Name: neuronal cell adhesion molecule
  ENSP ID: ENSP00000398174
  MOD_RES (1)..(1): Any amino acid
XGILPPDVGAGKVQAVNPRISNLTAAAAETYANISWEYEGPEHVNFYVEYGVAGTMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESS

SEQ ID NO: 56506 - protein, 1304 aa, Homo sapiens; identical to SEQ ID NO: 56500
  Payload ID: 11100
  Gene Symbol: NRCAM
  Gene Name: neuronal cell adhesion molecule
  Uniprot ID: Q92823
  ENSP ID: ENSP00000401244

SEQ ID NO: 56507 - protein, 1211 aa, Homo sapiens
  Payload ID: 11100
  Gene Symbol: NRCAM
  Gene Name: neuronal cell adhesion molecule
  ENSP ID: ENSP00000407858
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 56508 - protein, 106 aa, Homo sapiens; identical to SEQ ID NO: 56504
  Payload ID: 11100
  Gene Symbol: NRCAM
  Gene Name: neuronal cell adhesion molecule
  ENSP ID: ENSP00000408203

SEQ ID NO: 56509 - protein, 771 aa, Homo sapiens [sequence omitted]

SEQ ID NO: 56510 - protein, 356 aa, Homo sapiens
  Payload ID: 11101
  Gene Symbol: NEUROD1
  Gene Name: neuronal differentiation 1
  Uniprot ID: Q13562
  ENSP ID: ENSP00000295108
MTKSYSESGLMGEPQPQGPPSWTDECLSSQDEEHEADKKEDDLETMNAEEDSLRNGGEEEDEDEDLEEEEEEEEEDDDQKPKRRGPKKKKMTKARLERFKLRRMKANARERNRMHGLNAALDNLRKVVPCYSKTQKLSKIETLRLAKNYIWALSEILRSGKSPDLVSFVQTLCKGLSQPTTNLVAGCLQLNPRTFLPEQNQDMPPHLPTASASFPVHPYSYQSPGLPSPPYGTMDSSHVFHVKPPPHAYSAALEPFFESPLTDCTSPSFDGPLSPPLSINGNFSFKHEPSAEFEKNYAFTMHYPAATLAGAQSHGSIFSGTAAPRCEIPIDNIMSFDSHSHHERVMSAQLNAIFHD

SEQ ID NO: 56511 - protein, 382 aa, Homo sapiens
  Payload ID: 11102
  Gene Symbol: NEUROD2
  Gene Name: neuronal differentiation 2
  Uniprot ID: Q15784
  ENSP ID: ENSP00000306754
MLTRLFSEPGLLSDVPKFASWGDGEDDEPRSDKGDAPPPPPPAPGPGAPGPARAAKPVPLRGEEGTEATLAEVKEEGELGGEEEEEEEEEEGLDEAEGERPKKRGPKKRKMTKARLERSKLRRQKANARERNRMHDLNAALDNLRKVVPCYSKTQKLSKIETLRLAKNYIWALSEILRSGKRPDLVSYVQTLCKGLSQPTTNLVAGCLQLNSRNFLTEQGADGAGRFHGSGGPFAMHPYPYPCSRLAGAQCQAAGGLGGGAAHALRTHGYCAAYETLYAAAGGGGASPDYNSSEYEGPLSPPLCLNGNFSLKQDSSPDHEKSYHYSMHYSALPGSRPTGHGLVFGSSAVRGGVHSENLLSYDMHLHHDRGPMYEELNAFFHN

SEQ ID NO: 56512 - protein, 331 aa, Homo sapiens
  Payload ID: 11103
  Gene Symbol: NEUROD4
  Gene Name: neuronal differentiation 4
  Uniprot ID: Q9HD90
  ENSP ID: ENSP00000242994
MSKTFVKSKEMGELVNTPSWMDKGLGSQNEVKEEESRPGTYGMLSSLTEEHDSIEEEEEEEEDGEKPKRRGPKKKKMTKARLERFRARRVKANARERTRMHGLNDALDNLRRVMPCYSKTQKLSKIETLRLARNYIWALSEVLETGQTPEGKGFVEMLCKGLSQPTSNLVAGCLQLGPQSVLLEKHEDKSPICDSAISVHNFNYQSPGLPSPPYGHMETHLLHLKPQVFKSLGESSFGSHLPDCSTPPYEGPLTPPLSISGNFSLKQDGSPDLEKSYSFMPHYPSSSLSSGHVHSTPFQAGTPRYDVPIDMSYDSYPHHGIGTQLNTVFTE

SEQ ID NO: 56513 - protein, 337 aa, Homo sapiens
  Payload ID: 11104
  Gene Symbol: NEUROD6
  Gene Name: neuronal differentiation 6
  Uniprot ID: Q96NK8
  ENSP ID: ENSP00000297142
MLTLPFDESVVMPESQMCRKFSRECEDQKQIKKPESFSKQIVLRGKSIKRAPGEETEKEEEEEDREEEDENGLPRRRGLRKKKTTKLRLERVKFRRQEANARERNRMHGLNDALDNLRKVVPCYSKTQKLSKIETLRLAKNYIWALSEILRIGKRPDLLTFVQNLCKGLSQPTTNLVAGCLQLNARSFLMGQGGEAAHHTRSPYSTFYPPYHSPELTTPPGHGTLDNSKSMKPYNYCSAYESFYESTSPECASPQFEGPLSPPPINYNGIFSLKQEETLDYGKNYNYGMHYCAVPPRGPLGQGAMFRLPTDSHFPYDLHLRSQSLTMQDELNAVFHN

SEQ ID NO: 56514 - protein, 330 aa, Homo sapiens
  Payload ID: 11104
  Gene Symbol: NEUROD6
  Gene Name: neuronal differentiation 6
  ENSP ID: ENSP00000479428
MLTLPFDESVVMPESQMCRKFSRECEDQKQIKKPESFSKQIVLRGKSIKRAPGEETEKEEEEEDREEEDENGLPRRRGLRKKKTTKLRLERVKFRRQEANARERNRMHGLNDALDNLRKVVPCYSKTQKLSKIETLRLAKNYIWALSEILRIGKRPDLLTFVQNLCKGLSQPTTNLVAGCLQLNARSFLMGQGGEAAHHTRSPYSTFYPPYHSPELTTPPGHGTLDNSKSMKPYNYCSAYESFYESTSPECASPQFEGPLSPPPINYNGIFSLKQEETLDYGKNYNYGMHYCAVPPRGPLGQVPCSGCPPTATSLTTYICAANLSQCKMN

SEQ ID NO: 56515 - protein, 226 aa, Homo sapiens
  Payload ID: 11105
  Gene Symbol: NEGR1
  Gene Name: neuronal growth regulator 1
  Uniprot ID: Q7Z3B1
  ENSP ID: ENSP00000305938
MQVHLTVQVPPKIYDISNDMTVNEGTNVTLTCLATGKPEPSISWRHISPSAKPFENGQYLDIYGITRDQAGEYECSAENDVSFPDVRKVKVVVNFAPTIQEIKSGTVTPGRSGLIRCEGAGVPPPAFEWYKGEKKLFNGQQGIIIQNFSTRSILTVTNVTQEHFGNYTCVAANKLGTTNASLPLNPPSTAQYGITGSADVLFSCWYLVLTLSSFTSIFYLKNAILQ

SEQ ID NO: 56516 - protein, 354 aa, Homo sapiens
  Payload ID: 11105
  Gene Symbol: NEGR1
  Gene Name: neuronal growth regulator 1
  Uniprot ID: Q7Z3B1
  ENSP ID: ENSP00000350364
MDMMLLVQGACCSNQWLAAVLLSLCCLLPSCLPAGQSVDFPWAAVDNMMVRKGDTAVLRCYLEDGASKGAWLNRSSIIFAGGDKWSVDPRVSISTLNKRDYSLQIQNVDVTDDGPYTCSVQTQHTPRTMQVHLTVQVPPKIYDISNDMTVNEGTNVTLTCLATGKPEPSISWRHISPSAKPFENGQYLDIYGITRDQAGEYECSAENDVSFPDVRKVKVVVNFAPTIQEIKSGTVTPGRSGLIRCEGAGVPPPAFEWYKGEKKLFNGQQGIIIQNFSTRSILTVTNVTQEHFGNYTCVAANKLGTTNASLPLNPPSTAQYGITGSADVLFSCWYLVLTLSSFTSIFYLKNAILQ

SEQ ID NO: 56517 - protein, 299 aa, Homo sapiens
  Payload ID: 11105
  Gene Symbol: NEGR1
  Gene Name: neuronal growth regulator 1
  ENSP ID: ENSP00000413294
VICRCYLEDGASKGAWLNRSSIIFAGGDKWSVDPRVSISTLNKRDYSLQIQNVDVTDDGPYTCSVQTQHTPRTMQVHLTVQVPPKIYDISNDMTVNEGTNVTLTCLATGKPEPSISWRHISPSAKPFENGQYLDIYGITRDQAGEYECSAENDVSFPDVRKVKVVVNFAPTIQEIKSGTVTPGRSGLIRCEGAGVPPPAFEWYKGEKKLFNGQQGIIIQNFSTRSILTVTNVTQEHFGNYTCVAANKLGTTNASLPLNPPSTAQYGITGSADVLFSCWYLVLTLSSFTSIFYLKNAILQ

SEQ ID NO: 56518 - protein, 710 aa, Homo sapiens
  Payload ID: 11106
  Gene Symbol: NGEF
  Gene Name: neuronal guanine nucleotide exchange factor
  Uniprot ID: Q8N5V2
  ENSP ID: ENSP00000264051
METRESEDLEKTRRKSASDQWNTDNEPAKVKPELLPEKEETSQADQDIQDKEPHCHIPIKRNSIFNRSIRRKSKAKARDNPERNASCLADSQDNGKSVNEPLTLNIPWSRMPPCRTAMQTDPGAQEMSESSSTPGNGATPEEWPALADSPTTLTEALRMIHPIPADSWRNLIEQIGLLYQEYRDKSTLQEIETRRQQDAEIEDNTNGSPASEDTPEEEEEEEEEEEPASPPERKTLPQICLLSNPHSRFNLWQDLPEIRSSGVLEILQPEEIKLQEAMFELVTSEASYYKSLNLLVSHFMENERIRKILHPSEAHILFSNVLDVLAVSERFLLELEHRMEENIVISDVCDIVYRYAADHFSVYITYVSNQTYQERTYKQLLQEKAAFRELIAQLELDPKCRGLPFSSFLILPFQRITRLKLLVQNILKRVEERSERECTALDAHKELEMVVKACNEGVRKMSRTEQMISIQKKMEFKIKSVPIISHSRWLLKQGELQQMSGPKTSRTLRTKKLFHEIYLFLFNDLLVICRQIPGDKYQVFDSAPRGLLRVEELEDQGQTLANVFILRLLENADDREATYMLKASSQSEMKRWMTSLAPNRRTKFVSFTSRLLDCPQVQCVHPYVAQQPDELTLELADILNILDKTDDGWIFGERLHDQERGWFPSSMTEEILNPKIRSQNLKECFRVHKMDDPQRSQNKDRRKLGSRNRQ

SEQ ID NO: 56519 - protein, 618 aa, Homo sapiens
  Payload ID: 11106
  Gene Symbol: NGEF
  Gene Name: neuronal guanine nucleotide exchange factor
  Uniprot ID: Q8N5V2
  ENSP ID: ENSP00000362653
MELLAAAFSAACAVDHDSSTSESDARDSAAGHLPGSESSSTPGNGATPEEWPALADSPTTLTEALRMIHPIPADSWRNLIEQIGLLYQEYRDKSTLQEIETRRQQDAEIEDNTNGSPASEDTPEEEEEEEEEEEPASPPERKTLPQICLLSNPHSRFNLWQDLPEIRSSGVLEILQPEEIKLQEAMFELVTSEASYYKSLNLLVSHFMENERIRKILHPSEAHILFSNVLDVLAVSERFLLELEHRMEENIVISDVCDIVYRYAADHFSVYITYVSNQTYQERTYKQLLQEKAAFRELIAQLELDPKCRGLPFSSFLILPFQRITRLKLLVQNILKRVEERSERECTALDAHKELEMVVKACNEGVRKMSRTEQMISIQKKMEFKIKSVPIISHSRWLLKQGELQQMSGPKTSRTLRTKKLFHEIYLFLFNDLLVICRQIPGDKYQVFDSAPRGLLRVEELEDQGQTLANVFILRLLENADDREATYMLKASSQSEMKRWMTSLAPNRRTKFVSFTSRLLDCPQVQCVHPYVAQQPDELTLELADILNILDKTDDGWIFGERLHDQERGWFPSSMTEEILNPKIRSQNLKECFRVHKMDDPQRSQNKDRRKLGSRNRQ

SEQ ID NO: 56520 - protein, 238 aa, Homo sapiens
  Payload ID: 11106
  Gene Symbol: NGEF
  Gene Name: neuronal guanine nucleotide exchange factor
  Uniprot ID: Q8N5V2
  ENSP ID: ENSP00000387033
MELLAAAFSAACAVDHDSSTSESDARDSAAGHLPGSESSSTPGNGATPEEWPALADSPTTLTEALRMIHPIPADSWRNLIEQIGLLYQEYRDKSTLQEIETRRQQDAEIEDNTNGSPASEDTPEEEEEEEEEEEPASPPERKTLPQICLLSNPHSRFNLWQDLPEIRSSGVLEILQPEEIKLQEAMFELVTSEASYYKSLNLLVSHFMENERIRKILHPSEAHILFSNVLDVLAVSER

SEQ ID NO: 56521 - protein, 150 aa, Homo sapiens
  Payload ID: 11106
  Gene Symbol: NGEF
  Gene Name: neuronal guanine nucleotide exchange factor
  ENSP ID: ENSP00000387591
MVVKACNEGVRKMSRTEQMISIQKKMEFKIKSVPIISHSRWLLKQGELQQMSGPKTSRTLRTKKLFHEIYLFLFNDLLVICRQIPGDKYQVFDSAPRGLLRVEELEDQGQTLANVFILRLLENADDREATYMLKASSQSEMKRWMTSLAP

SEQ ID NO: 56522 - protein, 187 aa, Homo sapiens
  Payload ID: 11106
  Gene Symbol: NGEF
  Gene Name: neuronal guanine nucleotide exchange factor
  ENSP ID: ENSP00000401063
MFELVTSEASYYKSLNLLVSHFMENERIRKILHPSEAHILFSNVLDVLAVSERFLLELEHRMEENIVISDVCDIVYRYAADHFSVYITYVSNQTYQERTYKQLLQEKAAFRELIAQLELDPKCRGLPFSSFLILPFQRITRLKLLVQNILKRVEERSERECTALDAHKELEMVVKACNEGVRKMSRT

SEQ ID NO: 56523 - protein, 97 aa, Homo sapiens
  Payload ID: 11106
  Gene Symbol: NGEF
  Gene Name: neuronal guanine nucleotide exchange factor
  ENSP ID: ENSP00000405053
  MOD_RES (1)..(1): Any amino acid
XELLPEKEETSQADQDIQDKEPHCHIPIKRNSIFNRSIRRKSKAKARDNPERNASCLADSQDNGKSVNEPLTLNIPWSRMPPCRTAMQTDPGAQEMR

SEQ ID NO: 56524 - protein, 234 aa, Homo sapiens
  Payload ID: 11107
  Gene Symbol: NPAS1
  Gene Name: neuronal PAS domain protein 1
  Uniprot ID: Q99742
  ENSP ID: ENSP00000398689
MTGSSVFDYIHPGDHSEVLEQLGLRTPTPGPPTPPSVSSSSSSSSSLADTPEIEASLTKVPPSSLVQERSFFVRMKSTLTKRGLHVKASGYKVIHVTGRLRAHALGLVALGHTLPPAPLAELPLHGHMIVFRLSLGLTILACESRVSDHMDLGPSELVGRSCYQFVHGQDATRIRQSHVDSCRGLRVAAVCGHSGWEREEPRGAPCALGQPRAQPSRGWPNSFGCLPASSQRGL

SEQ ID NO: 56525 - protein, 590 aa, Homo sapiens
  Payload ID: 11107
  Gene Symbol: NPAS1
  Gene Name: neuronal PAS domain protein 1
  Uniprot ID: Q99742
  ENSP ID: ENSP00000405290
MAAPYPGSGGGSEVKCVGGRGASVPWDFLPGLMVKAPSGPCLQAQRKEKSRNAARSRRGKENLEFFELAKLLPLPGAISSQLDKASIVRLSVTYLRLRRFAALGAPPWGLRAAGPPAGLAPGRRGPAALVSEVFEQHLGGHILQSLDGFVFALNQEGKFLYISETVSIYLGLSQVEMTGSSVFDYIHPGDHSEVLEQLGLRTPTPGPPTPPSVSSSSSSSSSLADTPEIEASLTKVPPSSLVQERSFFVRMKSTLTKRGLHVKASGYKVIHVTGRLRAHALGLVALGHTLPPAPLAELPLHGHMIVFRLSLGLTILACESRVSDHMDLGPSELVGRSCYQFVHGQDATRIRQSHVDLLDKGQVMTGYYRWLQRAGGFVWLQSVATVAGSGKSPGEHHVLWVSHVLSQAEGGQTPLDAFQLPASVACEEASSPGPEPTEPEPPTEGKQAAPAENEAPQTQGKRIKVEPGPRETKGSEDSGDEDPSSHPATPRPEFTSVIRAGVLKQDPVRPWGLAPPGDPPPTLLHAGFLPPVVRGLCTPGTIRYGPAELGLVYPHLQRLGPGPALPEAFYPPLGLPYPGPAGTRLPRKGD

SEQ ID NO: 56526 - protein, 95 aa, Homo sapiens
  Payload ID: 11107
  Gene Symbol: NPAS1
  Gene Name: neuronal PAS domain protein 1
  ENSP ID: ENSP00000468871
MTGSSVFDYIHPGDHSEVLEQLGLRTPTPGPPTPPSVSSSSSSSSSLADTPEIESATTWTWGPQSWWAAAATSLSTDRTPRGSARATWTCWTRVR

SEQ ID NO: 56527 - protein, 590 aa, Homo sapiens; identical to SEQ ID NO: 56525
  Payload ID: 11107
  Gene Symbol: NPAS1
  Gene Name: neuronal PAS domain protein 1
  Uniprot ID: Q99742
  ENSP ID: ENSP00000469142

SEQ ID NO: 56528 - protein, 214 aa, Homo sapiens
  Payload ID: 11107
  Gene Symbol: NPAS1
  Gene Name: neuronal PAS domain protein 1
  ENSP ID: ENSP00000472075
MTGSSVFDYIHPGDHSEVLEQLGLRTPTPGPPTPPSVSSSSSSSSSLADTPEIEASLTKVPPSSLVQERSFFVRMKSTLTKRGLHVKASGYKVIHVTGRLRAHALGLVALGHTLPPAPLAELPLHGHMIVFRLSLGLTILACESRVSDHMDLGPSELVGRSCYQFVHGQDATRIRQSHVDSCRGLRVAAVCGHSGWEREEPRGAPCALGQPRAQ

SEQ ID NO: 56529 - protein, 415 aa, Homo sapiens
  Payload ID: 11107
  Gene Symbol: NPAS1
  Gene Name: neuronal PAS domain protein 1
  ENSP ID: ENSP00000472679
MTGSSVFDYIHPGDHSEVLEQLGLRTPTPGPPTPPSVSSSSSSSSSLADTPEIEASLTKVPPSSLVQERSFFVRMKSTLTKRGLHVKASGYKQVIHVTGRLRAHALGLVALGHTLPPAPLAELPLHGHMIVFRLSLGLTILACESRVSDHMDLGPSELVGRSCYQFVHGQDATRIRQSHVDLLDKGQVMTGYYRWLQRAGGFVWLQSVATVAGSGKSPGEHHVLWVSHVLSQAEGGQTPLDAFQLPASVACEEASSPGPEPTEPEPPTEGKQAAPAENEAPQTQGKRIKVEPGPRETKGSEDSGDEDPSSHPATPRPEFTSVIRAGVLKQDPVRPWGLAPPGDPPPTLLHAGFLPPVVRGLCTPGTIRYGPAELGLVYPHLQRLGPGPALPEAFYPPLGLPYPGPAGTRLPRKGD

SEQ ID NO: 56530 - protein, 824 aa, Homo sapiens
  Payload ID: 11108
  Gene Symbol: NPAS2
  Gene Name: neuronal PAS domain protein 2
  Uniprot ID: Q99743
  ENSP ID: ENSP00000338283
MDEDEKDRAKRASRNKSEKKRRDQFNVLIKELSSMLPGNTRKMDKTTVLEKVIGFLQKHNEVSAQTEICDIQQDWKPSFLSNEEFTQLMLEALDGFIIAVTTDGSIIYVSDSITPLLGHLPSDVMDQNLLNFLPEQEHSEVYKILSSHMLVTDSPSPEYLKSDSDLEFYCHLLRGSLNPKEFPTYEYIKFVGNFRSYNNVPSPSCNGFDNTLSRPCRVPLGKEVCFIATVRLATPQFLKEMCIVDEPLEEFTSRHSLEWKFLFLDHRAPPIIGYLPFEVLGTSGYDYYHIDDLELLARCHQHLMQFGKGKSCCYRFLTKGQQWIWLQTHYYITYHQWNSKPEFIVCTHSVVSYADVRVERRQELALEDPPSEALHSSALKDKGSSLEPRQHFNTLDVGASGLNTSHSPSASSRSSHKSSHTAMSEPTSTPTKLMAEASTPALPRSATLPQELPVPGLSQAATMPAPLPSPSSCDLTQQLLPQTVLQSTPAPMAQFSAQFSMFQTIKDQLEQRTRILQANIRWQQEELHKIQEQLCLVQDSNVQMFLQQPAVSLSFSSTQRPEAQQQLQQRSAAVTQPQLGAGPQLPGQISSAQVTSQHLLRESSVISTQGPKPMRSSQLMQSSGRSGSSLVSPFSSATAALPPSLNLTTPASTSQDASQCQPSPDFSHDRQLRLLLSQPIQPMMPGSCDARQPSEVSRTGRQVKYAQSQTVFQNPDAHPANSSSAPMPVLLMGQAVLHPSFPASQPSPLQPAQARQQPPQHYLQVQAPTSLHSEQQDSLLLSTYSQQPGTLGYPQPPPAQPQPLRPPRRVSSLSESSGLQQPPR

SEQ ID NO: 56531 - protein, 258 aa, Homo sapiens
  Payload ID: 11108
  Gene Symbol: NPAS2
  Gene Name: neuronal PAS domain protein 2
  ENSP ID: ENSP00000388528
  MOD_RES (1)..(1): Any amino acid
XASRNKSEKKRRDQFNVLIKELSSMLPGNTRKMDKTTVLEKVIGFLQKHNEVSAQTEICDIQQDWKPSFLSNEEFTQLMLEALDGFIIAVTTDGSIIYVSDSITPLLGHLPSDVMDQNLLNFLPEQEHSEVYKILSSHMLVTDSPSPEYLKSDSDLEFYCHLLRGSLNPKEFPTYEYIKFVGNFRSYNNVMQFGKGKSCCYRFLTKGQQWIWLQTHYYITYHQWNSKPEFIVCTHSVVSYADVRVERRQELALEDPPS

SEQ ID NO: 56532 - protein, 202 aa, Homo sapiens
  Payload ID: 11108
  Gene Symbol: NPAS2
  Gene Name: neuronal PAS domain protein 2
  ENSP ID: ENSP00000392125
LNTSHSPSASSRSSHKSSHTAMSEPTSTPTKLMAEASTPALPRSATLPQELPVPGLSQAATMPAPLPSPSSCDLTQQLLPQTVLQSTPAPMAQFSAQFSMFQTIKDQLEQRTRILQANIRWQQEELHKIQEQLCLVQDSNVQVRPEPDRVSKSRRTPRQQQQRPDARPADGAGGAPPQLPCLPTIAPAACTGPAAATAALPA

SEQ ID NO: 56533 - protein, 269 aa, Homo sapiens
  Payload ID: 11108
  Gene Symbol: NPAS2
  Gene Name: neuronal PAS domain protein 2
  ENSP ID: ENSP00000393396
  MOD_RES (1)..(1): Any amino acid
XQTIKDQLEQRTRILQANIRWQQEELHKIQEQLCLVQDSNVQMFLQQPAVSLSFSSTQRPEAQQQLQQRSAAVTQPQLGAGPQLPGQISSAQVTSQHLLRESSVISTQGPKPMRSSQLMQSSGRSGSSLVSPFSSATAALPPSLNLTTPASTSQDASQCQPSPDFSHDRQLRLLLSQPIQPMMPGSCDARQPSEVSRTGRQVKYAQSQTVFQNPDAHPANSSSAPMPVLLMGQAVLHPSFPASQPSPLQPAQARQQPPQHYLQVLGHTL

SEQ ID NO: 56534 - protein, 107 aa, Homo sapiens
  Payload ID: 11108
  Gene Symbol: NPAS2
  Gene Name: neuronal PAS domain protein 2
  ENSP ID: ENSP00000395265
SEKKRRDQFNVLIKELSSMLPGNTRKMDKTTVLEKVIGFLQKHNGKEVSAQTEICDIQQDWKPSFLSNEEFTQLMLEALDGFIIAVTTDGSIIYVSDSITPLLGHLP

SEQ ID NO: 56535 - protein, 207 aa, Homo sapiens
  Payload ID: 11108
  Gene Symbol: NPAS2
  Gene Name: neuronal PAS domain protein 2
  ENSP ID: ENSP00000397595
MYAYGFVGRCAPFPAEEGRTFDLSEELGRSVTREGTGTTRLNSEPVPLLCLPLLNCSRKNCIENLMDEDEKDRAKRASRNKSEKKRRDQFNVLIKELSSMLPGNTRKMDKTTVLEKVIGFLQKHNEVSAQTEICDIQQDWKPSFLSNEEFTQLMLEALDGFIIAVTTDGSIIYVSDSITPLLGHLPSDVMDQNLLNFLPEQEHSEVY

SEQ ID NO: 56536 - protein, 901 aa, Homo sapiens
  Payload ID: 11109
  Gene Symbol: NPAS3
  Gene Name: neuronal PAS domain protein 3
  Uniprot ID: Q8IXF0
  ENSP ID: ENSP00000319610
MAPTKPSFQQDPSRRERLQALRKEKSRDAARSRRGKENFEFYELAKLLPLPAAITSQLDKASIIRLTISYLKMRDFANQGDPPWNLRMEGPPPNTSVKGAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVESTSPSLLTTDNTLERSFFIRMKSTLTKRGVHIKSSGYKVIHITGRLRLRVSLSHGRTVPSQIMGLVVVAHALPPPTINEVRIDCHMFVTRVNMDLNIIYCENRISDYMDLTPVDIVGKRCYHFIHAEDVEGIRHSHLDLLNKGQCVTKYYRWMQKNGGYIWIQSSATIAINAKNANEKNIIWVNYLLSNPEYKDTPMDIAQLPHLPEKTSESSETSDSESDSKDTSGITEDNENSKSDEKGNQSENSEDPEPDRKKSGNACDNDMNCNDDGHSSSNPDSRDSDDSFEHSDFENPKAGEDGFGALGAMQIKVERYVESESDLRLQNCESLTSDSAKDSDSAGEAGAQASSKHQKRKKRRKRQKGGSASRRRLSSASSPGGLDAGLVEPPRLLSSPNSASVLKIKTEISEPINFDNDSSIWNYPPNREISRNESPYSMTKPPSSEHFPSPQGGGGGGGGGGGLHVAIPDSVLTPPGADGAAARKTQFGASATAALAPVASDPLSPPLSASPRDKHPGNGGGGGGGGGGAGGGGPSASNSLLYTGDLEALQRLQAGNVVLPLVHRVTGTLAATSTAAQRVYTTGTIRYAPAEVTLAMQSNLLPNAHAVNFVDVNSPGFGLDPKTPMEMLYHHVHRLNMSGPFGGAVSAASLTQMPAGNVFTTAEGLFSTLPFPVYSNGIHAAQTLERKED

SEQ ID NO: 56537 - protein, 933 aa, Homo sapiens
  Payload ID: 11109
  Gene Symbol: NPAS3
  Gene Name: neuronal PAS domain protein 3
  Uniprot ID: Q8IXF0
  ENSP ID: ENSP00000348460
MAPTKPSFQQDPSRRERITAQHPLPNQSECRKIYRYDGIYCESTYQNLQALRKEKSRDAARSRRGKENFEFYELAKLLPLPAAITSQLDKASIIRLTISYLKMRDFANQGDPPWNLRMEGPPPNTSVKVIGAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVESTSPSLLTTDNTLERSFFIRMKSTLTKRGVHIKSSGYKVIHITGRLRLRVSLSHGRTVPSQIMGLVVVAHALPPPTINEVRIDCHMFVTRVNMDLNIIYCENRISDYMDLTPVDIVGKRCYHFIHAEDVEGIRHSHLDLLNKGQCVTKYYRWMQKNGGYIWIQSSATIAINAKNANEKNIIWVNYLLSNPEYKDTPMDIAQLPHLPEKTSESSETSDSESDSKDTSGITEDNENSKSDEKGNQSENSEDPEPDRKKSGNACDNDMNCNDDGHSSSNPDSRDSDDSFEHSDFENPKAGEDGFGALGAMQIKVERYVESESDLRLQNCESLTSDSAKDSDSAGEAGAQASSKHQKRKKRRKRQKGGSASRRRLSSASSPGGLDAGLVEPPRLLSSPNSASVLKIKTEISEPINFDNDSSIWNYPPNREISRNESPYSMTKPPSSEHFPSPQGGGGGGGGGGGLHVAIPDSVLTPPGADGAAARKTQFGASATAALAPVASDPLSPPLSASPRDKHPGNGGGGGGGGGGAGGGGPSASNSLLYTGDLEALQRLQAGNVVLPLVHRVTGTLAATSTAAQRVYTTGTIRYAPAEVTLAMQSNLLPNAHAVNFVDVNSPGFGLDPKTPMEMLYHHVHRLNMSGPFGGAVSAASLTQMPAGNVFTTAEGLFSTLPFPVYSNGIHAAQTLERKED

SEQ ID NO: 56538 - protein, 920 aa, Homo sapiens
  Payload ID: 11109
  Gene Symbol: NPAS3
  Gene Name: neuronal PAS domain protein 3
  Uniprot ID: Q8IXF0
  ENSP ID: ENSP00000350446
MAPTKPSFQQDPSRRERLQALRKEKSRDAARSRRGKENFEFYELAKLLPLPAAITSQLDKASIIRLTISYLKMRDFANQGDPPWNLRMEGPPPNTSVKGIQMWKSELCMRKTPCEVIGAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVESTSPSLLTTDNTLERSFFIRMKSTLTKRGVHIKSSGYKVIHITGRLRLRVSLSHGRTVPSQIMGLVVVAHALPPPTINEVRIDCHMFVTRVNMDLNIIYCENRISDYMDLTPVDIVGKRCYHFIHAEDVEGIRHSHLDLLNKGQCVTKYYRWMQKNGGYIWIQSSATIAINAKNANEKNIIWVNYLLSNPEYKDTPMDIAQLPHLPEKTSESSETSDSESDSKDTSGITEDNENSKSDEKGNQSENSEDPEPDRKKSGNACDNDMNCNDDGHSSSNPDSRDSDDSFEHSDFENPKAGEDGFGALGAMQIKVERYVESESDLRLQNCESLTSDSAKDSDSAGEAGAQASSKHQKRKKRRKRQKGGSASRRRLSSASSPGGLDAGLVEPPRLLSSPNSASVLKIKTEISEPINFDNDSSIWNYPPNREISRNESPYSMTKPPSSEHFPSPQGGGGGGGGGGGLHVAIPDSVLTPPGADGAAARKTQFGASATAALAPVASDPLSPPLSASPRDKHPGNGGGGGGGGGGAGGGGPSASNSLLYTGDLEALQRLQAGNVVLPLVHRVTGTLAATSTAAQRVYTTGTIRYAPAEVTLAMQSNLLPNAHAVNFVDVNSPGFGLDPKTPMEMLYHHVHRLNMSGPFGGAVSAASLTQMPAGNVFTTAEGLFSTLPFPVYSNGIHAAQTLERKED

SEQ ID NO: 56539 - protein, 125 aa, Homo sapiens
  Payload ID: 11109
  Gene Symbol: NPAS3
  Gene Name: neuronal PAS domain protein 3
  ENSP ID: ENSP00000446700
ASIIRLTISYLKMRDFANQGDPPWNLRMEGPPPNTSVKVIGAQRRRSPSALAIEVFEAHLGSHILQSLDGFVFALNQEGKFLYISETVSIYLGLSQAQTLCSPLQSHRRPSRCSVAKLQSIYVTF

SEQ ID NO: 56540 - protein, 155 aa, Homo sapiens
  Payload ID: 11109
  Gene Symbol: NPAS3
  Gene Name: neuronal PAS domain protein 3
  ENSP ID: ENSP00000447213
MRDFANQGDPPWNLRMEGPPPNTSVKVIGAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVVCFPPASDQFLL

SEQ ID NO: 56541 - protein, 13 aa, Homo sapiens
  Payload ID: 11109
  Gene Symbol: NPAS3
  Gene Name: neuronal PAS domain protein 3
  ENSP ID: ENSP00000447858
  MOD_RES (1)..(1): Any amino acid
XSIYLGLSQAGVQ

SEQ ID NO: 56542 - protein, 906 aa, Homo sapiens
  Payload ID: 11109
  Gene Symbol: NPAS3
  Gene Name: neuronal PAS domain protein 3
  ENSP ID: ENSP00000448373
MGRAGAAANGTPQNVQGITSYQQRLQALRKEKSRDAARSRRGKENFEFYELAKLLPLPAAITSQLDKASIIRLTISYLKMRDFANQGDPPWNLRMEGPPPNTSVKVIGAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVESTSPSLLTTDNTLERSFFIRMKSTLTKRGVHIKSSGYKVIHITGRLRLRVSLSHGRTVPSQIMGLVVVAHALPPPTINEVRIDCHMFVTRVNMDLNIIYCENRISDYMDLTPVDIVGKRCYHFIHAEDVEGIRHSHLDLLNKGQCVTKYYRWMQKNGGYIWIQSSATIAINAKNANEKNIIWVNYLLSNPEYKDTPMDIAQLPHLPEKTSESSETSDSESDSKDTSEDNENSKSDEKGNQSENSEDPEPDRKKSGNACDNDMNCNDDGHSSSNPDSRDSDDSFEHSDFENPKAGEDGFGALGAMQIKVERYVESESDLRLQNCESLTSDSAKDSDSAGEAGAQASSKHQKRKKRRKRQKGGSASRRRLSSASSPGGLDAGLVEPPRLLSSPNSASVLKIKTEISEPINFDNDSSIWNYPPNREISRNESPYSMTKPPSSEHFPSPQGGGGGGGGGGGLHVAIPDSVLTPPGADGAAARKTQFGASATAALAPVASDPLSPPLSASPRDKHPGNGGGGGGGGGGAGGGGPSASNSLLYTGDLEALQRLQAGNVVLPLVHRVTGTLAATSTAAQRVYTTGTIRYAPAEVTLAMQSNLLPNAHAVNFVDVNSPGFGLDPKTPMEMLYHHVHRLNMSGPFGGAVSAASLTQMPAGNVFTTAEGLFSTLPFPVYSNGIHAAQTLERKE

SEQ ID NO: 56543 - protein, 132 aa, Homo sapiens
  Payload ID: 11109
  Gene Symbol: NPAS3
  Gene Name: neuronal PAS domain protein 3
  ENSP ID: ENSP00000448450
  MOD_RES (1)..(1): Any amino acid
XTDNTLERSFFIRMKSTLTKRGVHIKSSGYKVIHITGRLRLRVSLSHGRTVPSQIMGLVVVAHALPPPTINEVRIDCHMFVTRVNMDLNIIYCENRISDYMDLTPVDIVGKRCYHFIHAEDVEGIRHSHLDS

SEQ ID NO: 56544 - protein, 903 aa, Homo sapiens
  Payload ID: 11109
  Gene Symbol: NPAS3
  Gene Name: neuronal PAS domain protein 3
  Uniprot ID: Q8IXF0
  ENSP ID: ENSP00000448916
MAPTKPSFQQDPSRRERLQALRKEKSRDAARSRRGKENFEFYELAKLLPLPAAITSQLDKASIIRLTISYLKMRDFANQGDPPWNLRMEGPPPNTSVKVIGAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVESTSPSLLTTDNTLERSFFIRMKSTLTKRGVHIKSSGYKVIHITGRLRLRVSLSHGRTVPSQIMGLVVVAHALPPPTINEVRIDCHMFVTRVNMDLNIIYCENRISDYMDLTPVDIVGKRCYHFIHAEDVEGIRHSHLDLLNKGQCVTKYYRWMQKNGGYIWIQSSATIAINAKNANEKNIIWVNYLLSNPEYKDTPMDIAQLPHLPEKTSESSETSDSESDSKDTSGITEDNENSKSDEKGNQSENSEDPEPDRKKSGNACDNDMNCNDDGHSSSNPDSRDSDDSFEHSDFENPKAGEDGFGALGAMQIKVERYVESESDLRLQNCESLTSDSAKDSDSAGEAGAQASSKHQKRKKRRKRQKGGSASRRRLSSASSPGGLDAGLVEPPRLLSSPNSASVLKIKTEISEPINFDNDSSIWNYPPNREISRNESPYSMTKPPSSEHFPSPQGGGGGGGGGGGLHVAIPDSVLTPPGADGAAARKTQFGASATAALAPVASDPLSPPLSASPRDKHPGNGGGGGGGGGGAGGGGPSASNSLLYTGDLEALQRLQAGNVVLPLVHRVTGTLAATSTAAQRVYTTGTIRYAPAEVTLAMQSNLLPNAHAVNFVDVNSPGFGLDPKTPMEMLYHHVHRLNMSGPFGGAVSAASLTQMPAGNVFTTAEGLFSTLPFPVYSNGIHAAQTLERKED

SEQ ID NO: 56545 - protein, 153 aa, Homo sapiens
  Payload ID: 11109
  Gene Symbol: NPAS3
  Gene Name: neuronal PAS domain protein 3
  Uniprot ID: Q8IXF0
  ENSP ID: ENSP00000449542
MRDFANQGDPPWNLRMEGPPPNTSVKGAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVVCFPPASDQFLL

SEQ ID NO: 56546 - protein, 938 aa, Homo sapiens
  Payload ID: 11109
  Gene Symbol: NPAS3
  Gene Name: neuronal PAS domain protein 3
  ENSP ID: ENSP00000450392
MGRAGAAANGTPQNVQGITSYQQRITAQHPLPNQSECRKIYRYDGIYCESTYQNLQALRKEKSRDAARSRRGKENFEFYELAKLLPLPAAITSQLDKASIIRLTISYLKMRDFANQGDPPWNLRMEGPPPNTSVKGAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVESTSPSLLTTDNTLERSFFIRMKSTLTKRGVHIKSSGYKVIHITGRLRLRVSLSHGRTVPSQIMGLVVVAHALPPPTINEVRIDCHMFVTRVNMDLNIIYCENRISDYMDLTPVDIVGKRCYHFIHAEDVEGIRHSHLDLLNKGQCVTKYYRWMQKNGGYIWIQSSATIAINAKNANEKNIIWVNYLLSNPEYKDTPMDIAQLPHLPEKTSESSETSDSESDSKDTSGITEDNENSKSDEKGNQSENSEDPEPDRKKSGNACDNDMNCNDDGHSSSNPDSRDSDDSFEHSDFENPKAGEDGFGALGAMQIKVERYVESESDLRLQNCESLTSDSAKDSDSAGEAGAQASSKHQKRKKRRKRQKGGSASRRRLSSASSPGGLDAGLVEPPRLLSSPNSASVLKIKTEISEPINFDNDSSIWNYPPNREISRNESPYSMTKPPSSEHFPSPQGGGGGGGGGGGLHVAIPDSVLTPPGADGAAARKTQFGASATAALAPVASDPLSPPLSASPRDKHPGNGGGGGGGGGGAGGGGPSASNSLLYTGDLEALQRLQAGNVVLPLVHRVTGTLAATSTAAQRVYTTGTIRYAPAEVTLAMQSNLLPNAHAVNFVDVNSPGFGLDPKTPMEMLYHHVHRLNMSGPFGGAVSAASLTQMPAGNVFTTAEGLFSTLPFPVYSNGIHAAQTLERKED

SEQ ID NO: 56547 - protein, 802 aa, Homo sapiens
  Payload ID: 11110
  Gene Symbol: NPAS4
  Gene Name: neuronal PAS domain protein 4
  Uniprot ID: Q8IUM7
  ENSP ID: ENSP00000311196
MYRSTKGASKARRDQINAEIRNLKELLPLAEADKVRLSYLHIMSLACIYTRKGVFFAGGTPLAGPTGLLSAQELEDIVAALPGFLLVFTAEGKLLYLSESVSEHLGHSMVDLVAQGDSIYDIIDPADHLTVRQQLTLPSALDTDRLFRCRFNTSKSLRRQSAGNKLVLIRGRFHAHPPGAYWAGNPVFTAFCAPLEPRPRPGPGPGPGPASLFLAMFQSRHAKDLALLDISESVLIYLGFERSELLCKSWYGLLHPEDLAHASAQHYRLLAESGDIQAEMVVRLQAKTGGWAWIYCLLYSEGPEGPITANNYPISDMEAWSLRQQLNSEDTQAAYVLGTPTMLPSFPENILSQEECSSTNPLFTAALGAPRSTSFPSAPELSVVSASEELPRPSKELDFSYLTFPSGPEPSLQAELSKDLVCTPPYTPHQPGGCAFLFSLHEPFQTHLPTPSSTLQEQLTPSTATFSDQLTPSSATFPDPLTSPLQGQLTETSVRSYEDQLTPCTSTFPDQLLPSTATFPEPLGSPAHEQLTPPSTAFQAHLDSPSQTFPEQLSPNPTKTYFAQEGCSFLYEKLPPSPSSPGNGDCTLLALAQLRGPLSVDVPLVPEGLLTPEASPVKQSFFHYSEKEQNEIDRLIQQISQLAQGMDRPFSAEAGTGGLEPLGGLEPLDSNLSLSGAGPPVLSLDLKPWKCQELDFLADPDNMFLEETPVEDIFMDLSTPDPSEEWGSGDPEAEGPGGAPSPCNNLSPEDHSFLEDLATYETAFETGVSAFPYDGFTDELHQLQSQVQDSFHEDGSGGEPTF

SEQ ID NO: 56548 - protein, 234 aa, Homo sapiens
  Payload ID: 11110
  Gene Symbol: NPAS4
  Gene Name: neuronal PAS domain protein 4
  Uniprot ID: Q8IUM7
  ENSP ID: ENSP00000433135
MYRSTKGASKARRDQINAEIRNLKELLPLAEADKVRLSYLHIMSLACIYTRKGVFFAGGTPLAGPTGLLSAQELEDIVAALPGFLLVFTAEGKLLYLSESVSEHLGHSMVDLVAQGDSIYDIIDPADHLTVRQQLTLPSALDTDRLFRCRFNTSKSLRRQSAGNKLVLIRGRFHAHPPGAYWAGNPVFTAFCAPLEPRPRPGPGPGPGPASLFLAMFQSRHAKDLALLDISESG

SEQ ID NO: 56549 - protein, 432 aa, Homo sapiens
  Payload ID: 11111
  Gene Symbol: NPTX1
  Gene Name: neuronal pentraxin I
  Uniprot ID: Q15818
  ENSP ID: ENSP00000307549
MPAGRAARTCALLALCLLGAGAQDFGPTRFICTSVPVDADMCAASVAAGGAEELRSSVLQLRETVLQQKETILSQKETIRELTAKLGRCESQSTLDPGAGEARAGGGRKQPGSGKNTMGDLSRTPAAETLSQLGQTLQSLKTRLENLEQYSRLNSSSQTNSLKDLLQSKIDELERQVLSRVNTLEEGKGGPRNDTEERVKIETALTSLHQRISELEKGQKDNRPGDKFQLTFPLRTNYMYAKVKKSLPEMYAFTVCMWLKSSATPGVGTPFSYAVPGQANELVLIEWGNNPMEILINDKVAKLPFVINDGKWHHICVTWTTRDGVWEAYQDGTQGGSGENLAPYHPIKPQGVLVLGQEQDTLGGGFDATQAFVGELAHFNIWDRKLTPGEVYNLATCSTKALSGNVIAWAESHIEIYGGATKWTFEACRQIN

SEQ ID NO: 56550 - protein, 431 aa, Homo sapiens
  Payload ID: 11112
  Gene Symbol: NPTX2
  Gene Name: neuronal pentraxin II
  Uniprot ID: P47972
  ENSP ID: ENSP00000265634
MLALLAASVALAVAAGAQDSPAPGSRFVCTALPPEAVHAGCPLPAMPMQGGAQSPEEELRAAVLQLRETVVQQKETLGAQREAIRELTGKLARCEGLAGGKARGAGATGKDTMGDLPRDPGHVVEQLSRSLQTLKDRLESLEHQLRANVSNAGLPGDFREVLQQRLGELERQLLRKVAELEDEKSLLHNETSAHRQKTESTLNALLQRVTELERGNSAFKSPDAFKVSLPLRTNYLYGKIKKTLPELYAFTICLWLRSSASPGIGTPFSYAVPGQANEIVLIEWGNNPIELLINDKVAQLPLFVSDGKWHHICVTWTTRDGMWEAFQDGEKLGTGENLAPWHPIKPGGVLILGQEQDTVGGRFDATQAFVGELSQFNIWDRVLRAQEIVNIANCSTNMPGNIIPWVDNNVDVFGGASKWPVETCEERLLDL

SEQ ID NO: 56551 - protein, 500 aa, Homo sapiens
  Payload ID: 11113
  Gene Symbol: NPTXR
  Gene Name: neuronal pentraxin receptor
  Uniprot ID: O95502
  ENSP ID: ENSP00000327545
LKFLAVLLAAGMLAFLGAVICIIASVPLAASPARALPGGADNASVASGAAASPGPQRSLSALHGAGGSAGPPALPGAPAASAHPLPPGPLFSRFLCTPLAAACPSGAQQGDAAGAAPGEREELLLLQSTAEQLRQTALQQEARIRADQDTIRELTGKLGRCESGLPRGLQGAGPRRDTMADGPWDSPALILELEDAVRALRDRIDRLEQELPARVNLSAAPAPVSAVPTGLHSKMDQLEGQLLAQVLALEKERVALSHSSRRQRQEVEKELDVLQGRVAELEHGSSAYSPPDAFKISIPIRNNYMYARVRKALPELYAFTACMWLRSRSSGTGQGTPFSYSVPGQANEIVLLEAGHEPMELLINDKVAQLPLSLKDNGWHHICIAWTTRDGLWSAYQDGELQGSGENLAAWHPIKPHGILILGQEQDTLGGRFDATQAFVGDIAQFNLWDHALTPAQVLGIANCTAPLLGNVLPWEDKLVEAFGGATKAAFDVCKGRAKA

SEQ ID NO: 56552 - protein, 68 aa, Homo sapiens
  Payload ID: 11114
  Gene Symbol: NREP
  Gene Name: neuronal regeneration related protein
  Uniprot ID: Q16612
  ENSP ID: ENSP00000257435
MVYYPELFVWVSQEPFPNKDMEGRLPKGRLPVPKEVNRKKNDETNAASLTPLGSSELRSPRISYLHFF

SEQ ID NO: 56553 - protein, 68 aa, Homo sapiens; identical to SEQ ID NO: 56552
  Payload ID: 11114
  Gene Symbol: NREP
  Gene Name: neuronal regeneration related protein
  Uniprot ID: Q16612
  ENSP ID: ENSP00000368993

SEQ ID NO: 56554 - protein, 112 aa, Homo sapiens
  Payload ID: 11114
  Gene Symbol: NREP
  Gene Name: neuronal regeneration related protein
  Uniprot ID: Q16612
  ENSP ID: ENSP00000378996
MKGVWNYSALSRREDETRTQRSRMTDRVPCSKCFQVHCQISVLNCVYYPELFVWVSQEPFPNKDMEGRLPKGRLPVPKEVNRKKNDETNAASLTPLGSSELRSPRISYLHFF

SEQ ID NO: 56555 - protein, 68 aa, Homo sapiens; identical to SEQ ID NO: 56552
  Payload ID: 11114
  Gene Symbol: NREP
  Gene Name: neuronal regeneration related protein
  Uniprot ID: Q16612
  ENSP ID: ENSP00000392559

SEQ ID NO: 56556 - protein, 68 aa, Homo sapiens; identical to SEQ ID NO: 56552
  Payload ID: 11114
  Gene Symbol: NREP
  Gene Name: neuronal regeneration related protein
  Uniprot ID: Q16612
  ENSP ID: ENSP00000399766

SEQ ID NO: 56557 - protein, 68 aa, Homo sapiens; identical to SEQ ID NO: 56552
  Payload ID: 11114
  Gene Symbol: NREP
  Gene Name: neuronal regeneration related protein
  Uniprot ID: Q16612
  ENSP ID: ENSP00000402965

SEQ ID NO: 56558 - protein, 68 aa, Homo sapiens; identical to SEQ ID NO: 56552
  Payload ID: 11114
  Gene Symbol: NREP
  Gene Name: neuronal regeneration related protein
  Uniprot ID: Q16612
  ENSP ID: ENSP00000403383

SEQ ID NO: 56559 - protein, 68 aa, Homo sapiens; identical to SEQ ID NO: 56552
  Payload ID: 11114
  Gene Symbol: NREP
  Gene Name: neuronal regeneration related protein
  Uniprot ID: Q16612
  ENSP ID: ENSP00000408839

SEQ ID NO: 56560 - protein, 68 aa, Homo sapiens; identical to SEQ ID NO: 56552
  Payload ID: 11114
  Gene Symbol: NREP
  Gene Name: neuronal regeneration related protein
  Uniprot ID: Q16612
  ENSP ID: ENSP00000416617

SEQ ID NO: 56561 - protein, 33 aa, Homo sapiens
  Payload ID: 11114
  Gene Symbol: NREP
  Gene Name: neuronal regeneration related protein
  ENSP ID: ENSP00000422046
MVYYPELFVWVSQEPFPNKDMEGRLPKGRLPVP

SEQ ID NO: 56562 - protein, 35 aa, Homo sapiens
  Payload ID: 11114
  Gene Symbol: NREP
  Gene Name: neuronal regeneration related protein
  ENSP ID: ENSP00000422278
MVYYPELFVWVSQEPFPNKDMEGRLPKLRKKNRIH

SEQ ID NO: 56563 - protein, 5 aa, Homo sapiens
  Payload ID: 11114
  Gene Symbol: NREP
  Gene Name: neuronal regeneration related protein
  ENSP ID: ENSP00000422514
MVYYP

SEQ ID NO: 56564 - protein, 68 aa, Homo sapiens; identical to SEQ ID NO: 56552
  Payload ID: 11114
  Gene Symbol: NREP
  Gene Name: neuronal regeneration related protein
  Uniprot ID: Q16612
  ENSP ID: ENSP00000422630

SEQ ID NO: 56565 - protein, 35 aa, Homo sapiens; identical to SEQ ID NO: 56562
  Payload ID: 11114
  Gene Symbol: NREP
  Gene Name: neuronal regeneration related protein
  ENSP ID: ENSP00000423320

SEQ ID NO: 56566 - protein, 37 aa, Homo sapiens
  Payload ID: 11114
  Gene Symbol: NREP
  Gene Name: neuronal regeneration related protein
  ENSP ID: ENSP00000426834
MVYYPELFVWVSQEPFPNKDMEGRLPKETSLSPFMES

SEQ ID NO: 56567 - protein, 68 aa, Homo sapiens; identical to SEQ ID NO: 56552
  Payload ID: 11114
  Gene Symbol: NREP
  Gene Name: neuronal regeneration related protein
  Uniprot ID: Q16612
  ENSP ID: ENSP00000427149

SEQ ID NO: 56568 - protein, 65 aa, Homo sapiens
  Payload ID: 11114
  Gene Symbol: NREP
  Gene Name: neuronal regeneration related protein
  ENSP ID: ENSP00000427476
MVYYPELFVWVSQEPFPNKDMEGRLPKGRLPVPKEVNRKKNDETNAASLTPLGSSELRSPRISYL

SEQ ID NO: 56569 - protein, 37 aa, Homo sapiens; identical to SEQ ID NO: 56566
  Payload ID: 11114
  Gene Symbol: NREP
  Gene Name: neuronal regeneration related protein
  ENSP ID: ENSP00000427595

SEQ ID NO: 56570 - protein, 841 aa, Homo sapiens
  Payload ID: 11115
  Gene Symbol: NYAP1
  Gene Name: neuronal tyrosine-phosphorylated phosphoinositide-3-kinase adaptor 1
  Uniprot ID: Q6ZVC0
  ENSP ID: ENSP00000300179
MNLLYRKTKLEWRQHKEEEAKRSSSKEVAPAGSAGPAAGQGPGVRVRDIASLRRSLRMGFMTMPASQEHTPHPCRSAMAPRSLSCHSVGSMDSVGGGPGGASGGLTEDSSTRRPPAKPRRHPSTKLSMVGPGSGAETPPSKKAGSQKPTPEGRESSRKVPPQKPRRSPNTQLSVSFDESCPPGPSPRGGNLPLQRLTRGSRVAGDPDVGAQEEPVYIEMVGDVFRGGGRSGGGLAGPPLGGGGPTPPAGADSDSEESEAIYEEMKYPLPEEAGEGRANGPPPLTATSPPQQPHALPPHAHRRPASALPSRRDGTPTKTTPCEIPPPFPNLLQHRPPLLAFPQAKSASRTPGDGVSRLPVLCHSKEPAGSTPAPQVPARERETPPPPPPPPAANLLLLGPSGRARSHSTPLPPQGSGQPRGERELPNSHSMICPKAAGAPAAPPAPAALLPGPPKDKAVSYTMVYSAVKVTTHSVLPAGPPLGAGEPKTEKEISVLHGMLCTSSRPPVPGKTSPHGGAMGAAAGVLHHRGCLASPHSLPDPTVGPLTPLWTYPATAAGLKRPPAYESLKAGGVLNKGCGVGAPSPMVKIQLQEQGTDGGAFASISCAHVIASAGTPEEEEEEVGAATFGAGWALQRKVLYGGRKAKELDKVEDGARAWNGSAEGPGKVEREDRGPGTSGIPVRSQGAEGLLARIHHGDRGGSRTALPIPCQTFPACHRNGDFTGGYRLGRSASTSGVRQVVLHTPRPCSQPRDALSQPHPALPLPLPLPPQPARERDGKLLEVIERKRCVCKEIKARHRPDRGLCKQESMPILPSWRRGPEPRKSGTPPCRRQHTVLWDTAI

SEQ ID NO: 56571 - protein, 785 aa, Homo sapiens
  Payload ID: 11115
  Gene Symbol: NYAP1
  Gene Name: neuronal tyrosine-phosphorylated phosphoinositide-3-kinase adaptor 1
  ENSP ID: ENSP00000394424
MGFMTMPASQEHTPHPCRSAMAPRSLSCHSVGSMDSVGGGPGGASGGLTEDSSTRRPPAKPRRHPSTKLSMVGPGSGAETPPSKKAGSQKPTPEGRESSRKVPPQKPRRSPNTQLSVSFDESCPPGPSPRGGNLPLQRLTRGSRVAGDPDVGAQEEPVYIEMVGDVFRGGGRSGGGLAGPPLGGGGPTPPAGADSDSEESEAIYEEMKYPLPEEAGEGRANGPPPLTATSPPQQPHALPPHAHRRPASALPSRRDGTPTKTTPCEIPPPFPNLLQHRPPLLAFPQAKSASRTPGDGVSRLPVLCHSKEPAGSTPAPQVPARERETPPPPPPPPAANLLLLGPSGRARSHSTPLPPQGSGQPRGERELPNSHSMICPKAAGAPAAPPAPAALLPGPPKDKAVSYTMVYSAVKVTTHSVLPAGPPLGAGEPKTEKEISVLHGMLCTSSRPPVPGKTSPHGGAMGAAAGVLHHRGCLASPHSLPDPTVGPLTPLWTYPATAAGLKRPPAYESLKAGGVLNKGCGVGAPSPMVKIQLQEQGTDGGAFASISCAHVIASAGTPEEEEEEVGAATFGAGWALQRKVLYGGRKAKELDTEVEDGARAWNGSAEGPGKVEREDRGPGTSGIPVRSQGAEGLLARIHHGDRGGSRTALPIPCQTFPACHRNGDFTGGYRLGRSASTSGVRQVVLHTPRPCSQPRDALSQPHPALPLPLPLPPQPARERDGKLLEVIERKRCVCKEIKARHRPDRGLCKQESMPILPSWRRGPEPRKSGTPPCRRQHTVLWDTAI

SEQ ID NO: 56572 - protein, 653 aa, Homo sapiens
  Payload ID: 11116
  Gene Symbol: NYAP2
  Gene Name: neuronal tyrosine-phosphorylated phosphoinositide-3-kinase adaptor 2
  Uniprot ID: Q9P242
  ENSP ID: ENSP00000272907
MISSKMMSSNPEEDPLDTFLQYIEDMGMKAYDGLVIQNASDIARENDRLRNETNLAYLKEKNEKRRRQEEAIKRIGGEVGRGHEGSYVGKHFRMGFMTMPAPQDRLPHPCSSGFSVRSQSLHSVGGTDDDSSCGSRRQPPPKPKRDPSTKLSTSSETVSSTAASKSGKTPERTEASAKPRPHSDEYSKKIPPPKPKRNPNTQLSTSFDETYIKKHGPRRTSLPRDSSLSQMGSPAGDPEEEEPVYIEMVGNILRDFRKEDDDQSEAVYEEMKYPIFDDLGQDAKCDFDHHSCSSQCATPTVPDLDFAKASVPCPPKGLLCDIPPPFPNLLSHRPPLLVFPPAPVHCSPNSDESPLTPLEVTKLPVLENVSYMKQPAGASPSTLPSHVPGHAKLEKEQAAALGPASATPALSSSPPPPSTLYRTQSPHGYPKSHSTSPSPVSMGRSLTPLSLKRPPPYDAVHSGSLSRSSPSVPHSTPRPVSQDGAKMVNAAVNTYGAAPGGSRSRTPTSPLEELTSLFSSGRSLLRKSSSGRRSKEPAEKSTEELKVRSHSTEPLPKLDNKERGHHGASSSREPVKAQEWDGTPGTPVVTSRLGRCSVSPTLLAGNHSSEPKVSCKLGRSASTSGVPPPSVTPLRQSSDLQQSQVPSSLANRD

SEQ ID NO: 56573 - protein, 81 aa, Homo sapiens
  Payload ID: 11117
  Gene Symbol: NNAT
  Gene Name: neuronatin
  Uniprot ID: Q16517
  ENSP ID: ENSP00000062104
MAAVAAASAELLIIGWYIFRVLLQVFLECCIYWVGFAFRNPPGTQPIARSEVFRYSLQKLAYTVSRTGRQVLGERRQRAPN

SEQ ID NO: 56574 - protein, 54 aa, Homo sapiens
  Payload ID: 11117
  Gene Symbol: NNAT
  Gene Name: neuronatin
  Uniprot ID: Q16517
  ENSP ID: ENSP00000335497
MAAVAAASAELLIIGWYIFRVLLQVFRYSLQKLAYTVSRTGRQVLGERRQRAPN

SEQ ID NO: 56575 - protein, 568 aa, Homo sapiens
  Payload ID: 11118
  Gene Symbol: NDNF
  Gene Name: neuron-derived neurotrophic factor
  Uniprot ID: Q8TB73
  ENSP ID: ENSP00000369014
MVLLHWCLLWLLFPLSSRTQKLPTRDEELFQMQIRDKAFFHDSSVIPDGAEISSYLFRDTPKRYFFVVEEDNTPLSVTVTPCDAPLEWKLSLQELPEDRSGEGSGDLEPLEQQKQQIINEEGTELFSYKGNDVEYFISSSSPSGLYQLDLLSTEKDTHFKVYATTTPESDQPYPELPYDPRVDVTSLGRTTVTLAWKPSPTASLLKQPIQYCVVINKEHNFKSLCAVEAKLSADDAFMMAPKPGLDFSPFDFAHFGFPSDNSGKERSFQAKPSPKLGRHVYSRPKVDIQKICIGNKNIFTVSDLKPDTQYYFDVFVVNINSNMSTAYVGTFARTKEEAKQKTVELKDGKITDVFVKRKGAKFLRFAPVSSHQKVTFFIHSCLDAVQIQVRRDGKLLLSQNVEGIQQFQLRGKPKAKYLVRLKGNKKGASMLKILATTRPTKQSFPSLPEDTRIKAFDKLRTCSSATVAWLGTQERNKFCIYKKEVDDNYNEDQKKREQNQCLGPDIRKKSEKVLCKYFHSQNLQKAVTTETIKGLQPGKSYLLDVYVIGHGGHSVKYQSKVVKTRKFC

SEQ ID NO: 56576 - protein, 145 aa, Homo sapiens
  Payload ID: 11118
  Gene Symbol: NDNF
  Gene Name: neuron-derived neurotrophic factor
  ENSP ID: ENSP00000423352
MVLLHWCLLWLLFPLSSRTQKLPTRDEELFQMQIRDKAFFHDSSVIPDGAEISSYLFRDTPKRYFFVVEEDNTPLSVTVTPCDAPLEWKLSLQELPEDRSGEGSGDLEPLEQQKQQIINEEGTELFSYKGNDVEYFISSSSPSGL

SEQ ID NO: 56577 - protein, 116 aa, Homo sapiens
  Payload ID: 11118
  Gene Symbol: NDNF
  Gene Name: neuron-derived neurotrophic factor
  ENSP ID: ENSP00000426723
MVLLHWCLLWLLFPLSSRTQKLPTRDEELFQMQIRDKAFFHDSSVIPDGAEISSYLFRDTPKRYFFVVEEDNTPLSVTVTPCDAPLEWKLSLQELPEDRSGEGSGDLEPLEQQKQQ

SEQ ID NO: 56578 - protein, 109 aa, Homo sapiens
  Payload ID: 11119
  Gene Symbol: NOVA1
  Gene Name: neuro-oncological ventral antigen 1
  ENSP ID: ENSP00000299472
MPQNVAKTEPVSILQPQTTVNPDRIKQVKIIVPNSTAGLIIGKGGATVKAVMEQSGAWVQLSQKPDGINLQERVVTVSGEPEQNRKAVELIIQKIQEDPQSGSCLNISY

SEQ ID NO: 56579 - protein, 181 aa, Homo sapiens
  Payload ID: 11119
  Gene Symbol: NOVA1
  Gene Name: neuro-oncological ventral antigen 1
  Uniprot ID: P51513
  ENSP ID: ENSP00000342387
MMAAAPIQQNGTHTGVPIDLDPPDSRKRPLEAPPEAGSTKRTNTGEDGQYFLKVLIPSYAAGSIIGKGGQTIVQLQKETGATIKLSKSKDFYPGTTERVCLIQGTVEALNAVHGFIAEKIREMPQNVAKTEPVSILQPQTTVNPDRIKQTLPSSPTTTKSSPSDPMTTSRANQKHNISWIS

SEQ ID NO: 56580 - protein, 277 aa, Homo sapiens
  Payload ID: 11119
  Gene Symbol: NOVA1
  Gene Name: neuro-oncological ventral antigen 1
  ENSP ID: ENSP00000408914
MLSEEDGQYFLKVLIPSYAAGSIIGKGGQTIVQLQKETGATIKLSKSKDFYPGTTERVCLIQGTVEALNAVHGFIAEKIREMPQNVAKTEPVSILQPQTTVNPDRIKQTLPSSPTTTKSSPSDPMTTSRANQVKIIVPNSTAGLIIGKGGATVKAVMEQSGAWVQLSQKPDGINLQERVVTVSGEPEQNRKAVELIIQKIQEDPQSGSCLNISYANVTGPVANSNPTGSPYANTAEVLPTAAAAAGLLGHANLAGVAAFPAVLSGFTGNDLVAITSA

SEQ ID NO: 56581 - protein, 507 aa, Homo sapiens
  Payload ID: 11119
  Gene Symbol: NOVA1
  Gene Name: neuro-oncological ventral antigen 1
  Uniprot ID: P51513
  ENSP ID: ENSP00000438875
MMAAAPIQQNGTHTGVPIDLDPPDSRKRPLEAPPEAGSTKRTNTGEDGQYFLKVLIPSYAAGSIIGKGGQTIVQLQKETGATIKLSKSKDFYPGTTERVCLIQGTVEALNAVHGFIAEKIREMPQNVAKTEPVSILQPQTTVNPDRIKQTLPSSPTTTKSSPSDPMTTSRANQVKIIVPNSTAGLIIGKGGATVKAVMEQSGAWVQLSQKPDGINLQERVVTVSGEPEQNRKAVELIIQKIQEDPQSGSCLNISYANVTGPVANSNPTGSPYANTAEVLPTAAAAAGLLGHANLAGVAAFPAVLSGFTGNDLVAITSALNTLASYGYNLNTLGLGLSQAAATGALAAAAASANPAAAAANLLATYASEASASGSTAGGTAGTFALGSLAAATAATNGYFGAASPLAASAILGTEKSTDGSKDVVEIAVPENLVGAILGKGGKTLVEYQELTGARIQISKKGEFVPGTRNRKVTITGTPAATQAAQYLITQRITYEQGVRAANPQKVG

SEQ ID NO: 56582 - protein, 483 aa, Homo sapiens
  Payload ID: 11119
  Gene Symbol: NOVA1
  Gene Name: neuro-oncological ventral antigen 1
  Uniprot ID: P51513
  ENSP ID: ENSP00000447391
MMAAAPIQQNGTHTGVPIDLDPPDSRKRPLEAPPEAGSTKRTNTGEDGQYFLKVLIPSYAAGSIIGKGGQTIVQLQKETGATIKLSKSKDFYPGTTERVCLIQGTVEALNAVHGFIAEKIREMPQNVAKTEPVSILQPQTTVNPDRIKQVKIIVPNSTAGLIIGKGGATVKAVMEQSGAWVQLSQKPDGINLQERVVTVSGEPEQNRKAVELIIQKIQEDPQSGSCLNISYANVTGPVANSNPTGSPYANTAEVLPTAAAAAGLLGHANLAGVAAFPAVLSGFTGNDLVAITSALNTLASYGYNLNTLGLGLSQAAATGALAAAAASANPAAAAANLLATYASEASASGSTAGGTAGTFALGSLAAATAATNGYFGAASPLAASAILGTEKSTDGSKDVVEIAVPENLVGAILGKGGKTLVEYQELTGARIQISKKGEFVPGTRNRKVTITGTPAATQAAQYLITQRITYEQGVRAANPQKVG

SEQ ID NO: 56583 - protein, 49 aa, Homo sapiens
  Payload ID: 11119
  Gene Symbol: NOVA1
  Gene Name: neuro-oncological ventral antigen 1
  ENSP ID: ENSP00000448144
VQLQKETGATIKLSKSKDFYPGADSCRRNCTWCCTEGISPLCHLQSETD

SEQ ID NO: 56584 - protein, 211 aa, Homo sapiens
  Payload ID: 11119
  Gene Symbol: NOVA1
  Gene Name: neuro-oncological ventral antigen 1
  ENSP ID: ENSP00000448157
MMAAAPIQQNGTHTGVPIDLDPPDSRKRPLEAPPEAGSTKRTNTGEDGQYFLKVLIPSYAAGSIIGKGGQTIVQLQKETGATIKLSKSKDFYPGTTERVCLIQGTVEALNAVHGFIAEKIREMPQNVAKTEPVSILQPQTTVNPDRIKQTLPSSPTTTKSSPSDPMTTSRANQVQYHPVIYTILFTGDCLQTGEKDNGGLRIYSFIHIYAP

SEQ ID NO: 56585 - protein, 121 aa, Homo sapiens
  Payload ID: 11119
  Gene Symbol: NOVA1
  Gene Name: neuro-oncological ventral antigen 1
  ENSP ID: ENSP00000448956
MMAAAPIQQNGTHTGVPIDLDPPDSRKRPLEAPPEAGSTKRTNTGEDGQYFLKVLIPSYAAGSIIGKGGQTIVQLQKETGATIKLSKSKDFYPGADSCRRNCTWCCTEGISPLCHLQSETD

SEQ ID NO: 56586 - protein, 96 aa, Homo sapiens
  Payload ID: 11119
  Gene Symbol: NOVA1
  Gene Name: neuro-oncological ventral antigen 1
  ENSP ID: ENSP00000449113
MPQNVAKTEPVSILQPQTTVNPDRIKQTLPSSPTTTKSSPSDPMTTSRANQVKIIVPNSTAGLIIGKGGATVKAVMEQSGAWVQLSQKPDGINLQE

SEQ ID NO: 56587 - protein, 173 aa, Homo sapiens
  Payload ID: 11119
  Gene Symbol: NOVA1
  Gene Name: neuro-oncological ventral antigen 1
  ENSP ID: ENSP00000449185
MHPMHRSREDGQYFLKVLIPSYAAGSIIGKGGQTIVQLQKETGATIKLSKSKDFYPGTTERVCLIQGTVEALNAVHGFIAEKIREMPQNVAKTEPVSILQPQTTVNPDRIKQTLPSSPTTTKSSPSDPMTTSRANQVKIIVPNSTAGLIIGKGGATVKAVMEQSGAWVQLSQK

SEQ ID NO: 56588 - protein, 152 aa, Homo sapiens
  Payload ID: 11119
  Gene Symbol: NOVA1
  Gene Name: neuro-oncological ventral antigen 1
  ENSP ID: ENSP00000459545
MMAAAPIQQNGTHTGVPIDLDPPDSRKRPLEAPPEAGSTKRTNTGEDGQYFLKVLIPSYAAGSIIGKGGQTIVQLQKETGATIKLSKSKDFYPGTTERVCLIQGTVEALNAVHGFIAEKIREMPQNVAKTEPVSILQPQTTVNPDRIKQVSV

SEQ ID NO: 56589 - protein, 492 aa, Homo sapiens
  Payload ID: 11120
  Gene Symbol: NOVA2
  Gene Name: neuro-oncological ventral antigen 2
  Uniprot ID: Q9UNW9
  ENSP ID: ENSP00000263257
MEPEAPDSRKRPLETPPEVVCTKRSNTGEEGEYFLKVLIPSYAAGSIIGKGGQTIVQLQKETGATIKLSKSKDFYPGTTERVCLVQGTAEALNAVHSFIAEKVREIPQAMTKPEVVNILQPQTTMNPDRAKQAKLIVPNSTAGLIIGKGGATVKAVMEQSGAWVQLSQKPEGINLQERVVTVSGEPEQVHKAVSAIVQKVQEDPQSSSCLNISYANVAGPVANSNPTGSPYASPADVLPAAAAASAAAASGLLGPAGLAGVGAFPAALPAFSGTDLLAISTALNTLASYGYNTNSLGLGLNSAAASGVLAAVAAGANPAAAAAANLLASYAGEAGAGPAGGAAPPPPPPPGALGSFALAAAANGYLGAGAGGGAGGGGGPLVAAAAAAGAAGGFLTAEKLAAESAKELVEIAVPENLVGAILGKGGKTLVEYQELTGARIQISKKGEFLPGTRNRRVTITGSPAATQAAQYLISQRVTYEQGVRASNPQKVG

SEQ ID NO: 56590 - protein, 40 aa, Homo sapiens
  Payload ID: 11120
  Gene Symbol: NOVA2
  Gene Name: neuro-oncological ventral antigen 2
  ENSP ID: ENSP00000471736
MTKPEVVNILQPQTTMNPDRAKQAKLIVPNSTAGLIIGKG

SEQ ID NO: 56591 - protein, 125 aa, Homo sapiens
  Payload ID: 11121
  Gene Symbol: NPB
  Gene Name: neuropeptide B
  Uniprot ID: Q8NG41
  ENSP ID: ENSP00000332766
MARSATLAAAALALCLLLAPPGLAWYKPAAGHSSYSVGRAAGLLSGLRRSPYARRSQPYRGAEPPGGAGASPELQLHPRLRSLAVCVQDVAPNLQRCERLPDGRGTYQCKANVFLSLRAADCLAA

SEQ ID NO: 56592 - protein, 156 aa, Homo sapiens
  Payload ID: 11121
  Gene Symbol: NPB
  Gene Name: neuropeptide B
  ENSP ID: ENSP00000461824
MARSATLAAAALALCLLLAPPGLAWYKPAAGHSSYSVGRAAGLLSGLRRSPYARRSQPYRGAEPPGGAGASPELQLHPRLRSLVSPACRGLMGGGGRTWVGVRRPLSLCLPAPQAVCVQDVAPNLQRCERLPDGRGTYQCKANVFLSLRAADCLAA

SEQ ID NO: 56593 - protein, 430 aa, Homo sapiens
  Payload ID: 11122
  Gene Symbol: NPFFR1
  Gene Name: neuropeptide FF receptor 1
  Uniprot ID: Q9GZQ6
  ENSP ID: ENSP00000277942
MEGEPSQPPNSSWPLSQNGTNTEATPATNLTFSSYYQHTSPVAAMFIVAYALIFLLCMVGNTLVCFIVLKNRHMHTVTNMFILNLAVSDLLVGIFCMPTTLVDNLITGWPFDNATCKMSGLVQGMSVSASVFTLVAIAVERFRCIVHPFREKLTLRKALVTIAVIWALALLIMCPSAVTLTVTREEHHFMVDARNRSYPLYSCWEAWPEKGMRRVYTTVLFSHIYLAPLALIVVMYARIARKLCQAPGPAPGGEEAADPRASRRRARVVHMLVMVALFFTLSWLPLWALLLLIDYGQLSAPQLHLVTVYAFPFAHWLAFFNSSANPIIYGYFNENFRRGFQAAFRARLCPRPSGSHKEAYSERPGGLLHRRVFVVVRPSDSGLPSESGPSSGAPRPGRLPLRNGRVAHHGLPREGPGCSHLPLTIPAWDI

SEQ ID NO: 56594 - protein, 522 aa, Homo sapiens
  Payload ID: 11123
  Gene Symbol: NPFFR2
  Gene Name: neuropeptide FF receptor 2
  Uniprot ID: Q9Y5X5
  ENSP ID: ENSP00000307822
MNSFFGTPAASWCLLESDVSSAPDKEAGRERRALSVQQRGGPAWSGSLEWSRQSAGDRRRLGLSRQTAKSSWSRSRDRTCCCRRAWWILVPAADRARRERFIMNEKWDTNSSENWHPIWNVNDTKHHLYSDINITYVNYYLHQPQVAAIFIISYFLIFFLCMMGNTVVCFIVMRNKHMHTVTNLFILNLAISDLLVGIFCMPITLLDNIIAGWPFGNTMCKISGLVQGISVAASVFTLVAIAVDRFQCVVYPFKPKLTIKTAFVIIMIIWVLAITIMSPSAVMLHVQEEKYYRVRLNSQNKTSPVYWCREDWPNQEMRKIYTTVLFANIYLAPLSLIVIMYGRIGISLFRAAVPHTGRKNQEQWHVVSRKKQKIIKMLLIVALLFILSWLPLWTLMMLSDYADLSPNELQIINIYIYPFAHWLAFGNSSVNPIIYGFFNENFRRGFQEAFQLQLCQKRAKPMEAYALKAKSHVLINTSNQLVQESTFQNPHGETLLYRKSAEKPQQELVMEELKETTNSSEI

SEQ ID NO: 56595 - protein, 132 aa, Homo sapiens
  Payload ID: 11123
  Gene Symbol: NPFFR2
  Gene Name: neuropeptide FF receptor 2
  Uniprot ID: Q9Y5X5
  ENSP ID: ENSP00000340789
MNSFFGTPAASWCLLESDVSSAPDKEAGRERRALSVQQRGGPAWSGSLEWSRQSAGDRRRLGLSRQTAKSSWSRSRDRTCCCRRAWWILVPAADRARRERMAIWKHDVQDQWIGPGNICRSFSLYVSCNCCR

SEQ ID NO: 56596 - protein, 420 aa, Homo sapiens
  Payload ID: 11123
  Gene Symbol: NPFFR2
  Gene Name: neuropeptide FF receptor 2
  Uniprot ID: Q9Y5X5
  ENSP ID: ENSP00000351599
MNEKWDTNSSENWHPIWNVNDTKHHLYSDINITYVNYYLHQPQVAAIFIISYFLIFFLCMMGNTVVCFIVMRNKHMHTVTNLFILNLAISDLLVGIFCMPITLLDNIIAGWPFGNTMCKISGLVQGISVAASVFTLVAIAVDRFQCVVYPFKPKLTIKTAFVIIMIIWVLAITIMSPSAVMLHVQEEKYYRVRLNSQNKTSPVYWCREDWPNQEMRKIYTTVLFANIYLAPLSLIVIMYGRIGISLFRAAVPHTGRKNQEQWHVVSRKKQKIIKMLLIVALLFILSWLPLWTLMMLSDYADLSPNELQIINIYIYPFAHWLAFGNSSVNPIIYGFFNENFRRGFQEAFQLQLCQKRAKPMEAYALKAKSHVLINTSNQLVQESTFQNPHGETLLYRKSAEKPQQELVMEELKETTNSSEI

SEQ ID NO: 56597 - protein, 423 aa, Homo sapiens
  Payload ID: 11123
  Gene Symbol: NPFFR2
  Gene Name: neuropeptide FF receptor 2
  Uniprot ID: Q9Y5X5
  ENSP ID: ENSP00000379321
MFIMNEKWDTNSSENWHPIWNVNDTKHHLYSDINITYVNYYLHQPQVAAIFIISYFLIFFLCMMGNTVVCFIVMRNKHMHTVTNLFILNLAISDLLVGIFCMPITLLDNIIAGWPFGNTMCKISGLVQGISVAASVFTLVAIAVDRFQCVVYPFKPKLTIKTAFVIIMIIWVLAITIMSPSAVMLHVQEEKYYRVRLNSQNKTSPVYWCREDWPNQEMRKIYTTVLFANIYLAPLSLIVIMYGRIGISLFRAAVPHTGRKNQEQWHVVSRKKQKIIKMLLIVALLFILSWLPLWTLMMLSDYADLSPNELQIINIYIYPFAHWLAFGNSSVNPIIYGFFNENFRRGFQEAFQLQLCQKRAKPMEAYALKAKSHVLINTSNQLVQESTFQNPHGETLLYRKSAEKPQQELVMEELKETTNSSEI

SEQ ID NO: 56598 - protein, 113 aa, Homo sapiens
  Payload ID: 11124
  Gene Symbol: NPFF
  Gene Name: neuropeptide FF-amide peptide precursor
  Uniprot ID: O15130
  ENSP ID: ENSP00000267017
MDSRQAAALLVLLLLIDGGCAEGPGGQQEDQLSAEEDSEPLPPQDAQTSGSLLHYLLQAMERPGRSQAFLFQPQRFGRNTQGSWRNEWLSPRAGEGLNSQFWSLAAPQRFGKK

SEQ ID NO: 56599 - protein, 89 aa, Homo sapiens
  Payload ID: 11125
  Gene Symbol: NPS
  Gene Name: neuropeptide S
  Uniprot ID: P0C0P6
  ENSP ID: ENSP00000381105
MISSVKLNLILVLSLSTMHVFWCYPVPSSKVSGKSDYFLILLNSCPTRLDRSKELAFLKPILEKMFVKRSFRNGVGTGMKKTSFQRAKS

SEQ ID NO: 56600 - protein, 377 aa, Homo sapiens
  Payload ID: 11126
  Gene Symbol: NPSR1
  Gene Name: neuropeptide S receptor 1
  Uniprot ID: Q6W5P4
  ENSP ID: ENSP00000352839
MPANFTEGSFDSSGTGQTLDSSPVACTETVTFTEVVEGKEWGSFYYSFKTEQLITLWVLFVFTIVGNSVVLFSTWRRKKKSRMTFFVTQLAITDSFTGLVNILTDINWRFTGDFTAPDLVCRVVRYLQVVLLYASTYVLVSLSIDRYHAIVYPMKFLQGEKQARVLIVIAWSLSFLFSIPTLIIFGKRTLSNGEVQCWALWPDDSYWTPYMTIVAFLVYFIPLTIISIMYGIVIRTIWIKSKTYETVISNCSDGKLCSSYNRGLISKAKIKAIKYSIIIILAFICCWSPYFLFDILDNFNLLPDTQERFYASVIIQNLPALNSAINPLIYCVFSSSISFPCRVIRLRQLQEAALMLCPQRENWKGTWPGVPSWALPR

SEQ ID NO: 56601 - protein, 371 aa, Homo sapiens
  Payload ID: 11126
  Gene Symbol: NPSR1
  Gene Name: neuropeptide S receptor 1
  Uniprot ID: Q6W5P4
  ENSP ID: ENSP00000353788
MPANFTEGSFDSSGTGQTLDSSPVACTETVTFTEVVEGKEWGSFYYSFKTEQLITLWVLFVFTIVGNSVVLFSTWRRKKKSRMTFFVTQLAITDSFTGLVNILTDINWRFTGDFTAPDLVCRVVRYLQVVLLYASTYVLVSLSIDRYHAIVYPMKFLQGEKQARVLIVIAWSLSFLFSIPTLIIFGKRTLSNGEVQCWALWPDDSYWTPYMTIVAFLVYFIPLTIISIMYGIVIRTIWIKSKTYETVISNCSDGKLCSSYNRGLISKAKIKAIKYSIIIILAFICCWSPYFLFDILDNFNLLPDTQERFYASVIIQNLPALNSAINPLIYCVFSSSISFPCREQRSQDSRMTFRERTERHEMQILSKPEFI

SEQ ID NO: 56602 - protein, 390 aa, Homo sapiens
  Payload ID: 11126
  Gene Symbol: NPSR1
  Gene Name: neuropeptide S receptor 1
  Uniprot ID: Q6W5P4
  ENSP ID: ENSP00000370950
MPANFTEGSFDSSGTGQTLDSSPVACTETVTFTEVVEGKEWGSFYYSFKTEQLITLWVLFVFTIVGNSVVLFSTWRRKKKSRMTFFVTQLAITDSFTGLVNILTDINWRFTGDFTAPDLVCRVVRYLQVVLLYASTYVLVSLSIDRYHAIVYPMKFLQGEKQARVLIVIAWSLSFLFSIPTLIIFGKRTLSNGEVQCWALWPDDSYWTPYMTIVAFLVYFIPLTIISIMYGIVIRTIWIKSKTYETVISNCSDGKLCSSYNRGLISKAKIKAIKYSIIIILAFICCWSPYFLFDILDNFNLLPDTQERFYASVIIQNLPALNSAINPLIYCVFSSSISFPCRANSSVYLLACDVSVLWALVLTSEKESCESWRRKGAKITGFQNDVPGEN

SEQ ID NO: 56603 - protein, 305 aa, Homo sapiens
  Payload ID: 11126
  Gene Symbol: NPSR1
  Gene Name: neuropeptide S receptor 1
  Uniprot ID: Q6W5P4
  ENSP ID: ENSP00000370953
MPANFTEGSFDSSGTGQTLDSSPVACTETVTFTEVVEGKEWGSFYYSFKTEQLITLWVLFVFTIVGNSVVLFSTWRRKKKSRMTFFVTQLAITEKQARVLIVIAWSLSFLFSIPTLIIFGKRTLSNGEVQCWALWPDDSYWTPYMTIVAFLVYFIPLTIISIMYGIVIRTIWIKSKTYETVISNCSDGKLCSSYNRGLISKAKIKAIKYSIIIILAFICCWSPYFLFDILDNFNLLPDTQERFYASVIIQNLPALNSAINPLIYCVFSSSISFPCREQRSQDSRMTFRERTERHEMQILSKPEFI

SEQ ID NO: 56604 - protein, 158 aa, Homo sapiens
  Payload ID: 11126
  Gene Symbol: NPSR1
  Gene Name: neuropeptide S receptor 1
  Uniprot ID: Q6W5P4
  ENSP ID: ENSP00000370955
MPANFTEGSFDSSGTGQTLDSSPVACTETVTFTEVVEGKEWGSFYYSFKTEQLITLWVLFVFTIVGNSVVLFSTWRRKKKSRMTFFVTQLAITGCAALRLYLRPGVPQHRQIPCHRLPHEVPSRRKASQGPHCDRLEPVFSVLHSHPDHIWEEDTVQR

SEQ ID NO: 56605 - protein, 143 aa, Homo sapiens
  Payload ID: 11126
  Gene Symbol: NPSR1
  Gene Name: neuropeptide S receptor 1
  Uniprot ID: Q6W5P4
  ENSP ID: ENSP00000370965
MPANFTEGSFDSSGTGQTLDSSPVACTETVTFTEVVEGKEWGSFYYSFKTEQLITLWVLFVFTIVGNSVVLFSTWRRKKKSRMTFFVTQLAITDSFTGLVNILTDINWRFTGDFTAPDLVCRVVRYLQVMVMKLFHIQKMNME

SEQ ID NO: 56606 - protein, 136 aa, Homo sapiens
  Payload ID: 11126
  Gene Symbol: NPSR1
  Gene Name: neuropeptide S receptor 1
  Uniprot ID: Q6W5P4
  ENSP ID: ENSP00000379402
MPANFTEGSFDSSGTGQTLDSSPVACTETVTFTEVVEGKEWGSFYYSFKTEQLITLWVLFVFTIVGNSVVLFSTWRRKKKSRMTFFVTQLAITDSFTGLVNILTDINWRFTGDFTAPDLVCRVVRYLQKSKPGSSL

SEQ ID NO: 56607 - protein, 366 aa, Homo sapiens
  Payload ID: 11126
  Gene Symbol: NPSR1
  Gene Name: neuropeptide S receptor 1
  Uniprot ID: Q6W5P4
  ENSP ID: ENSP00000433258
MPANFTEGSFDSSGTGQTLDSSPVACTETVTFTEVVEGKEWGSFYYSFKTEQLITLWVLFVFTIVGNSVVLFSTWRRKKKSRMTFFVTQLAITDINWRFTGDFTAPDLVCRVVRYLQVVLLYASTYVLVSLSIDRYHAIVYPMKFLQGEKQARVLIVIAWSLSFLFSIPTLIIFGKRTLSNGEVQCWALWPDDSYWTPYMTIVAFLVYFIPLTIISIMYGIVIRTIWIKSKTYETVISNCSDGKLCSSYNRGLISKAKIKAIKYSIIIILAFICCWSPYFLFDILDNFNLLPDTQERFYASVIIQNLPALNSAINPLIYCVFSSSISFPCRVIRLRQLQEAALMLCPQRENWKGTWPGVPSWALPR

SEQ ID NO: 56608 - protein, 94 aa, Homo sapiens
  Payload ID: 11126
  Gene Symbol: NPSR1
  Gene Name: neuropeptide S receptor 1
  Uniprot ID: Q6W5P4
  ENSP ID: ENSP00000434955
MPANFTEGSFDSSGTGQTLDSSPVACTETVTFTEVVEGKEWGSFYYSFKTEQLITLWVLFVFTIVGNSVVLFSTWRRKKKSRMTFFVTQLAITV

SEQ ID NO: 56609 - protein, 196 aa, Homo sapiens
  Payload ID: 11127
  Gene Symbol: NPVF
  Gene Name: neuropeptide VF precursor
  Uniprot ID: Q9HCQ7
  ENSP ID: ENSP00000222674
MEIISSKLFILLTLATSSLLTSNIFCADELVMSNLHSKENYDKYSEPRGYPKGERSLNFEELKDWGPKNVIKMSTPAVNKMPHSFANLPLRFGRNVQEERSAGATANLPLRSGRNMEVSLVRRVPNLPQRFGRTTTAKSVCRMLSDLCQGSMHSPCANDLFYSMTCQHQEIQNPDQKQSRRLLFKKIDDAELKQEK

SEQ ID NO: 56610 - protein, 165 aa, Homo sapiens
  Payload ID: 11128
  Gene Symbol: NPW
  Gene Name: neuropeptide W
  Uniprot ID: Q8N729
  ENSP ID: ENSP00000330070
LAWRPGERGAPASRPRLALLLLLLLLPLPSGAWYKHVASPRYHTVGRAAGLLMGLRRSPYLWRRALRAAAGPLARDTLSPEPAAREAPLLLPSWVQELWETRRRSSQAGIPVRAPRSPRAPEPALEPESLDFSGAGQRLRRDVSRPAVDPAANRLGLPCLAPGPF

SEQ ID NO: 56611 - protein, 113 aa, Homo sapiens
  Payload ID: 11128
  Gene Symbol: NPW
  Gene Name: neuropeptide W
  ENSP ID: ENSP00000456974
MGLRRSPYLWRRALRAAAGPLARDTLSPEPAAREAPLLLPSWVQELWETRRRSSQAGIPVRAPRSPRAPEPALEPESLDFSGAGQRLRRDVSRPAVDPAANRLGLPCLAPGPF

SEQ ID NO: 56612 - protein, 128 aa, Homo sapiens
  Payload ID: 11128
  Gene Symbol: NPW
  Gene Name: neuropeptide W
  ENSP ID: ENSP00000457009
MSRPLEGPRGHAASPGLLWATRVTSTLAGLHELALSDETRHNWFASQMNKGSCLSPARLLSCCPRGFRSCGRRDAGAPRQGSPSVRPGARAPQSLRWNRSPWTSAELARDFGETSPAQRWTPQQTALA

SEQ ID NO: 56613 - protein, 97 aa, Homo sapiens
  Payload ID: 11129
  Gene Symbol: NPY
  Gene Name: neuropeptide Y
  Uniprot ID: P01303
  ENSP ID: ENSP00000242152
MLGNKRLGLSGLTLALSLLVCLGALAEAYPSKPDNPGEDAPAEDMARYYSALRHYINLITRQRYGKRSSPETLISDLLMRESTENVPRTRLEDPAMW

SEQ ID NO: 56614 - protein, 97 aa, Homo sapiens; identical to SEQ ID NO: 56613
  Payload ID: 11129
  Gene Symbol: NPY
  Gene Name: neuropeptide Y
  Uniprot ID: P01303
  ENSP ID: ENSP00000384364

SEQ ID NO: 56615 - protein, 97 aa, Homo sapiens; identical to SEQ ID NO: 56613
  Payload ID: 11129
  Gene Symbol: NPY
  Gene Name: neuropeptide Y
  Uniprot ID: P01303
  ENSP ID: ENSP00000385282

SEQ ID NO: 56616 - protein, 384 aa, Homo sapiens
  Payload ID: 11130
  Gene Symbol: NPY1R
  Gene Name: neuropeptide Y receptor Y1
  Uniprot ID: P25929
  ENSP ID: ENSP00000354652
MNSTLFSQVENHSVHSNFSEKNAQLLAFENDDCHLPLAMIFTLALAYGAVIILGVSGNLALIIIILKQKEMRNVTNILIVNLSFSDLLVAIMCLPFTFVYTLMDHWVFGEAMCKLNPFVQCVSITVSIFSLVLIAVERHQLIINPRGWRPNNRHAYVGIAVIWVLAVASSLPFLIYQVMTDEPFQNVTLDAYKDKYVCFDQFPSDSHRLSYTTLLLVLQYFGPLCFIFICYFKIYIRLKRRNNMMDKMRDNKYRSSETKRINIMLLSIVVAFAVCWLPLTIFNTVFDWNHQIIATCNHNLLFLLCHLTAMISTCVNPIFYGFLNKNFQRDLQFFFNFCDFRSRDDDYETIAMSTMHTDVSKTSLKQASPVAFKKINNNDDNEKI

SEQ ID NO: 56617 - protein, 99 aa, Homo sapiens
  Payload ID: 11130
  Gene Symbol: NPY1R
  Gene Name: neuropeptide Y receptor Y1
  ENSP ID: ENSP00000421618
MTDEPFQNVTLDAYKDKYVCFDQFPSDSHRLSYTTLLLVLQYFGPLCFIFICYFKIYIRLKRRNNMMDKMRDNKYRSSETKRINIMLLSIVVAFAVCWL

SEQ ID NO: 56618 - protein, 64 aa, Homo sapiens
  Payload ID: 11130
  Gene Symbol: NPY1R
  Gene Name: neuropeptide Y receptor Y1
  ENSP ID: ENSP00000422963
MMDKMRDNKYRSSETKRINIMLLSIVVAFAVCWLPLTIFNTVFDWNHQIIATCNHNLLFLLCHL

SEQ ID NO: 56619 - protein, 24 aa, Homo sapiens
  Payload ID: 11130
  Gene Symbol: NPY1R
  Gene Name: neuropeptide Y receptor Y1
  ENSP ID: ENSP00000423878
MNSTLFSQVENHSVHSNFSEKNAQ

SEQ ID NO: 56620 - protein, 60 aa, Homo sapiens
  Payload ID: 11130
  Gene Symbol: NPY1R
  Gene Name: neuropeptide Y receptor Y1
  ENSP ID: ENSP00000426099
MNSTLFSQVENHSVHSNFSEKNAQLLAFENDDCHLPLAMIFTLALAYGAVIILGVSGNLA

SEQ ID NO: 56621 - protein, 141 aa, Homo sapiens
  Payload ID: 11130
  Gene Symbol: NPY1R
  Gene Name: neuropeptide Y receptor Y1
  ENSP ID: ENSP00000427284
MMDKMRDNKYRSSETKRINIMLLSIVVAFAVCWLPLTIFNTVFDWNHQIIATCNHNLLFLLCHLTAMISTCVNPIFYGFLNKNFQRDLQFFFNFCDFRSRDDDYETIAMSTMHTDVSKTSLKQASPVAFKKINNNDDNEKI

SEQ ID NO: 56622 - protein, 61 aa, Homo sapiens
  Payload ID: 11130
  Gene Symbol: NPY1R
  Gene Name: neuropeptide Y receptor Y1
  ENSP ID: ENSP00000427564
MNSTLFSQVENHSVHSNFSEKNAQLLAFENDDCHLPLAMIFTLALAYGAVIILGVSGNLAL

SEQ ID NO: 56623 - protein, 381 aa, Homo sapiens
  Payload ID: 11131
  Gene Symbol: NPY2R
  Gene Name: neuropeptide Y receptor Y2
  Uniprot ID: P49146
  ENSP ID: ENSP00000332591
MGPIGAEADENQTVEEMKVEQYGPQTTPRGELVPDPEPELIDSTKLIEVQVVLILAYCSIILLGVIGNSLVIHVVIKFKSMRTVTNFFIANLAVADLLVNTLCLPFTLTYTLMGEWKMGPVLCHLVPYAQGLAVQVSTITLTVIALDRHRCIVYHLESKISKRISFLIIGLAWGISALLASPLAIFREYSLIEIIPDFEIVACTEKWPGEEKSIYGTVYSLSSLLILYVLPLGIISFSYTRIWSKLKNHVSPGAANDHYHQRRQKTTKMLVCVVVVFAVSWLPLHAFQLAVDIDSQVLDLKEYKLIFTVFHIIAMCSTFANPLLYGWMNSNYRKAFLSAFRCEQRLDAIHSEVSVTFKAKKNLEVRKNSGPNDSFTEATNV

SEQ ID NO: 56624 - protein, 381 aa, Homo sapiens; identical to SEQ ID NO: 56623
  Payload ID: 11131
  Gene Symbol: NPY2R
  Gene Name: neuropeptide Y receptor Y2
  Uniprot ID: P49146
  ENSP ID: ENSP00000426366

SEQ ID NO: 56625 - protein, 375 aa, Homo sapiens
  Payload ID: 11132
  Gene Symbol: NPY4R
  Gene Name: neuropeptide Y receptor Y4
  Uniprot ID: P50391
  ENSP ID: ENSP00000363431
MNTSHLLALLLPKSPQGENRSKPLGTPYNFSEHCQDSVDVMVFIVTSYSIETVVGVLGNLCLMCVTVRQKEKANVTNLLIANLAFSDFLMCLLCQPLTAVYTIMDYWIFGETLCKMSAFIQCMSVTVSILSLVLVALERHQLIINPTGWKPSISQAYLGIVLIWVIACVLSLPFLANSILENVFHKNHSKALEFLADKVVCTESWPLAHHRTIYTTFLLLFQYCLPLGFILVCYARIYRCLQRQGRVFHKGTYSLRAGHMKQVNVVLVVMVVAFAVLWLPLHVFNSLEDWHHEAIPICHGNLIFLVCHLLAMASTCVNPFIYGFLNTNFKKEIKALVLTCQQSAPLEESEHLPLSTVHTEVSKGSLRLSGRSNPI

SEQ ID NO: 56626 - protein, 375 aa, Homo sapiens; identical to SEQ ID NO: 56625
  Payload ID: 11132
  Gene Symbol: NPY4R
  Gene Name: neuropeptide Y receptor Y4
  Uniprot ID: P50391
  ENSP ID: ENSP00000379066

SEQ ID NO: 56627 - protein, 375 aa, Homo sapiens; identical to SEQ ID NO: 56625
  Payload ID: 11132
  Gene Symbol: NPY4R
  Gene Name: neuropeptide Y receptor Y4
  Uniprot ID: P50391
  ENSP ID: ENSP00000480883

SEQ ID NO: 56628 - protein, 445 aa, Homo sapiens
  Payload ID: 11133
  Gene Symbol: NPY5R
  Gene Name: neuropeptide Y receptor Y5
  Uniprot ID: Q15761
  ENSP ID: ENSP00000339377
MDLELDEYYNKTLATENNTAATRNSDFPVWDDYKSSVDDLQYFLIGLYTFVSLLGFMGNLLILMALMKKRNQKTTVNFLIGNLAFSDILVVLFCSPFTLTSVLLDQWMFGKVMCHIMPFLQCVSVLVSTLILISIAIVRYHMIKHPISNNLTANHGYFLIATVWTLGFAICSPLPVFHSLVELQETFGSALLSSRYLCVESWPSDSYRIAFTISLLLVQYILPLVCLTVSHTSVCRSISCGLSNKENRLEENEMINLTLHPSKKSGPQVKLSGSHKWSYSFIKKHRRRYSKKTACVLPAPERPSQENHSRILPENFGSVRSQLSSSSKFIPGVPTCFEIKPEENSDVHELRVKRSVTRIKKRSRSVFYRLTILILVFAVSWMPLHLFHVVTDFNDNLISNRHFKLVYCICHLLGMMSCCLNPILYGFLNNGIKADLVSLIHCLHM

SEQ ID NO: 56629 - protein, 445 aa, Homo sapiens; identical to SEQ ID NO: 56628
  Payload ID: 11133
  Gene Symbol: NPY5R
  Gene Name: neuropeptide Y receptor Y5
  Uniprot ID: Q15761
  ENSP ID: ENSP00000423474

SEQ ID NO: 56630 - protein, 445 aa, Homo sapiens; identical to SEQ ID NO: 56628
  Payload ID: 11133
  Gene Symbol: NPY5R
  Gene Name: neuropeptide Y receptor Y5
  Uniprot ID: Q15761
  ENSP ID: ENSP00000423917

SEQ ID NO: 56631 - protein, 328 aa, Homo sapiens
  Payload ID: 11134
  Gene Symbol: NPBWR1
  Gene Name: neuropeptides B/W receptor 1
  Uniprot ID: P48145
  ENSP ID: ENSP00000330284
MDNASFSEPWPANASGPDPALSCSNASTLAPLPAPLAVAVPVVYAVICAVGLAGNSAVLYVLLRAPRMKTVTNLFILNLAIADELFTLVLPINIADFLLRQWPFGELMCKLIVAIDQYNTFSSLYFLTVMSADRYLVVLATAESRRVAGRTYSAARAVSLAVWGIVTLVVLPFAVFARLDDEQGRRQCVLVFPQPEAFWWRASRLYTLVLGFAIPVSTICVLYTTLLCRLHAMRLDSHAKALERAKKRVTFLVVAILAVCLLCWTPYHLSTVVALTTDLPQTPLVIAISYFITSLSYANSCLNPFLYAFLDASFRRNLRQLITCRAAA

SEQ ID NO: 56632 - protein, 333 aa, Homo sapiens
  Payload ID: 11135
  Gene Symbol: NPBWR2
  Gene Name: neuropeptides B/W receptor 2
  Uniprot ID: P48146
  ENSP ID: ENSP00000358783
MQAAGHPEPLDSRGSFSLPTMGANVSQDNGTGHNATFSEPLPFLYVLLPAVYSGICAVGLTGNTAVILVILRAPKMKTVTNVFILNLAVADGLFTLVLPVNIAEHLLQYWPFGELLCKLVLAVDHYNIFSSIYFLAVMSVDRYLVVLATVRSRHMPWRTYRGAKVASLCVWLGVTVLVLPFFSFAGVYSNELQVPSCGLSFPWPEQVWFKASRVYTLVLGFVLPVCTICVLYTDLLRRLRAVRLRSGAKALGKARRKVTVLVLVVLAVCLLCWTPFHLASVVALTTDLPQTPLVISMSYVITSLSYANSCLNPFLYAFLDDNFRKNFRSILRC

SEQ ID NO: 56633 - protein, 333 aa, Homo sapiens; identical to SEQ ID NO: 56632
  Payload ID: 11135
  Gene Symbol: NPBWR2
  Gene Name: neuropeptides B/W receptor 2
  Uniprot ID: P48146
  ENSP ID: ENSP00000484253

SEQ ID NO: 56634 - protein, 533 aa, Homo sapiens
  Payload ID: 11136
  Gene Symbol: NETO1
  Gene Name: neuropilin (NRP) and tolloid (TLL)-like 1
  Uniprot ID: Q8TDF5
  ENSP ID: ENSP00000313088
MIHGRSVLHIVASLIILHLSGATKKGTEKQTTSETQKSVQCGTWTKHAEGGIFTSPNYPSKYPPDRECIYIIEAAPRQCIELYFDEKYSIEPSWECKFDHIEVRDGPFGFSPIIGRFCGQQNPPVIKSSGRFLWIKFFADGELESMGFSARYNFTPDPDFKDLGALKPLPACEFEMGGSEGIVESIQIMKEGKATASEAVDCKWYIRAPPRSKIYLRFLDYEMQNSNECKRNFVAVYDGSSSVEDLKAKFCSTVANDVMLRTGLGVIRMWADEGSRNSRFQMLFTSFQEPPCEGNTFFCHSNMCINNTLVCNGLQNCVYPWDENHCKEKRKTSLLDQLTNTSGTVIGVTSCIVIILIIISVIVQIKQPRKKYVQRKSDFDQTVFQEVFEPPHYELCTLRGTGATADFADVADDFENYHKLRRSSSKCIHDHHCGSQLSSTKGSRSNLSTRDASILTEMPTQPGKPLIPPMNRRNILVMKHSYSQDAADACDIDEIEEVPTTSHRLSRHDKAVQRFCLIGSLSKHESEYNTTRV

SEQ ID NO: 56635 - protein, 156 aa, Homo sapiens
  Payload ID: 11136
  Gene Symbol: NETO1
  Gene Name: neuropilin (NRP) and tolloid (TLL)-like 1
  Uniprot ID: Q8TDF5
  ENSP ID: ENSP00000381024
MLAEPFPKVVASLIILHLSGATKKGTEKQTTSETQKSVQCGTWTKHAEGGIFTSPNYPSKYPPDRECIYIIEAAPRQCIELYFDEKYSIEPSWECKFDHIEVRDGPFGFSPIIGRFCGQQNPPVIKSSGRFLWIKFFADGELESMGFSARYNFTPE

SEQ ID NO: 56636 - protein, 3 aa, Homo sapiens
  Payload ID: 11136
  Gene Symbol: NETO1
  Gene Name: neuropilin (NRP) and tolloid (TLL)-like 1
  ENSP ID: ENSP00000462993
  MOD_RES (1)..(1): Any amino acid
XRV

SEQ ID NO: 56637 - protein, 101 aa, Homo sapiens
  Payload ID: 11136
  Gene Symbol: NETO1
  Gene Name: neuropilin (NRP) and tolloid (TLL)-like 1
  ENSP ID: ENSP00000464188
MSLYGFVASLIILHLSGATKKGTEKQTTSETQKSVQCGTWTKHAEGGIFTSPNYPSKYPPDRECIYIIEAAPRQCIELYFDEKYSIEPSWECKFDHIEVRD

SEQ ID NO: 56638 - protein, 533 aa, Homo sapiens; identical to SEQ ID NO: 56634
  Payload ID: 11136
  Gene Symbol: NETO1
  Gene Name: neuropilin (NRP) and tolloid (TLL)-like 1
  Uniprot ID: Q8TDF5
  ENSP ID: ENSP00000464312

SEQ ID NO: 56639 - protein, 518 aa, Homo sapiens
  Payload ID: 11137
  Gene Symbol: NETO2
  Gene Name: neuropilin (NRP) and tolloid (TLL)-like 2
  Uniprot ID: Q8NC67
  ENSP ID: ENSP00000306726
MALERLCSVLKVLLITVLVVEGIAVAQKTQDGQNIGIKHIPATQCGIWVRTSNGGHFASPNYPDSYPPNKECIYILEAAPRQRIELTFDEHYYIEPSFECRFDHLEVRDGPFGFSPLIDRYCGVKSPPLIRSTGRFMWIKFSSDEELEGLGFRAKYSFIPDPDFTYLGDCQFELSGADGIVRSSQVEQEEKTKPGQAVDCIWTIKATPKAKIYLRFLDYQMEHSNECKRNFVAVYDGSSSIENLKAKFCSTVANDVMLKTGIGVIRMWADEGSRLSRFRMLFTSFVEPPCTSSTFFCHSNMCINNSLVCNGVQNCAYPWDENHCKEKKKAGVFEQITKTHGTIIGITSGIVLVLLIISILVQVKQPRKKVMACKTAFNKTGFQEVFDPPHYELFSLRDKEISADLADLSEELDNYQKMRRSSTASRCIHDHHCGSQASSVKQSRTNLSSMELPFRNDFAQPQPMKTFNSTFKKSSYTFKQGHECPEQALEDRVMEEIPCEIYVRGREDSAQASISIDF

SEQ ID NO: 56640 - protein, 365 aa, Homo sapiens
  Payload ID: 11137
  Gene Symbol: NETO2
  Gene Name: neuropilin (NRP) and tolloid (TLL)-like 2
  ENSP ID: ENSP00000454213
  MOD_RES (1)..(1): Any amino acid
XLIDRYCGVKSPPLIRSTGRFMWIKFSSDEELEGLGFRAKYSFIPDPDFTYLGDCQFELSGADGIVRSSQVEQEEKTKPGQAVDCIWTIKATPKAKIYLRFLDYQMEHSNECKRNFVAVYDGSSSIENLKAKFCSTVANDVMLKTGIGVIRMWADEGSRLSRFRMLFTSFVEQKKKAGVFEQITKTHGTIIGITSGIVLVLLIISILVQVKQPRKKVMACKTAFNKTGFQEVFDPPHYELFSLRDKEISADLADLSEELDNYQKMRRSSTASRCIHDHHCGSQASSVKQSRTNLSSMELPFRNDFAQPQPMKTFNSTFKKSSYTFKQGHECPEQALEDRVMEEIPCEIYVRGREDSAQASISIDF

SEQ ID NO: 56641 - protein, 525 aa, Homo sapiens
  Payload ID: 11137
  Gene Symbol: NETO2
  Gene Name: neuropilin (NRP) and tolloid (TLL)-like 2
  Uniprot ID: Q8NC67
  ENSP ID: ENSP00000455169
MALERLCSVLKVLLITVLVVEGIAVAQKTQDGQNIGIKHIPATQCGIWVRTSNGGHFASPNYPDSYPPNKECIYILEAAPRQRIELTFDEHYYIEPSFECRFDHLEVRDGPFGFSPLIDRYCGVKSPPLIRSTGRFMWIKFSSDEELEGLGFRAKYSFIPDPDFTYLGGILNPIPDCQFELSGADGIVRSSQVEQEEKTKPGQAVDCIWTIKATPKAKIYLRFLDYQMEHSNECKRNFVAVYDGSSSIENLKAKFCSTVANDVMLKTGIGVIRMWADEGSRLSRFRMLFTSFVEPPCTSSTFFCHSNMCINNSLVCNGVQNCAYPWDENHCKEKKKAGVFEQITKTHGTIIGITSGIVLVLLIISILVQVKQPRKKVMACKTAFNKTGFQEVFDPPHYELFSLRDKEISADLADLSEELDNYQKMRRSSTASRCIHDHHCGSQASSVKQSRTNLSSMELPFRNDFAQPQPMKTFNSTFKKSSYTFKQGHECPEQALEDRVMEEIPCEIYVRGREDSAQASISIDF

SEQ ID NO: 56642 - protein, 194 aa, Homo sapiens
  Payload ID: 11137
  Gene Symbol: NETO2
  Gene Name: neuropilin (NRP) and tolloid (TLL)-like 2
  ENSP ID: ENSP00000456818
  MOD_RES (1)..(1): Any amino acid
XTYLGGILNPIPDCQFELSGADGIVRSSQVEQEEKTKPGQAVDCIWTIKATPKAKIYLRFLDYQMEHSNECKRNFVAVYDGSSSIENLKAKFCSTVANDVMLKTGIGVIRMWADEGSRLSRFRMLFTSFVEQKKKAGVFEQITKTHGTIIGITSGIVLVLLIISILVQVKQPRKKVMACKTAFNKTGFQEVFDP

SEQ ID NO: 56643 - protein, 228 aa, Homo sapiens
  Payload ID: 11137
  Gene Symbol: NETO2
  Gene Name: neuropilin (NRP) and tolloid (TLL)-like 2
  ENSP ID: ENSP00000457133
  MOD_RES (1)..(1): Any amino acid
XSSSIENLKAKFCSTVANDVMLKTGIGVIRMWADEEKKKAGVFEQITKTHGTIIGITSGIVLVLLIISILVQVKQPRKKVMACKTAFNKTGFQEVFDPPHYELFSLRDKEISADLADLSEELDNYQKMRRSSTASRCIHDHHCGSQASSVKQSRTNLSSMELPFRNDFAQPQPMKTFNSTFKKSSYTFKQGHECPEQALEDRVMEEIPCEIYVRGREDSAQASISIDF

SEQ ID NO: 56644 - protein, 923 aa, Homo sapiens
  Payload ID: 11138
  Gene Symbol: NRP1
  Gene Name: neuropilin 1
  Uniprot ID: O14786
  ENSP ID: ENSP00000265371
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCAKPADLDKKNPEIKIDETGSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 56645 - protein, 641 aa, Homo sapiens
  Payload ID: 11138
  Gene Symbol: NRP1
  Gene Name: neuropilin 1
  ENSP ID: ENSP00000363949
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEGTINTDQECPCARALAKDAKKKKRWADSTHCRCVRSIHGEMWSSGKGVCSLDANL

SEQ ID NO: 56646 - protein, 609 aa, Homo sapiens
  Payload ID: 11138
  Gene Symbol: NRP1
  Gene Name: neuropilin 1
  Uniprot ID: O14786
  ENSP ID: ENSP00000363954
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEGGTTVLATEKPTVIDSTIQSGIK

SEQ ID NO: 56647 - protein, 644 aa, Homo sapiens
  Payload ID: 11138
  Gene Symbol: NRP1
  Gene Name: neuropilin 1
  Uniprot ID: O14786
  ENSP ID: ENSP00000363955
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSGIK

SEQ ID NO: 56648 - protein, 704 aa, Homo sapiens
  Payload ID: 11138
  Gene Symbol: NRP1
  Gene Name: neuropilin 1
  ENSP ID: ENSP00000363956
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGAETIFIPLLYHFSSCLSWDQLTPVCVLVTPHGRELPRNRSCLARTRASSFPHVIWIDELFLIATTICNNNLSHFESQRLGLS

SEQ ID NO: 56649 - protein, 923 aa, Homo sapiens; identical to SEQ ID NO: 56644
  Payload ID: 11138
  Gene Symbol: NRP1
  Gene Name: neuropilin 1
  Uniprot ID: O14786
  ENSP ID: ENSP00000364001

SEQ ID NO: 56650 - protein, 735 aa, Homo sapiens
  Payload ID: 11138
  Gene Symbol: NRP1
  Gene Name: neuropilin 1
  ENSP ID: ENSP00000364009
MSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCAKPADLDKKNPEIKIDETGSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 56651 - protein, 906 aa, Homo sapiens
  Payload ID: 11138
  Gene Symbol: NRP1
  Gene Name: neuropilin 1
  ENSP ID: ENSP00000379317
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKSFEGNNNYDTPELRTFPALSTRFIRIYPERATHGGLGLRMELLGCEVEAPTAGPTTPNGNLVDECDDDQANCHSGTGDDFQLTGGTTVLATEKPTVIDSTIQSEFPTYGFNCEFGWGSHKTFCHWEHDNHVQLKWSVLTSKTGPIQDHTGDGNFIYSQADENQKGKVARLVSPVVYSQNSAHCMTFWYHMSGSHVGTLRVKLRYQKPEEYDQLVWMAIGHQGDHWKEGRVLLHKSLKLYQVIFEGEIGKGNLGGIAVDDISINNHISQEDCARSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 56652 - protein, 105 aa, Homo sapiens
  Payload ID: 11138
  Gene Symbol: NRP1
  Gene Name: neuropilin 1
  ENSP ID: ENSP00000390447
NHISQEDCARSTPGYEGEGEGDKNISRKPGNVLKTLDPILITIIAMSALGVLLGAVCGVVLYCACWHNGMSERNLSALENYNFELVDGVKLKKDKLNTQSTYSEA

SEQ ID NO: 56653 - protein, 170 aa, Homo sapiens
  Payload ID: 11138
  Gene Symbol: NRP1
  Gene Name: neuropilin 1
  ENSP ID: ENSP00000390567
  MOD_RES (1)..(1): Any amino acid
XPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQDAKYRLRVSVVRSKSSSSSTSLEPRPLSSLKLSFFSYKIKIT

SEQ ID NO: 56654 - protein, 100 aa, Homo sapiens
  Payload ID: 11138
  Gene Symbol: NRP1
  Gene Name: neuropilin 1
  ENSP ID: ENSP00000393071
  MOD_RES (1)..(1): Any amino acid
XTHGGLGLRMELLGCEVEAPTAGPTTPNGNLVDECDDDQANCHSGTGDDFQLTGGTTVLATEKPTVIDSTIQSGSRFFKHHHKQQSMRPQNLHHNSILLL

SEQ ID NO: 56655 - protein, 597 aa, Homo sapiens
  Payload ID: 11138
  Gene Symbol: NRP1
  Gene Name: neuropilin 1
  ENSP ID: ENSP00000408911
MERGLPLLCAVLALVLAPAGAFRNDKCGDTIKIESPGYLTSPGYPHSYHPSEKCEWLIQAPDPYQRIMINFNPHFDLEDRDCKYDYVEVFDGENENGHFRGKFCGKIAPPPVVSSGPFLFIKFVSDYETHGAGFSIRYEIFKRGPECSQNYTTPSGVIKSPGFPEKYPNSLECTYIVFVPKMSEIILEFESFDLEPDSNPPGGMFCRYDRLEIWDGFPDVGPHIGRYCGQKTPGRIRSSSGILSMVFYTDSAIAKEGFSANYSVLQSSVSEDFKCMEALGMESGEIHSDQITASSQYSTNWSAERSRLNYPENGWTPGEDSYREWIQVDLGLLRFVTAVGTQGAISKETKKKYYVKTYKIDVSSNGEDWITIKEGNKPVLFQGNTNPTDVVVAVFPKPLITRFVRIKPATWETGISMRFEVYGCKITDYPCSGMLGMVSGLISDSQITSSNQGDRNWMPENIRLVTSRSGWALPPAPHSYINEWLQIDLGEEKIVRGIIIQGGKHRENKVFMRKFKIGYSNNGSDWKMIMDDSKRKAKVRAGDWEEVIPYVLDFNQGPLAFSRGRASYFLPAMTLEEVCDGVSKTLDSRKTGIWHEK

SEQ ID NO: 56656 - protein, 77 aa, Homo sapiens
  Payload ID: 11138
  Gene Symbol: NRP1
  Gene Name: neuropilin 1
  ENSP ID: ENSP00000416147
  MOD_RES (1)..(1): Any amino acid
XPTAGPTTPNGNLVDECDDDQANCHSGTGDDFQLTGGTTVLATEKPTVIDSTIQSARLEVSTLNLSLHNPPQQKALI

SEQ ID NO: 56657 - protein, 60 aa, Homo sapiens
  Payload ID: 11138
  Gene Symbol: NRP1
  Gene Name: neuropilin 1
  ENSP ID: ENSP00000476896
  MOD_RES (1)..(1): Any amino acid
XINEWLQIDLGEEKIVRGIIIQGGKHRENKVFMRKFKIGYSNNGSDWKMIMDDSKRKALI

SEQ ID NO: 56658 - protein, 906 aa, Homo sapiens
  Payload ID: 11139
  Gene Symbol: NRP2
  Gene Name: neuropilin 2
  Uniprot ID: O60462
  ENSP ID: ENSP00000272849
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGENFKGGTLLPGTEPTVDTVPMQPIPAYWYYVMAAGGAVLVLVSVALALVLHYHRFRYAAKKTDHSITYKTSHYTNGAPLAVEPTLTIKLEQDRGSHC

SEQ ID NO: 56659 - protein, 901 aa, Homo sapiens
  Payload ID: 11139
  Gene Symbol: NRP2
  Gene Name: neuropilin 2
  ENSP ID: ENSP00000349632
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGGTLLPGTEPTVDTVPMQPIPAYWYYVMAAGGAVLVLVSVALALVLHYHRFRYAAKKTDHSITYKTSHYTNGAPLAVEPTLTIKLEQDRGSHC

SEQ ID NO: 56660 - protein, 926 aa, Homo sapiens
  Payload ID: 11139
  Gene Symbol: NRP2
  Gene Name: neuropilin 2
  ENSP ID: ENSP00000350432
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 56661 - protein, 931 aa, Homo sapiens
  Payload ID: 11139
  Gene Symbol: NRP2
  Gene Name: neuropilin 2
  ENSP ID: ENSP00000353582
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFAGENFKVDIPEIHEREGYEDEIDDEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 56662 - protein, 555 aa, Homo sapiens
  Payload ID: 11139
  Gene Symbol: NRP2
  Gene Name: neuropilin 2
  Uniprot ID: O60462
  ENSP ID: ENSP00000387519
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKVGCSWRPL

SEQ ID NO: 56663 - protein, 101 aa, Homo sapiens
  Payload ID: 11139
  Gene Symbol: NRP2
  Gene Name: neuropilin 2
  ENSP ID: ENSP00000404279
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLL

SEQ ID NO: 56664 - protein, 909 aa, Homo sapiens
  Payload ID: 11139
  Gene Symbol: NRP2
  Gene Name: neuropilin 2
  ENSP ID: ENSP00000407626
MDMFPLTWVFLALYFSRHQVRGQPDPPCGGRLNSKDAGYITSPGYPQDYPSHQNCEWIVYAPEPNQKIVLNFNPHFEIEKHDCKYDFIEIRDGDSESADLLGKHCGNIAPPTIISSGSMLYIKFTSDYARQGAGFSLRYEIFKTGSEDCSKNFTSPNGTIESPGFPEKYPHNLDCTFTILAKPKMEIILQFLIFDLEHDPLQVGEGDCKYDWLDIWDGIPHVGPLIGKYCGTKTPSELRSSTGILSLTFHTDMAVAKDGFSARYYLVHQEPLENFQCNVPLGMESGRIANEQISASSTYSDGRWTPQQSRLHGDDNGWTPNLDSNKEYLQVDLRFLTMLTAIATQGAISRETQNGYYVKSYKLEVSTNGEDWMVYRHGKNHKVFQANNDATEVVLNKLHAPLLTRFVRIRPQTWHSGIALRLELFGCRVTDAPCSNMLGMLSGLIADSQISASSTQEYLWSPSAARLVSSRSGWFPRIPQAQPGEEWLQVDLGTPKTVKGVIIQGARGGDSITAVEARAFVRKFKVSYSLNGKDWEYIQDPRTQQPKLFEGNMHYDTPDIRRFDPIPAQYVRVYPERWSPAGIGMRLEVLGCDWTDSKPTVETLGPTVKSEETTTPYPTEEEATECGENCSFEDDKDLQLPSGFNCNFDFLEEPCGWMYDHAKWLRTTWASSSSPNDRTFPDDRNFLRLQSDSQREGQYARLISPPVHLPRSPVCMEFQYQATGGRGVALQVVREASQESKLLWVIREDQGGEWKHGRIILPSYDMEYQIVFEGVIGKGRSGEIAIDDIRISTDVPLENCMEPISAFADEYEVDWSNSSSATSGSGAPSTDKEKSWLYTLDPILITIIAMSSLGVLLGATCAGLLLYCTCSYSGLSSRSCTTLENYNFELYDGLKHKVKMNHQKCCSEA

SEQ ID NO: 56665 - protein, 398 aa, Homo sapiens
  Payload ID: 11140
  Gene Symbol: NPTN
  Gene Name: neuroplastin
  Uniprot ID: Q9Y639
  ENSP ID: ENSP00000290401
MSGSSLPSALALSLLLVSGSLLPGPGAAQNAGFVKSPMSETKLTGDAFELYCDVVGSPTPEIQWWYAEVNRAESFRQLWDGARKRRVTVNTAYGSNGVSVLRITRLTLEDSGTYECRASNDPKRNDLRQNPSITWIRAQATISVLQKPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFIINKENYTELNIVNLQITEDPGEYECNATNAIGSASVVTVLRVRSHLAPLWPFLGILAEIIILVVIIVVYEKRKRPDEVPDDDEPAGPMKTNSTNNHKDKNLRQRNTN

SEQ ID NO: 56666 - protein, 282 aa, Homo sapiens
  Payload ID: 11140
  Gene Symbol: NPTN
  Gene Name: neuroplastin
  Uniprot ID: Q9Y639
  ENSP ID: ENSP00000342958
MSGSSLPSALALSLLLVSGSLLPGPGAAQNEPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFIINKENYTELNIVNLQITEDPGEYECNATNAIGSASVVTVLRVRSHLAPLWPFLGILAEIIILVVIIVVYEKRKRPDEVPDDDEPAGPMKTNSTNNHKDKNLRQRNTN

SEQ ID NO: 56667 - protein, 152 aa, Homo sapiens
  Payload ID: 11140
  Gene Symbol: NPTN
  Gene Name: neuroplastin
  ENSP ID: ENSP00000455671
MSETKLTGDAFELYCDVVGSPTPEIQWWYAEVNRAESFRQLWDGARKRRVTVNTAYGSNGVSVLRITRLTLEDSGTYECRASNDPKRNDLRQNPSITWIRAQATISVLQKPRIVTSEEVIIRDSPVLPVTLQCNLTSSSHTLTYSYWTKNGV

SEQ ID NO: 56668 - protein, 308 aa, Homo sapiens
  Payload ID: 11140
  Gene Symbol: NPTN
  Gene Name: neuroplastin
  ENSP ID: ENSP00000456033
MSETKLTGDAFELYCDVVGSPTPEIQWWYAEVNRAESFRQLWDGARKRRVTVNTAYGSNGVSVLRITRLTLEDSGTYECRASNDPKRNDLRQNPSITWIRAQATISVLQKPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFIINKENYTELNIVNLQITEDPGEYECNATNAIGSASVVTVLRVRSHLAPLWPFLG

SEQ ID NO: 56669 - protein, 278 aa, Homo sapiens
  Payload ID: 11140
  Gene Symbol: NPTN
  Gene Name: neuroplastin
  Uniprot ID: Q9Y639
  ENSP ID: ENSP00000456349
MSGSSLPSALALSLLLVSGSLLPGPGAAQNEPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFIINKENYTELNIVNLQITEDPGEYECNATNAIGSASVVTVLRVRSHLAPLWPFLGILAEIIILVVIIVVYEKRKRPDEVPDAGPMKTNSTNNHKDKNLRQRNTN

SEQ ID NO: 56670 - protein, 394 aa, Homo sapiens
  Payload ID: 11140
  Gene Symbol: NPTN
  Gene Name: neuroplastin
  Uniprot ID: Q9Y639
  ENSP ID: ENSP00000457028
MSGSSLPSALALSLLLVSGSLLPGPGAAQNAGFVKSPMSETKLTGDAFELYCDVVGSPTPEIQWWYAEVNRAESFRQLWDGARKRRVTVNTAYGSNGVSVLRITRLTLEDSGTYECRASNDPKRNDLRQNPSITWIRAQATISVLQKPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFIINKENYTELNIVNLQITEDPGEYECNATNAIGSASVVTVLRVRSHLAPLWPFLGILAEIIILVVIIVVYEKRKRPDEVPDAGPMKTNSTNNHKDKNLRQRNTN

SEQ ID NO: 56671 - protein, 184 aa, Homo sapiens
  Payload ID: 11140
  Gene Symbol: NPTN
  Gene Name: neuroplastin
  ENSP ID: ENSP00000457470
MSGSSLPSALALSLLLVSGSLLPGPGAAQNAAPDITGHKRSENKNEGQDATMYCKSVGYPHPDWIWRKKENGMPMDIVNTSGRFFIINKENYTELNIVNLQITEDPGEYECNATNAIGSASVVTVLRVRSHLAPLWPFLGILAEIIILVVIIVVYEKRKRPDEVPDDDEPAGPMKTNSTNNHKD

SEQ ID NO: 56672 - protein, 170 aa, Homo sapiens
  Payload ID: 11141
  Gene Symbol: NTS
  Gene Name: neurotensin
  Uniprot ID: P30990
  ENSP ID: ENSP00000256010
MMAGMKIQLVCMLLLAFSSWSLCSDSEEEMKALEADFLTNMHTSKISKAHVPSWKMTLLNVCSLVNNLNSPAEETGEVHEEELVARRKLPTALDGFSLEAMLTIYQLHKICHSRAFQHWELIQEDILDTGNDKNGKEEVIKRKIPYILKRQLYENKPRRPYILKRDSYYY

SEQ ID NO: 56673 - protein, 95 aa, Homo sapiens
  Payload ID: 11141
  Gene Symbol: NTS
  Gene Name: neurotensin
  ENSP ID: ENSP00000448328
MMAGMKIQLVCMLLLAFSSWSLCSDSEEEMKALEADFLTNMHTSKLIQEDILDTGNDKNGKEEVIKRKIPYILKRQLYENKPRRPYILKRDSYYY

SEQ ID NO: 56674 - protein, 418 aa, Homo sapiens
  Payload ID: 11142
  Gene Symbol: NTSR1
  Gene Name: neurotensin receptor 1 (high affinity)
  Uniprot ID: P30989
  ENSP ID: ENSP00000359532
MRLNSSAPGTPGTPAADPFQRAQAGLEEALLAPGFGNASGNASERVLAAPSSELDVNTDIYSKVLVTAVYLALFVVGTVGNTVTAFTLARKKSLQSLQSTVHYHLGSLALSDLLTLLLAMPVELYNFIWVHHPWAFGDAGCRGYYFLRDACTYATALNVASLSVERYLAICHPFKAKTLMSRSRTKKFISAIWLASALLAVPMLFTMGEQNRSADGQHAGGLVCTPTIHTATVKVVIQVNTFMSFIFPMVVISVLNTIIANKLTVMVRQAAEQGQVCTVGGEHSTFSMAIEPGRVQALRHGVRVLRAVVIAFVVCWLPYHVRRLMFCYISDEQWTPFLYDFYHYFYMVTNALFYVSSTINPILYNLVSANFRHIFLATLACLCPVWRRRRKRPAFSRKADSVSSNHTLSSNATRETLY

SEQ ID NO: 56675 - protein, 410 aa, Homo sapiens
  Payload ID: 11143
  Gene Symbol: NTSR2
  Gene Name: neurotensin receptor 2
  Uniprot ID: O95665
  ENSP ID: ENSP00000303686
METSSPRPPRPSSNPGLSLDARLGVDTRLWAKVLFTALYALIWALGAAGNALSAHVVLKARAGRAGRLRHHVLSLALAGLLLLLVGVPVELYSFVWFHYPWVFGDLGCRGYYFVHELCAYATVLSVAGLSAERCLAVCQPLRARSLLTPRRTRWLVALSWAASLGLALPMAVIMGQKHELETADGEPEPASRVCTVLVSRTALQVFIQVNVLVSFVLPLALTAFLNGVTVSHLLALCSQVPSTSTPGSSTPSRLELLSEEGLLSFIVWKKTFIQGGQVSLVRHKDVRRIRSLQRSVQVLRAIVVMYVICWLPYHARRLMYCYVPDDAWTDPLYNFYHYFYMVTNTLFYVSSAVTPLLYNAVSSSFRKLFLEAVSSLCGEHHPMKRLPPKPQSPTLMDTASGFGDPPETRT

SEQ ID NO: 56676 - protein, 316 aa, Homo sapiens
  Payload ID: 11144
  Gene Symbol: NTM
  Gene Name: neurotrimin
  Uniprot ID: Q9P121
  ENSP ID: ENSP00000363916
MGVCGYLFLPWKCLVVVSLRLLFLVPTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGETVL

SEQ ID NO: 56677 - protein, 344 aa, Homo sapiens
  Payload ID: 11144
  Gene Symbol: NTM
  Gene Name: neurotrimin
  Uniprot ID: Q9P121
  ENSP ID: ENSP00000363918
MGVCGYLFLPWKCLVVVSLRLLFLVPTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 56678 - protein, 344 aa, Homo sapiens
  Payload ID: 11144
  Gene Symbol: NTM
  Gene Name: neurotrimin
  Uniprot ID: Q9P121
  ENSP ID: ENSP00000363923
MKTIQPKMHNSISWAIFTGLAALCLFQGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 56679 - protein, 119 aa, Homo sapiens
  Payload ID: 11144
  Gene Symbol: NTM
  Gene Name: neurotrimin
  ENSP ID: ENSP00000387984
  MOD_RES (1)..(1): Any amino acid
XSAEFQWYKDDKRLIEGKKGVKVENRPFLSKLIFFNVSEHDYGNYTCVASNKLGHTNASIMLFELNEPTSSTLLQEVKTTALTPWKGPGAVSEVSNGTSRRAGCVWLLPLLVLHLLLKF

SEQ ID NO: 56680 - protein, 355 aa, Homo sapiens
  Payload ID: 11144
  Gene Symbol: NTM
  Gene Name: neurotrimin
  Uniprot ID: Q9P121
  ENSP ID: ENSP00000396722
MGVCGYLFLPWKCLVVVSLRLLFLVPTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFEVKTTALTPWKGPGAVSEVSNGTSRRAGCVWLLPLLVLHLLLKF

SEQ ID NO: 56681 - protein, 18 aa, Homo sapiens
  Payload ID: 11144
  Gene Symbol: NTM
  Gene Name: neurotrimin
  ENSP ID: ENSP00000400205
MNGKRNGEGGKRWKWKGT

SEQ ID NO: 56682 - protein, 36 aa, Homo sapiens
  Payload ID: 11144
  Gene Symbol: NTM
  Gene Name: neurotrimin
  ENSP ID: ENSP00000409221
MNGKRNGEGGKRWKWKGTGVPVRSGDATFPKAMDNV

SEQ ID NO: 56683 - protein, 179 aa, Homo sapiens
  Payload ID: 11144
  Gene Symbol: NTM
  Gene Name: neurotrimin
  ENSP ID: ENSP00000416320
VGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFEVKTTALTPWKGPGAVSEVSNGTSRRAGCVWLLPLLVLHLLLKF

SEQ ID NO: 56684 - protein, 168 aa, Homo sapiens
  Payload ID: 11144
  Gene Symbol: NTM
  Gene Name: neurotrimin
  ENSP ID: ENSP00000437668
VGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 56685 - protein, 191 aa, Homo sapiens
  Payload ID: 11144
  Gene Symbol: NTM
  Gene Name: neurotrimin
  ENSP ID: ENSP00000448104
MNGKRNGEGGKRWKWKGTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYE

SEQ ID NO: 56686 - protein, 793 aa, Homo sapiens
  Payload ID: 11145
  Gene Symbol: NTRK1
  Gene Name: neurotrophic tyrosine kinase, receptor, type 1
  ENSP ID: ENSP00000351486
MLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDASPSGVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 56687 - protein, 790 aa, Homo sapiens
  Payload ID: 11145
  Gene Symbol: NTRK1
  Gene Name: neurotrophic tyrosine kinase, receptor, type 1
  Uniprot ID: P04629
  ENSP ID: ENSP00000357179
MLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 56688 - protein, 760 aa, Homo sapiens
  Payload ID: 11145
  Gene Symbol: NTRK1
  Gene Name: neurotrophic tyrosine kinase, receptor, type 1
  Uniprot ID: P04629
  ENSP ID: ENSP00000376120
MKEAALICLAPSVPPILTVKSWDTMQLRAARSRCTNLLAASYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 56689 - protein, 796 aa, Homo sapiens
  Payload ID: 11145
  Gene Symbol: NTRK1
  Gene Name: neurotrophic tyrosine kinase, receptor, type 1
  Uniprot ID: P04629
  ENSP ID: ENSP00000431418
MLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPVSFSPVDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 56690 - protein, 388 aa, Homo sapiens
  Payload ID: 11145
  Gene Symbol: NTRK1
  Gene Name: neurotrophic tyrosine kinase, receptor, type 1
  ENSP ID: ENSP00000436804
MKEAALICLAPSVPPILTVKSWDTMQLRAARSRCTNLLAASYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMSRPVCSCTRRWRCTTGASPSLWMGSRHRLCAGSSMAPCSMRPASSSLSSWSRQPMRPCGTGVCASTSPPTSTTATTRCWLPTPSARPPPPSWLPSWTTLSSSTPRTPSLTLTAHLETRWRRRTKHLLGSRWLWAWPSLPASSFLRCSLCSTNVDGETSLGSTARLCWLQRMGWPCPCIS

SEQ ID NO: 56691 - protein, 838 aa, Homo sapiens
  Payload ID: 11146
  Gene Symbol: NTRK2
  Gene Name: neurotrophic tyrosine kinase, receptor, type 2
  Uniprot ID: Q16620
  ENSP ID: ENSP00000277120
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKDFSWFGFGKVKSRQGVGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 56692 - protein, 553 aa, Homo sapiens
  Payload ID: 11146
  Gene Symbol: NTRK2
  Gene Name: neurotrophic tyrosine kinase, receptor, type 2
  Uniprot ID: Q16620
  ENSP ID: ENSP00000306167
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKDFSWFGFGKVKSRQGVGPASVISNDDDSASPLHHISNGSNTPSSSEGGPDAVIIGMTKIPVIENPQYFGITNSQLKPDTWPRGSPKTA

SEQ ID NO: 56693 - protein, 822 aa, Homo sapiens
  Payload ID: 11146
  Gene Symbol: NTRK2
  Gene Name: neurotrophic tyrosine kinase, receptor, type 2
  Uniprot ID: Q16620
  ENSP ID: ENSP00000314586
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 56694 - protein, 477 aa, Homo sapiens
  Payload ID: 11146
  Gene Symbol: NTRK2
  Gene Name: neurotrophic tyrosine kinase, receptor, type 2
  Uniprot ID: Q16620
  ENSP ID: ENSP00000352906
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKGFVLFHKIPLDG

SEQ ID NO: 56695 - protein, 537 aa, Homo sapiens
  Payload ID: 11146
  Gene Symbol: NTRK2
  Gene Name: neurotrophic tyrosine kinase, receptor, type 2
  Uniprot ID: Q16620
  ENSP ID: ENSP00000365381
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKGPASVISNDDDSASPLHHISNGSNTPSSSEGGPDAVIIGMTKIPVIENPQYFGITNSQLKPDTWPRGSPKTA

SEQ ID NO: 56696 - protein, 822 aa, Homo sapiens; identical to SEQ ID NO: 56693
  Payload ID: 11146
  Gene Symbol: NTRK2
  Gene Name: neurotrophic tyrosine kinase, receptor, type 2
  Uniprot ID: Q16620
  ENSP ID: ENSP00000365386

SEQ ID NO: 56697 - protein, 838 aa, Homo sapiens; identical to SEQ ID NO: 56691
  Payload ID: 11146
  Gene Symbol: NTRK2
  Gene Name: neurotrophic tyrosine kinase, receptor, type 2
  Uniprot ID: Q16620
  ENSP ID: ENSP00000365387

SEQ ID NO: 56698 - protein, 477 aa, Homo sapiens; identical to SEQ ID NO: 56694
  Payload ID: 11146
  Gene Symbol: NTRK2
  Gene Name: neurotrophic tyrosine kinase, receptor, type 2
  Uniprot ID: Q16620
  ENSP ID: ENSP00000379221

SEQ ID NO: 56699 - protein, 612 aa, Homo sapiens
  Payload ID: 11147
  Gene Symbol: NTRK3
  Gene Name: neurotrophic tyrosine kinase, receptor, type 3
  Uniprot ID: Q16288
  ENSP ID: ENSP00000318328
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTWVFSNIDNHGILNLKDNRDHLVPSTHYIYEEPEVQSGEVSYPRSHGFREIMLNPISLPGHSKPLNHGIYVEDVNVYFSKGRHGF

SEQ ID NO: 56700 - protein, 817 aa, Homo sapiens
  Payload ID: 11147
  Gene Symbol: NTRK3
  Gene Name: neurotrophic tyrosine kinase, receptor, type 3
  Uniprot ID: Q16288
  ENSP ID: ENSP00000347397
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPVDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 56701 - protein, 831 aa, Homo sapiens
  Payload ID: 11147
  Gene Symbol: NTRK3
  Gene Name: neurotrophic tyrosine kinase, receptor, type 3
  Uniprot ID: Q16288
  ENSP ID: ENSP00000350356
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPVDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRLFNPSGNDFCIWCEVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 56702 - protein, 839 aa, Homo sapiens
  Payload ID: 11147
  Gene Symbol: NTRK3
  Gene Name: neurotrophic tyrosine kinase, receptor, type 3
  Uniprot ID: Q16288
  ENSP ID: ENSP00000354207
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRLFNPSGNDFCIWCEVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 56703 - protein, 825 aa, Homo sapiens
  Payload ID: 11147
  Gene Symbol: NTRK3
  Gene Name: neurotrophic tyrosine kinase, receptor, type 3
  Uniprot ID: Q16288
  ENSP ID: ENSP00000377990
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 56704 - protein, 617 aa, Homo sapiens
  Payload ID: 11147
  Gene Symbol: NTRK3
  Gene Name: neurotrophic tyrosine kinase, receptor, type 3
  ENSP ID: ENSP00000437773
MELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVVQA

SEQ ID NO: 56705 - protein, 612 aa, Homo sapiens; identical to SEQ ID NO: 56699
  Payload ID: 11147
  Gene Symbol: NTRK3
  Gene Name: neurotrophic tyrosine kinase, receptor, type 3
  Uniprot ID: Q16288
  ENSP ID: ENSP00000444673

SEQ ID NO: 56706 - protein, 705 aa, Homo sapiens
  Payload ID: 11147
  Gene Symbol: NTRK3
  Gene Name: neurotrophic tyrosine kinase, receptor, type 3
  ENSP ID: ENSP00000453511
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPVDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVK

SEQ ID NO: 56707 - protein, 817 aa, Homo sapiens; identical to SEQ ID NO: 56700
  Payload ID: 11147
  Gene Symbol: NTRK3
  Gene Name: neurotrophic tyrosine kinase, receptor, type 3
  Uniprot ID: Q16288
  ENSP ID: ENSP00000453959

SEQ ID NO: 56708 - protein, 146 aa, Homo sapiens
  Payload ID: 11147
  Gene Symbol: NTRK3
  Gene Name: neurotrophic tyrosine kinase, receptor, type 3
  ENSP ID: ENSP00000473315
  MOD_RES (1)..(1): Any amino acid
XGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRYTSAKALEECSDLSDRENTVKDSLYELIPPDRLCRHED

SEQ ID NO: 56709 - protein, 85 aa, Homo sapiens
  Payload ID: 11147
  Gene Symbol: NTRK3
  Gene Name: neurotrophic tyrosine kinase, receptor, type 3
  ENSP ID: ENSP00000473475
VGMSNASVALTVYFDEVSPTPPITVTHKPEEDTFGVSIAVGLAAFACVLLVVLFVMINKYGRRSKFGMKDGLELLAVLLKCDSKQ

SEQ ID NO: 56710 - protein, 90 aa, Homo sapiens
  Payload ID: 11147
  Gene Symbol: NTRK3
  Gene Name: neurotrophic tyrosine kinase, receptor, type 3
  ENSP ID: ENSP00000473656
MELYTGLQKLTIKNSGLRSIQPRAFAKNPHLRYINLSSNRLTTLSWQLFQTLSLRELQLEQNFFNCSCDIRWMQLWQEQGEAKLNSQNLY

SEQ ID NO: 56711 - protein, 49 aa, Homo sapiens
  Payload ID: 11147
  Gene Symbol: NTRK3
  Gene Name: neurotrophic tyrosine kinase, receptor, type 3
  ENSP ID: ENSP00000480693
THKPEEDTFGVPWLSSVVRRTQPAHCTTSTTASPRPRHWMPGPTLWSLA

SEQ ID NO: 56712 - protein, 839 aa, Homo sapiens; identical to SEQ ID NO: 56702
  Payload ID: 11147
  Gene Symbol: NTRK3
  Gene Name: neurotrophic tyrosine kinase, receptor, type 3
  Uniprot ID: Q16288
  ENSP ID: ENSP00000485864

SEQ ID NO: 56713 - protein, 864 aa, Homo sapiens
  Payload ID: 11147
  Gene Symbol: NTRK3
  Gene Name: neurotrophic tyrosine kinase, receptor, type 3
  ENSP ID: ENSP00000486784
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYREGPCQKGPFSVVWQRQRLAATAASTLFNPSGNDFCIWCEVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 56714 - protein, 257 aa, Homo sapiens
  Payload ID: 11148
  Gene Symbol: NTF3
  Gene Name: neurotrophin 3
  Uniprot ID: P20783
  ENSP ID: ENSP00000328738
MSILFYVIFLAYLRGIQGNNMDQRSLPEDSLNSLIIKLIQADILKNKLSKQMVDVKENYQSTLPKAEAPREPERGGPAKSAFQPVIAMDTELLRQQRRYNSPRVLLSDSTPLEPPPLYLMEDYVGSPVVANRTSRRKRYAEHKSHRGEYSVCDSESLWVTDKSSAIDIRGHQVTVLGEIKTGNSPVKQYFYETRCKEARPVKNGCRGIDDKHWNSQCKTSQTYVRALTSENNKLVGWRWIRIDTSCVCALSRKIGRT

SEQ ID NO: 56715 - protein, 270 aa, Homo sapiens
  Payload ID: 11148
  Gene Symbol: NTF3
  Gene Name: neurotrophin 3
  Uniprot ID: P20783
  ENSP ID: ENSP00000397297
MVTFATILQVNKVMSILFYVIFLAYLRGIQGNNMDQRSLPEDSLNSLIIKLIQADILKNKLSKQMVDVKENYQSTLPKAEAPREPERGGPAKSAFQPVIAMDTELLRQQRRYNSPRVLLSDSTPLEPPPLYLMEDYVGSPVVANRTSRRKRYAEHKSHRGEYSVCDSESLWVTDKSSAIDIRGHQVTVLGEIKTGNSPVKQYFYETRCKEARPVKNGCRGIDDKHWNSQCKTSQTYVRALTSENNKLVGWRWIRIDTSCVCALSRKIGRT

SEQ ID NO: 56716 - protein, 210 aa, Homo sapiens
  Payload ID: 11149
  Gene Symbol: NTF4
  Gene Name: neurotrophin 4
  Uniprot ID: P34130
  ENSP ID: ENSP00000469455
MLPLPSCSLPILLLFLLPSVPIESQPPPSTLPPFLAPEWDLLSPRVVLSRGAPAGPPLLFLLEAGAFRESAGAPANRSRRGVSETAPASRRGELAVCDAVSGWVTDRRTAVDLRGREVEVLGEVPAAGGSPLRQYFFETRCKADNAEEGGPGAGGGGCRGVDRRHWVSECKAKQSYVRALTADAQGRVGWRWIRIDTACVCTLLSRTGRA

SEQ ID NO: 56717 - protein, 153 aa, Homo sapiens
  Payload ID: 11149
  Gene Symbol: NTF4
  Gene Name: neurotrophin 4
  ENSP ID: ENSP00000470689
MLPLPSCSLPILLLFLLPSVPIESQPPPSTLPPFLAPEWDLLSPRVVLSRGAPAGPPLLFLLEAGAFRESAGAPANRSRRGSTVADPLPPTAKQDSRIWAFDEVLSRWETTSGSAYVPKTHGGPCAQPRAPEPADPTRTVGIKDSGEKLRHRS

SEQ ID NO: 56718 - protein, 143 aa, Homo sapiens
  Payload ID: 11149
  Gene Symbol: NTF4
  Gene Name: neurotrophin 4
  ENSP ID: ENSP00000471508
MLPLPSCSLPILLLFLLPSVPIESQPPPSTLPPFLAPEWDLLSPRVVLSRGAPAGPPLLFLLEAGAFRESAGAPANRSRRGVSETAPASRRGELAVCDAVSGWVTDRRTAVDLRGREVEVLGEVPAAGGSPLRQYFFETRCKA

SEQ ID NO: 56719 - protein, 197 aa, Homo sapiens
  Payload ID: 11150
  Gene Symbol: NRTN
  Gene Name: neurturin
  Uniprot ID: Q99748
  ENSP ID: ENSP00000302648
MQRWKAAALASVLCSSVLSIWMCREGLLLSHRLGPALVPLHRLPRTLDARIARLAQYRALLQGAPDAMELRELTPWAGRPPGPRRRAGPRRRRARARLGARPCGLRELEVRVSELGLGYASDETVLFRYCAGACEAAARVYDLGLRRLRQRRRLRRERVRAQPCCRPTAYEDEVSFLDAHSRYHTVHELSARECACV

SEQ ID NO: 56720 - protein, 307 aa, Homo sapiens
  Payload ID: 11151
  Gene Symbol: NCEH1
  Gene Name: neutral cholesterol ester hydrolase 1
  ENSP ID: ENSP00000392934
  MOD_RES (1)..(1): Any amino acid
XGGLRVVSPFPLCQPAGEPSQGKMRSSCVLLTALVALAAYYVYIPLPGSVSDPWKLMLLDATFRGAQQVSNLIHYLGLSHHLLALNFIIVSFGKKSAWSSAQVKVTDTDFDGVEVRVFEGPPKPEEPLKRSVVYIHGGGWALASASASWSPSDEIRYYDELCTAMAEELNAVIVSIEYRLVPKVYFPEQIHDVVRATKYFLKPEVLQKYMVDPGRICISGDSAGGNLAAALGQQFTQDASLKNKLKLQALIYPVLQALDFNTPSYQQNVNTPILPRYVMVKYWVDYFKGNYDFVQAMIVNNHTSLDV

SEQ ID NO: 56721 - protein, 93 aa, Homo sapiens
  Payload ID: 11151
  Gene Symbol: NCEH1
  Gene Name: neutral cholesterol ester hydrolase 1
  ENSP ID: ENSP00000402196
MSSCRGQKVAGGLRVVSPFPLCQPAGEPSQGKMRSSCVLLTALVALAAYYVYIPLPGSVSDPWKLMLLDATFRGAQQVKSGIMMSCVQQWLRN

SEQ ID NO: 56722 - protein, 440 aa, Homo sapiens
  Payload ID: 11151
  Gene Symbol: NCEH1
  Gene Name: neutral cholesterol ester hydrolase 1
  ENSP ID: ENSP00000418571
MSSCRGQKVAGGLRVVSPFPLCQPAGEPSQGKMRSSCVLLTALVALAAYYVYIPLPGSVSDPWKLMLLDATFRGAQQVSNLIHYLGLSHHLLALNFIIVSFGKKSAWSSAQVKVTDTDFDGVEVRVFEGPPKPEEPLKRSVVYIHGGGWALASAKIRYYDELCTAMAEELNAVIVSIEYRLVPKVYFPEQIHDVVRATKYFLKPEVLQKYMVDPGRICISGDSAGGNLAAALGQQFTQDASLKNKLKLQALIYPVLQALDFNTPSYQQNVNTPILPRYVMVKYWVDYFKGNYDFVQAMIVNNHTSLDVEEAAAVRARLNWTSLLPASFTKNYKPVVQTTGNARIVQELPQLLDARSAPLIADQAVLQLLPKTYILTCEHDVLRDDGIMYAKRLESAGVEVTLDHFEDGFHGCMIFTSWPTNFSVGIRTRNSYIKWLDQNL

SEQ ID NO: 56723 - protein, 448 aa, Homo sapiens
  Payload ID: 11151
  Gene Symbol: NCEH1
  Gene Name: neutral cholesterol ester hydrolase 1
  ENSP ID: ENSP00000442464
MSSCRGQKVAGGLRVVSPFPLCQPAGEPSQGKMRSSCVLLTALVALAAYYVYIPLPGSVSDPWKLMLLDATFRGAQQVSNLIHYLGLSHHLLALNFIIVSFGKKSAWSSAQVKVTDTDFDGVEVRVFEGPPKPEEPLKRSVVYIHGGGWALASASASWSPSDEIRYYDELCTAMAEELNAVIVSIEYRLVPKVYFPEQIHDVVRATKYFLKPEVLQKYMVDPGRICISGDSAGGNLAAALGQQFTQDASLKNKLKLQALIYPVLQALDFNTPSYQQNVNTPILPRYVMVKYWVDYFKGNYDFVQAMIVNNHTSLDVEEAAAVRARLNWTSLLPASFTKNYKPVVQTTGNARIVQELPQLLDARSAPLIADQAVLQLLPKTYILTCEHDVLRDDGIMYAKRLESAGVEVTLDHFEDGFHGCMIFTSWPTNFSVGIRTRNSYIKWLDQNL

SEQ ID NO: 56724 - protein, 275 aa, Homo sapiens
  Payload ID: 11151
  Gene Symbol: NCEH1
  Gene Name: neutral cholesterol ester hydrolase 1
  Uniprot ID: Q6PIU2
  ENSP ID: ENSP00000443227
MAEELNAVIVSIEYRLVPKVYFPEQIHDVVRATKYFLKPEVLQKYMVDPGRICISGDSAGGNLAAALGQQFTQDASLKNKLKLQALIYPVLQALDFNTPSYQQNVNTPILPRYVMVKYWVDYFKGNYDFVQAMIVNNHTSLDVEEAAAVRARLNWTSLLPASFTKNYKPVVQTTGNARIVQELPQLLDARSAPLIADQAVLQLLPKTYILTCEHDVLRDDGIMYAKRLESAGVEVTLDHFEDGFHGCMIFTSWPTNFSVGIRTRNSYIKWLDQNL

SEQ ID NO: 56725 - protein, 917 aa, Homo sapiens
  Payload ID: 11152
  Gene Symbol: NSMAF
  Gene Name: neutral sphingomyelinase (N-SMase) activation associated factor
  Uniprot ID: Q92636
  ENSP ID: ENSP00000038176
MAFIRKKQQEQQLQLYSKERFSLLLLNLEEYYFEQHRANHILHKGSHHERKIRGSLKICSKSVIFEPDSISQPIIKIPLRDCIKIGKHGENGANRHFTKAKSGGISLIFSQVYFIKEHNVVAPYKIERGKMEYVFELDVPGKVEDVVETLLQLHRASCLDKLGDQTAMITAILQSRLARTSFDKNRFQNISEKLHMECKAEMVTPLVTNPGHVCITDTNLYFQPLNGYPKPVVQITLQDVRRIYKRRHGLMPLGLEVFCTEDDLCSDIYLKFYEPQDRDDLYFYIATYLEHHVAEHTAESYMLQWQRGHLSNYQYLLHLNNLADRSCNDLSQYPVFPWIIHDYSSSELDLSNPGTFRDLSKPVGALNKERLERLLTRYQEMPEPKFMYGSHYSSPGYVLFYLVRIAPEYMLCLQNGRFDNADRMFNSIAETWKNCLDGATDFKELIPEFYGDDVSFLVNSLKLDLGKRQGGQMVDDVELPPWASSPEDFLQKSKDALESNYVSEHLHEWIDLIFGYKQKGSDAVGAHNVFHPLTYEGGVDLNSIQDPDEKVAMLTQILEFGQTPKQLFVTPHPRRITPKFKSLSQTSSYNASMADSPGEESFEDLTEESKTLAWNNITKLQLHEHYKIHKEAVTGITVSRNGSSVFTTSQDSTLKMFSKESKMLQRSISFSNMALSSCLLLPGDATVITSSWDNNVYFYSIAFGRRQDTLMGHDDAVSKICWHDNRLYSASWDSTVKVWSGVPAEMPGTKRHHFDLLAELEHDVSVDTISLNAASTLLVSGTKEGTVNIWDLTTATLMHQIPCHSGIVCDTAFSPDSRHVLSTGTDGCLNVIDVQTGMLISSMTSDEPQRCFVWDGNSVLSGSQSGELLVWDLLGAKISERIQGHTGAVTCIWMNEQCSSIITGGEDRQIIFWKLQY

SEQ ID NO: 56726 - protein, 948 aa, Homo sapiens
  Payload ID: 11152
  Gene Symbol: NSMAF
  Gene Name: neutral sphingomyelinase (N-SMase) activation associated factor
  Uniprot ID: Q92636
  ENSP ID: ENSP00000411012
MTGQARFHRGAEACRAIRQCRSRRPRAAHPEGRAGSGRGSRHASPGVRRGGFSLLLLNLEEYYFEQHRANHILHKGSHHERKIRGSLKICSKSVIFEPDSISQPIIKIPLRDCIKIGKHGENGANRHFTKAKSGGISLIFSQVYFIKEHNVVAPYKIERGKMEYVFELDVPGKVEDVVETLLQLHRASCLDKLGDQTAMITAILQSRLARTSFDKNRFQNISEKLHMECKAEMVTPLVTNPGHVCITDTNLYFQPLNGYPKPVVQITLQDVRRIYKRRHGLMPLGLEVFCTEDDLCSDIYLKFYEPQDRDDLYFYIATYLEHHVAEHTAESYMLQWQRGHLSNYQYLLHLNNLADRSCNDLSQYPVFPWIIHDYSSSELDLSNPGTFRDLSKPVGALNKERLERLLTRYQEMPEPKFMYGSHYSSPGYVLFYLVRIAPEYMLCLQNGRFDNADRMFNSIAETWKNCLDGATDFKELIPEFYGDDVSFLVNSLKLDLGKRQGGQMVDDVELPPWASSPEDFLQKSKDALESNYVSEHLHEWIDLIFGYKQKGSDAVGAHNVFHPLTYEGGVDLNSIQDPDEKVAMLTQILEFGQTPKQLFVTPHPRRITPKFKSLSQTSSYNASMADSPGEESFEDLTEESKTLAWNNITKLQLHEHYKIHKEAVTGITVSRNGSSVFTTSQDSTLKMFSKESKMLQRSISFSNMALSSCLLLPGDATVITSSWDNNVYFYSIAFGRRQDTLMGHDDAVSKICWHDNRLYSASWDSTVKVWSGVPAEMPGTKRHHFDLLAELEHDVSVDTISLNAASTLLVSGTKEGTVNIWDLTTATLMHQIPCHSGIVCDTAFSPDSRHVLSTGTDGCLNVIDVQTGMLISSMTSDEPQRCFVWDGNSVLSGSQSGELLVWDLLGAKISERIQGHTGAVTCIWMNEQCSSIITGGEDRQIIFWKLQY

SEQ ID NO: 56727 - protein, 65 aa, Homo sapiens
  Payload ID: 11152
  Gene Symbol: NSMAF
  Gene Name: neutral sphingomyelinase (N-SMase) activation associated factor
  ENSP ID: ENSP00000430195
MAFIRKKQQEQQLQLYSKERFSLLLLNLEEYYFEQHRANHILHKGSHHERPRNNSVAISTKNLVS

SEQ ID NO: 56728 - protein, 54 aa, Homo sapiens
  Payload ID: 11152
  Gene Symbol: NSMAF
  Gene Name: neutral sphingomyelinase (N-SMase) activation associated factor
  ENSP ID: ENSP00000430982
MAFIRKKQQEQQLQLYSKERFSLLLLNLEEYYFEQHRANHILHKGSHHERTYPG

SEQ ID NO: 56729 - protein, 390 aa, Homo sapiens
  Payload ID: 11153
  Gene Symbol: NCF1
  Gene Name: neutrophil cytosolic factor 1
  Uniprot ID: P14598
  ENSP ID: ENSP00000289473
MGDTFIRHIALLGFEKRFVPSQHYVYMFLVKWQDLSEKVVYRRFTEIYEFHKTLKEMFPIEAGAINPENRIIPHLPAPKWFDGQRAAENRQGTLTEYCSTLMSLPTKISRCPHLLDFFKVRPDDLKLPTDNQTKKPETYLMPKDGKSTATDITGPIILQTYRAIANYEKTSGSEMALSTGDVVEVVEKSESGWWFCQMKAKRGWIPASFLEPLDSPDETEDPEPNYAGEPYVAIKAYTAVEGDEVSLLEGEAVEVIHKLLDGWWVIRKDDVTGYFPSMYLQKSGQDVSQAQRQIKRGAPPRRSSIRNAHSIHQRSRKRLSQDAYRRNSVRFLQQRRRQARPGPQSPGSPLEEERQTQRSKPQPAVPPRPSADLILNRCSESTKRKLASAV

SEQ ID NO: 56730 - protein, 163 aa, Homo sapiens
  Payload ID: 11153
  Gene Symbol: NCF1
  Gene Name: neutrophil cytosolic factor 1
  ENSP ID: ENSP00000392870
  MOD_RES (1)..(1): Any amino acid
XYMFLVKWQDLSEKVVYRRFTEIYEFHKTLKEMFPIEAGAINPENRIIPHLPAPKWFDGQRAAENRQGTLTEYCSTLMSLPTKISRCPHLLDFFKVRPDDLKLPTDNQAPEGGRGRAQWLTRIIPALWKVEDKKARDILDAQRWQEYRDRHHRPHHPADVPRH

SEQ ID NO: 56731 - protein, 146 aa, Homo sapiens
  Payload ID: 11153
  Gene Symbol: NCF1
  Gene Name: neutrophil cytosolic factor 1
  ENSP ID: ENSP00000401935
  MOD_RES (1)..(1): Any amino acid
XYMFLVKWQDLSEKVVYRRFTEIYEFHRWDFAMLPRLVSNSWTQVILPPQPPKLLGLQKTLKEMFPIEAGAINPENRIIPHLPAPKWFDGQRAAENRQGTLTEYCSTLMSLPTKISRCPHLLDFFKVRPDDLKLPTDNQTKKPETY

SEQ ID NO: 56732 - protein, 52 aa, Homo sapiens
  Payload ID: 11153
  Gene Symbol: NCF1
  Gene Name: neutrophil cytosolic factor 1
  ENSP ID: ENSP00000484502
  MOD_RES (1)..(1): Any amino acid
XYMFLVKWQDLSEKVVYRRFTEIYEFHLPSGLTGSGPPRTARAHLPSTAARS

SEQ ID NO: 56733 - protein, 526 aa, Homo sapiens
  Payload ID: 11154
  Gene Symbol: NCF2
  Gene Name: neutrophil cytosolic factor 2
  Uniprot ID: P19878
  ENSP ID: ENSP00000356505
MSLVEAISLWNEGVLAADKKDWKGALDAFSAVQDPHSRICFNIGCMYTILKNMTEAEKAFTRSINRDKHLAVAYFQRGMLYYQTEKYDLAIKDLKEALIQLRGNQLIDYKILGLQFKLFACEVLYNIAFMYAKKEEWKKAEEQLALATSMKSEPRHSKIDKAMECVWKQKLYEPVVIPVGKLFRPNERQVAQLAKKDYLGKATVVASVVDQDSFSGFAPLQPQAAEPPPRPKTPEIFRALEGEAHRVLFGFVPETKEELQVMPGNIVFVLKKGNDNWATVMFNGQKGLVPCNYLEPVELRIHPQQQPQEESSPQSDIPAPPSSKAPGRPQLSPGQKQKEEPKEVKLSVPMPYTLKVHYKYTVVMKTQPGLPYSQVRDMVSKKLELRLEHTKLSYRPRDSNELVPLSEDSMKDAWGQVKNYCLTLWCENTVGDQGFPDEPKESEKADANNQTTEPQLKKGSQVEALFSYEATQPEDLEFQEGDIILVLSKVNEEWLEGECKGKVGIFPKVFVEDCATTDLESTRREV

SEQ ID NO: 56734 - protein, 526 aa, Homo sapiens; identical to SEQ ID NO: 56733
  Payload ID: 11154
  Gene Symbol: NCF2
  Gene Name: neutrophil cytosolic factor 2
  Uniprot ID: P19878
  ENSP ID: ENSP00000356506

SEQ ID NO: 56735 - protein, 56 aa, Homo sapiens
  Payload ID: 11154
  Gene Symbol: NCF2
  Gene Name: neutrophil cytosolic factor 2
  ENSP ID: ENSP00000397228
MPYTLKVHYKYTVVMKTQPGLPYSQVRDMVSKKLELRLEHTKLSYRPRDSNELVPL

SEQ ID NO: 56736 - protein, 481 aa, Homo sapiens
  Payload ID: 11154
  Gene Symbol: NCF2
  Gene Name: neutrophil cytosolic factor 2
  Uniprot ID: P19878
  ENSP ID: ENSP00000399294
MSLVEAISLWNEGVLAADKKDWKGALDAFSAVQDPHSRICFNIGCMYTILKNMTEAEKAFTRSINRDKHLAVAYFQRGMLYYQTEKYDLAIKDLKEALIQLRGNQLIDYKILGLQFKLFACEKQKLYEPVVIPVGKLFRPNERQVAQLAKKDYLGKATVVASVVDQDSFSGFAPLQPQAAEPPPRPKTPEIFRALEGEAHRVLFGFVPETKEELQVMPGNIVFVLKKGNDNWATVMFNGQKGLVPCNYLEPVELRIHPQQQPQEESSPQSDIPAPPSSKAPGRPQLSPGQKQKEEPKEVKLSVPMPYTLKVHYKYTVVMKTQPGLPYSQVRDMVSKKLELRLEHTKLSYRPRDSNELVPLSEDSMKDAWGQVKNYCLTLWCENTVGDQGFPDEPKESEKADANNQTTEPQLKKGSQVEALFSYEATQPEDLEFQEGDIILVLSKVNEEWLEGECKGKVGIFPKVFVEDCATTDLESTRREV

SEQ ID NO: 56737 - protein, 143 aa, Homo sapiens
  Payload ID: 11154
  Gene Symbol: NCF2
  Gene Name: neutrophil cytosolic factor 2
  ENSP ID: ENSP00000406198
MPGNIVFVLKKGNDNWATVMFNGQKGLVPCNYLEPVELRIHPQQQPQEESSPQSDIPAPPSSKAPGRPQLSPGQKQKEEPKEVKLSVPMPYTLKVHYKYTVVMKTQPGLPYSQVRDMVSKKLELRLEHTKLSYRPRDSNELVP

SEQ ID NO: 56738 - protein, 445 aa, Homo sapiens
  Payload ID: 11154
  Gene Symbol: NCF2
  Gene Name: neutrophil cytosolic factor 2
  Uniprot ID: P19878
  ENSP ID: ENSP00000407217
MSLVEAISLWNEGVLAADKKDWKGALDAFSAVQDPHSRICFNIGCMYTILKNMTEAEKAFTRSINRDKHLAVAYFQRGMLYYQTEKYDLAIKDLKEALIQLRGNQLIDYKILGLQFKLFACEVVASVVDQDSFSGFAPLQPQAAEPPPRPKTPEIFRALEGEAHRVLFGFVPETKEELQVMPGNIVFVLKKGNDNWATVMFNGQKGLVPCNYLEPVELRIHPQQQPQEESSPQSDIPAPPSSKAPGRPQLSPGQKQKEEPKEVKLSVPMPYTLKVHYKYTVVMKTQPGLPYSQVRDMVSKKLELRLEHTKLSYRPRDSNELVPLSEDSMKDAWGQVKNYCLTLWCENTVGDQGFPDEPKESEKADANNQTTEPQLKKGSQVEALFSYEATQPEDLEFQEGDIILVLSKVNEEWLEGECKGKVGIFPKVFVEDCATTDLESTRREV

SEQ ID NO: 56739 - protein, 339 aa, Homo sapiens
  Payload ID: 11155
  Gene Symbol: NCF4
  Gene Name: neutrophil cytosolic factor 4, 40kDa
  Uniprot ID: Q15080
  ENSP ID: ENSP00000248899
MAVAQQLRAESDFEQLPDDVAISANIADIEEKRGFTSHFVFVIEVKTKGGSKYLIYRRYRQFHALQSKLEERFGPDSKSSALACTLPTLPAKVYVGVKQEIAEMRIPALNAYMKSLLSLPVWVLMDEDVRIFFYQSPYDSEQVPQALRRLRPRTRKVKSVSPQGNSVDRMAAPRAEALFDFTGNSKLELNFKAGDVIFLLSRINKDWLEGTVRGATGIFPLSFVKILKDFPEEDDPTNWLRCYYYEDTISTIKDIAVEEDLSSTPLLKDLLELTRREFQREDIALNYRDAEGDLVRLLSDEDVALMVRQARGLPSQKRLFPWKLHITQKDNYRVYNTMP

SEQ ID NO: 56740 - protein, 348 aa, Homo sapiens
  Payload ID: 11155
  Gene Symbol: NCF4
  Gene Name: neutrophil cytosolic factor 4, 40kDa
  Uniprot ID: Q15080
  ENSP ID: ENSP00000380334
MAVAQQLRAESDFEQLPDDVAISANIADIEEKRGFTSHFVFVIEVKTKGGSKYLIYRRYRQFHALQSKLEERFGPDSKSSALACTLPTLPAKVYVGVKQEIAEMRIPALNAYMKSLLSLPVWVLMDEDVRIFFYQSPYDSEQVPQALRRLRPRTRKVKSVSPQGNSVDRMAAPRAEALFDFTGNSKLELNFKAGDVIFLLSRINKDWLEGTVRGATGIFPLSFVKILKDFPEEDDPTNWLRCYYYEDTISTIKSVAWEGGACPAFLPSLRPLPLTSPSHGSLSHSKAPSGSQMSHNAVTSHQRPGWPGQPHSPFPHPTPHFQPDASLLQPVTPLGTSRWRKISAALPY

SEQ ID NO: 56741 - protein, 166 aa, Homo sapiens
  Payload ID: 11155
  Gene Symbol: NCF4
  Gene Name: neutrophil cytosolic factor 4, 40kDa
  ENSP ID: ENSP00000414958
MRIPALNAYMKSLLSLPVWVLMDEDVRIFFYQSPYDSEQVPQALRRLRPRTRKVKSVSPQGNSVDRMAAPRAEALFDFTGNSKLELNFKAGDVIFLLSRINKDWLEGTVRGATGIFPLSFVKILKDFPEEDDPTNWLRCYYYEDTISTIKSVAWEGGACPAFLPSL

SEQ ID NO: 56742 - protein, 348 aa, Homo sapiens
  Payload ID: 11155
  Gene Symbol: NCF4
  Gene Name: neutrophil cytosolic factor 4, 40kDa
  Uniprot ID: Q15080
  ENSP ID: ENSP00000483977
MAVAQQLRAESDFEQLPDDVAISANIADIEEKRGFTSHFVFVIEVKTKGGSKYLIYRRYRQFHALQSKLEERFGPDSKSSALACTLPTLPAKVYVGVKQEIAEMRIPALNAYMKSLLSLPVWVLMDEDVRIFFYQSPYDSEQVPQALRRLRPRTRKVKSVSPQGNSVDRMAAPRAEALFDFTGNSKLELNFKAGDVIFLLSRINKDWLEGTVRGATGIFPLSFVKILKDFPEEDDPTNWLRCYYYEDTISTIKSVAWEGGACPAFLPSLRPPPLTSPSHGSLSHSKAPSGSQMSHNAVTSHQRPGWPGQPHSPFPHPTPHFQPDASLLQPVTPLGTSRWRKISAALPY

SEQ ID NO: 56743 - protein, 300 aa, Homo sapiens
  Payload ID: 11155
  Gene Symbol: NCF4
  Gene Name: neutrophil cytosolic factor 4, 40kDa
  ENSP ID: ENSP00000486446
MAVAQQLRAESDFEQLPDDVAISANIADIEEKRGFTSHFVFVIEVKTKGGSKYLIYRRYRQFHALQSKLEERFGPDSKSSALACTLPTLPAKVYVGVKQEIAEMRIPALNAYMKSLLSLPVWVLMDEDVRIFFYQSPYDSEQVPQALRRLRPRTRKVKSVSPQGNSVDRMAAPRAEALFDFTGNSKLELNFKAGDVIFLLSRINKDWLEGTVRGATGIFPLSFVKILKDFPEEDDPTNWLRCYYYEDTISTIKDIAVEEDLSSTPLLKDLLELTRREFQREDIALNYRDAEGDLVRLLSD

SEQ ID NO: 56744 - protein, 348 aa, Homo sapiens; identical to SEQ ID NO: 56742
  Payload ID: 11155
  Gene Symbol: NCF4
  Gene Name: neutrophil cytosolic factor 4, 40kDa
  Uniprot ID: Q15080
  ENSP ID: ENSP00000486471

SEQ ID NO: 56745 - protein, 166 aa, Homo sapiens; identical to SEQ ID NO: 56741
  Payload ID: 11155
  Gene Symbol: NCF4
  Gene Name: neutrophil cytosolic factor 4, 40kDa
  ENSP ID: ENSP00000486744

SEQ ID NO: 56746 - protein, 611 aa, Homo sapiens
  Payload ID: 11156
  Gene Symbol: NEXN
  Gene Name: nexilin (F actin binding protein)
  Uniprot ID: Q0ZGT2
  ENSP ID: ENSP00000327363
MNDISQKAEIKEMLASDDEEDVSSKVEKAYVPKLTGTVKGRFAEMEKQRQEEQRKRTEEERKRRIEQDMLEKRKIQRELAKRAEQIEDINNTGTESASEEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLKSKFEKIGQLSEKEIQKKIEEERARRRAIDLEIKEREAENFHEEDDVDVRPARKSEAPFTHKVNMKARFEQMAKAREEEEQRRIEEQKLLRMQFEQREIDAALQKKREEEEEEEGSIMNGSTAEDEEQTRSGAPWFKKPLKNTSVVDSEPVRFTVKVTGEPKPEITWWFEGEILQDGEDYQYIERGETYCLYLPETFPEDGGEYMCKAVNNKGSAASTCILTIESKN

SEQ ID NO: 56747 - protein, 675 aa, Homo sapiens
  Payload ID: 11156
  Gene Symbol: NEXN
  Gene Name: nexilin (F actin binding protein)
  Uniprot ID: Q0ZGT2
  ENSP ID: ENSP00000333938
MNDISQKAEILLSSSKPVPKTYVPKLGKGDVKDKFEAMQRAREERNQRRSRDEKQRRKEQYIREREWNRRKQEIKEMLASDDEEDVSSKVEKAYVPKLTGTVKGRFAEMEKQRQEEQRKRTEEERKRRIEQDMLEKRKIQRELAKRAEQIEDINNTGTESASEEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLKSKFEKIGQLSEKEIQKKIEEERARRRAIDLEIKEREAENFHEEDDVDVRPARKSEAPFTHKVNMKARFEQMAKAREEEEQRRIEEQKLLRMQFEQREIDAALQKKREEEEEEEGSIMNGSTAEDEEQTRSGAPWFKKPLKNTSVVDSEPVRFTVKVTGEPKPEITWWFEGEILQDGEDYQYIERGETYCLYLPETFPEDGGEYMCKAVNNKGSAASTCILTIESKN

SEQ ID NO: 56748 - protein, 576 aa, Homo sapiens
  Payload ID: 11156
  Gene Symbol: NEXN
  Gene Name: nexilin (F actin binding protein)
  ENSP ID: ENSP00000343928
  MOD_RES (1)..(1): Any amino acid
XVKGRFAEMEKQRQEEQRKRTEEERKRRIEQDMLEKRKIQRELAKRAEQIEDINNTGTESASEEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLKSKFEKIGQLSEKEIQKKIEEERARRRAIDLEIKEREAENFHEEDDVDVRPARKSEAPFTHKVNMKARFEQMAKAREEEEQRRIEEQKLLRMQFEQREIDAALQKKREEEEEEEGSIMNGSTAEDEEQTRSGAPWFKKPLKNTSVVDSEPVRFTVKVTGEPKPEITWWFEGEILQDGEDYQYIERGETYCLYLPETFPEDGGEYMCKAVNNKGSAASTCILTIETDDY

SEQ ID NO: 56749 - protein, 321 aa, Homo sapiens
  Payload ID: 11156
  Gene Symbol: NEXN
  Gene Name: nexilin (F actin binding protein)
  ENSP ID: ENSP00000383814
MNDISQKAEIKEMLASDDEEDVSSKVEKAYVPKLTGTVKGRFAEMEKQRQEEQRKRTEEERKRRIEQDMLEKRKIQRELAKRAEQIEDINNTGTESASEEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQK

SEQ ID NO: 56750 - protein, 435 aa, Homo sapiens
  Payload ID: 11156
  Gene Symbol: NEXN
  Gene Name: nexilin (F actin binding protein)
  ENSP ID: ENSP00000411902
MNDISQKAEILLSSSKPVPKTYVPKLGKGDVKDKFEAMQRAREERNQRRSRDEKQRRKEQYIREREWNRRKQEIKEMLASDDEEDVSSKVEKAYVPKLTGTVKGRFAEMEKQRQEEQRKRTEEERKRRIEQDMLEKRKIQRELAKRAEQEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLK

SEQ ID NO: 56751 - protein, 270 aa, Homo sapiens
  Payload ID: 11157
  Gene Symbol: NFAM1
  Gene Name: NFAT activating protein with ITAM motif 1
  Uniprot ID: Q8NET5
  ENSP ID: ENSP00000333680
MENQPVRWRALPGLPRPPGLPAAPWLLLGVLLLPGTLRLAGGQSVTHTGLPIMASLANTAISFSCRITYPYTPQFKVFTVSYFHEDLQGQRSPKKPTNCHPGLGTENQSHTLDCQVTLVLPGASATGTYYCSVHWPHSTVRGSGTFILVRDAGYREPPQSPQKLLLFGFTGLLSVLSVVGTALLLWNKKRMRGPGKDPTRKCPDPRSASSPKQHPSESVYTALQRRETEVYACIENEDGSSPTAKQSPLSQERPHRFEDDGELNLVYENL

SEQ ID NO: 56752 - protein, 164 aa, Homo sapiens
  Payload ID: 11157
  Gene Symbol: NFAM1
  Gene Name: NFAT activating protein with ITAM motif 1
  ENSP ID: ENSP00000347650
MENQPVRWRALPGLPRPPGLPAAPWLLLGVLLLPGTLRLAGGQSVTHTGLPIMASLANTAISFSCRITYPYTPQFKVFTVSYFHEDLQGQRSPKKPTNCHPGLGTENQSHTLDCQVTLVLPGASATGTYYCSVHWPHSTVRGSGTFILVRETRFRHVGQAGLES

SEQ ID NO: 56753 - protein, 415 aa, Homo sapiens
  Payload ID: 11158
  Gene Symbol: NKAP
  Gene Name: NFKB activating protein
  Uniprot ID: Q8N5F7
  ENSP ID: ENSP00000360464
MAPVSGSRSPDREASGSGGRRRSSSKSPKPSKSARSPRGRRSRSHSCSRSGDRNGLTHQLGGLSQGSRNQSYRSRSRSRSRERPSAPRGIPFASASSSVYYGSYSRPYGSDKPWPSLLDKEREESLRQKRLSERERIGELGAPEVWGLSPKNPEPDSDEHTPVEDEEPKKSTTSASTSEEEKKKKSSRSKERSKKRRKKKSSKRKHKKYSEDSDSDSDSETDSSDEDNKRRAKKAKKKEKKKKHRSKKYKKKRSKKSRKESSDSSSKESQEEFLENPWKDRTKAEEPSDLIGPEAPKTLTSQDDKPLNYGHALLPGEGAAMAEYVKAGKRIPRRGEIGLTSEEIASFECSGYVMSGSRHRRMEAVRLRKENQIYSADEKRALASFNQEERRKRENKILASFREMVYRKTKGKDDK

SEQ ID NO: 56754 - protein, 402 aa, Homo sapiens
  Payload ID: 11159
  Gene Symbol: NKAPL
  Gene Name: NFKB activating protein-like
  Uniprot ID: Q5M9Q1
  ENSP ID: ENSP00000345716
MPPVSRSSYSEDIVGSRRRRRSSSGSPPSPQSRCSSWDGCSRSHSRGREGLRPPWSELDVGALYPFSRSGSRGRLPRFRNYAFASSWSTSYSGYRYHRHCYAEERQSAEDYEKEESHRQRRLKERERIGELGAPEVWGPSPKFPQLDSDEHTPVEDEEEVTHQKSSSSDSNSEEHRKKKTSRSRNKKKRKNKSSKRKHRKYSDSDSNSESDTNSDSDDDKKRVKAKKKKKKKKHKTKKKKNKKTKKESSDSSCKDSEEDLSEATWMEQPNVADTMDLIGPEAPIIHTSQDEKPLKYGHALLPGEGAAMAEYVKAGKRIPRRGEIGLTSEEIGSFECSGYVMSGSRHRRMEAVRLRKENQIYSADEKRALASFNQEERRKRESKILASFREMVHKKTKEKDDK

SEQ ID NO: 56755 - protein, 192 aa, Homo sapiens
  Payload ID: 11160
  Gene Symbol: NKIRAS1
  Gene Name: NFKB inhibitor interacting Ras-like 1
  Uniprot ID: Q9NYS0
  ENSP ID: ENSP00000373411
MGKGCKVVVCGLLSVGKTAILEQLLYGNHTIGMEDCETMEDVYMASVETDRGVKEQLHLYDTRGLQEGVELPKHYFSFADGFVLVYSVNNLESFQRVELLKKEIDKFKDKKEVAIVVLGNKIDLSEQRQVDAEVAQQWAKSEKVRLWEVTVTDRKTLIEPFTLLASKLSQPQSKSSFPLPGRKNKGNSNSEN

SEQ ID NO: 56756 - protein, 192 aa, Homo sapiens; identical to SEQ ID NO: 56755
  Payload ID: 11160
  Gene Symbol: NKIRAS1
  Gene Name: NFKB inhibitor interacting Ras-like 1
  Uniprot ID: Q9NYS0
  ENSP ID: ENSP00000392307

SEQ ID NO: 56757 - protein, 192 aa, Homo sapiens; identical to SEQ ID NO: 56755
  Payload ID: 11160
  Gene Symbol: NKIRAS1
  Gene Name: NFKB inhibitor interacting Ras-like 1
  Uniprot ID: Q9NYS0
  ENSP ID: ENSP00000393785

SEQ ID NO: 56758 - protein, 192 aa, Homo sapiens; identical to SEQ ID NO: 56755
  Payload ID: 11160
  Gene Symbol: NKIRAS1
  Gene Name: NFKB inhibitor interacting Ras-like 1
  Uniprot ID: Q9NYS0
  ENSP ID: ENSP00000394214

SEQ ID NO: 56759 - protein, 192 aa, Homo sapiens
  Payload ID: 11160
  Gene Symbol: NKIRAS1
  Gene Name: NFKB inhibitor interacting Ras-like 1
  ENSP ID: ENSP00000396063
MGKGCKVVVCGLLSVGKTAILEQLLYGNHTIGMEDCETMEDVYMASVETDRGVKEQLHLYDTRGLQEGVELPKHYFSFADGFVLVYSVNNLESFQRVELLKKEIDKFKDKKEATIVVLGNKIDLSEQRQVDAEVAQQWAKSEKVRLWEVTVTDRKTLIEPFTLLASKLSQPQSKSSFPLPGRKNKGNSNSEN

SEQ ID NO: 56760 - protein, 192 aa, Homo sapiens; identical to SEQ ID NO: 56755
  Payload ID: 11160
  Gene Symbol: NKIRAS1
  Gene Name: NFKB inhibitor interacting Ras-like 1
  Uniprot ID: Q9NYS0
  ENSP ID: ENSP00000400385

SEQ ID NO: 56761 - protein, 192 aa, Homo sapiens; identical to SEQ ID NO: 56759
  Payload ID: 11160
  Gene Symbol: NKIRAS1
  Gene Name: NFKB inhibitor interacting Ras-like 1
  ENSP ID: ENSP00000406543

SEQ ID NO: 56762 - protein, 192 aa, Homo sapiens; identical to SEQ ID NO: 56759
  Payload ID: 11160
  Gene Symbol: NKIRAS1
  Gene Name: NFKB inhibitor interacting Ras-like 1
  ENSP ID: ENSP00000415225

SEQ ID NO: 56763 - protein, 192 aa, Homo sapiens; identical to SEQ ID NO: 56755
  Payload ID: 11160
  Gene Symbol: NKIRAS1
  Gene Name: NFKB inhibitor interacting Ras-like 1
  Uniprot ID: Q9NYS0
  ENSP ID: ENSP00000483749

SEQ ID NO: 56764 - protein, 191 aa, Homo sapiens
  Payload ID: 11161
  Gene Symbol: NKIRAS2
  Gene Name: NFKB inhibitor interacting Ras-like 2
  Uniprot ID: Q9NYR9
  ENSP ID: ENSP00000303580
MGKSCKVVVCGQASVGKTSILEQLLYGNHVVGSEMIETQEDIYVGSIETDRGVREQVRFYDTRGLRDGAELPRHCFSCTDGYVLVYSTDSRESFQRVELLKKEIDKSKDKKEVTIVVLGNKCDLQEQRRVDPDVAQHWAKSEKVKLWEVSVADRRSLLEPFVYLASKMTQPQSKSAFPLSRKNKGSGSLDG

SEQ ID NO: 56765 - protein, 229 aa, Homo sapiens
  Payload ID: 11161
  Gene Symbol: NKIRAS2
  Gene Name: NFKB inhibitor interacting Ras-like 2
  ENSP ID: ENSP00000312773
MGKSCKVVVCGQASVGKTSILEQLLYGNHVVGSEMIETQEDIYVGSIETDRGVREQVRFYDTRGLRDGAELPRHCFSCTDGYVLVYSTDSRESFQRVELLKKEIDKSKDKKEGLTLPPRLECSGMITAHCSLNLPRLRWSSCLSPLLRLQVTIVVLGNKCDLQEQRRVDPDVAQHWAKSEKVKLWEVSVADRRSLLEPFVYLASKMTQPQSKSAFPLSRKNKGSGSLDG

SEQ ID NO: 56766 - protein, 191 aa, Homo sapiens; identical to SEQ ID NO: 56764
  Payload ID: 11161
  Gene Symbol: NKIRAS2
  Gene Name: NFKB inhibitor interacting Ras-like 2
  Uniprot ID: Q9NYR9
  ENSP ID: ENSP00000377458

SEQ ID NO: 56767 - protein, 191 aa, Homo sapiens; identical to SEQ ID NO: 56764
  Payload ID: 11161
  Gene Symbol: NKIRAS2
  Gene Name: NFKB inhibitor interacting Ras-like 2
  Uniprot ID: Q9NYR9
  ENSP ID: ENSP00000377459

SEQ ID NO: 56768 - protein, 191 aa, Homo sapiens; identical to SEQ ID NO: 56764
  Payload ID: 11161
  Gene Symbol: NKIRAS2
  Gene Name: NFKB inhibitor interacting Ras-like 2
  Uniprot ID: Q9NYR9
  ENSP ID: ENSP00000377463

SEQ ID NO: 56769 - protein, 135 aa, Homo sapiens
  Payload ID: 11161
  Gene Symbol: NKIRAS2
  Gene Name: NFKB inhibitor interacting Ras-like 2
  Uniprot ID: Q9NYR9
  ENSP ID: ENSP00000401976
MGKSCKVVVCGQASVGKTSILEQLLYGNHVVGSEMIETQEDIYVGSIETDRGVREQVTIVVLGNKCDLQEQRRVDPDVAQHWAKSEKVKLWEVSVADRRSLLEPFVYLASKMTQPQSKSAFPLSRKNKGSGSLDG

SEQ ID NO: 56770 - protein, 41 aa, Homo sapiens
  Payload ID: 11161
  Gene Symbol: NKIRAS2
  Gene Name: NFKB inhibitor interacting Ras-like 2
  ENSP ID: ENSP00000419929
MGKSCKVVVCGQASVGKTSILEQLLYGNHVVGHHRGPWQQV

SEQ ID NO: 56771 - protein, 42 aa, Homo sapiens
  Payload ID: 11161
  Gene Symbol: NKIRAS2
  Gene Name: NFKB inhibitor interacting Ras-like 2
  ENSP ID: ENSP00000465588
MGKSCKVVVCGQASVGKTSILEQLLYGNHVVDSFLILYQVRR

SEQ ID NO: 56772 - protein, 97 aa, Homo sapiens
  Payload ID: 11161
  Gene Symbol: NKIRAS2
  Gene Name: NFKB inhibitor interacting Ras-like 2
  Uniprot ID: Q9NYR9
  ENSP ID: ENSP00000465633
MGKSCKVVVCGQASVGKTSILEQLLYGNHVVGSEMIETQEDIYVGSIETDRGVREQIAESLFSVWSCSRRRLTNPRTRRRSPSWSLATSVTYRSSGV

SEQ ID NO: 56773 - protein, 58 aa, Homo sapiens
  Payload ID: 11161
  Gene Symbol: NKIRAS2
  Gene Name: NFKB inhibitor interacting Ras-like 2
  ENSP ID: ENSP00000466135
MGKSCKVVVCGQASVGKTSILEQLLYGNHVVGSEMIETQEDIYVGSIETDRGVREQHR

SEQ ID NO: 56774 - protein, 46 aa, Homo sapiens
  Payload ID: 11161
  Gene Symbol: NKIRAS2
  Gene Name: NFKB inhibitor interacting Ras-like 2
  ENSP ID: ENSP00000468081
MGKSCKVVVCGQASVGKTSILEQLLYGNHVVGSEMIETQEDIYVGS

SEQ ID NO: 56775 - protein, 140 aa, Homo sapiens
  Payload ID: 11161
  Gene Symbol: NKIRAS2
  Gene Name: NFKB inhibitor interacting Ras-like 2
  ENSP ID: ENSP00000468245
MIETQEDIYVGSIETDRGVREQVRFYDTRGLRDGAELPRHCFSCTDGYVLVYSTDSRESFQRVELLKKEIDKSKDKKEVTIVVLGNKCDLQEQRRVDPDVAQHWAKSEKVKLWEVSVADRRSLLEPFVYLASKMTQPQSK

SEQ ID NO: 56776 - protein, 690 aa, Homo sapiens
  Payload ID: 11162
  Gene Symbol: NKRF
  Gene Name: NFKB repressing factor
  Uniprot ID: O15226
  ENSP ID: ENSP00000304803
MEKILQMAEGIDIGEMPSYDLVLSKPSKGQKRHLSTCDGQNPPKKQAGSKFHARPRFEPVHFVASSSKDERQEDPYGPQTKEVNEQTHFASMPRDIYQDYTQDSFSIQDGNSQYCDSSGFILTKDQPVTANMYFDSGNPAPSTTSQQANSQSTPEPSPSQTFPESVVAEKQYFIEKLTATIWKNLSNPEMTSGSDKINYTYMLTRCIQACKTNPEYIYAPLKEIPPADIPKNKKLLTDGYACEVRCQNIYLTTGYAGSKNGSRDRATELAVKLLQKRIEVRVVRRKFKHTFGEDLVVCQIGMSSYEFPPALKPPEDLVVLGKDASGQPIFNASAKHWTNFVITENANDAIGILNNSASFNKMSIEYKYEMMPNRTWRCRVFLQDHCLAEGYGTKKTSKHAAADEALKILQKTQPTYPSVKSSQCHTGSSPRGSGKKKDIKDLVVYENSSNPVCTLNDTAQFNRMTVEYVYERMTGLRWKCKVILESEVIAEAVGVKKTVKYEAAGEAVKTLKKTQPTVINNLKKGAVEDVISRNEIQGRSAEEAYKQQIKEDNIGNQLLRKMGWTGGGLGKSGEGIREPISVKEQHKREGLGLDVERVNKIAKRDIEQIIRNYARSESHTDLTFSRELTNDERKQIHQIAQKYGLKSKSHGVGHDRYLVVGRKRRKEDLLDQLKQEGQVGHYELVMPQAN

SEQ ID NO: 56777 - protein, 690 aa, Homo sapiens; identical to SEQ ID NO: 56776
  Payload ID: 11162
  Gene Symbol: NKRF
  Gene Name: NFKB repressing factor
  Uniprot ID: O15226
  ENSP ID: ENSP00000360582

SEQ ID NO: 56778 - protein, 705 aa, Homo sapiens
  Payload ID: 11162
  Gene Symbol: NKRF
  Gene Name: NFKB repressing factor
  Uniprot ID: O15226
  ENSP ID: ENSP00000442308
MGFMLPLIFRYSPRLMEKILQMAEGIDIGEMPSYDLVLSKPSKGQKRHLSTCDGQNPPKKQAGSKFHARPRFEPVHFVASSSKDERQEDPYGPQTKEVNEQTHFASMPRDIYQDYTQDSFSIQDGNSQYCDSSGFILTKDQPVTANMYFDSGNPAPSTTSQQANSQSTPEPSPSQTFPESVVAEKQYFIEKLTATIWKNLSNPEMTSGSDKINYTYMLTRCIQACKTNPEYIYAPLKEIPPADIPKNKKLLTDGYACEVRCQNIYLTTGYAGSKNGSRDRATELAVKLLQKRIEVRVVRRKFKHTFGEDLVVCQIGMSSYEFPPALKPPEDLVVLGKDASGQPIFNASAKHWTNFVITENANDAIGILNNSASFNKMSIEYKYEMMPNRTWRCRVFLQDHCLAEGYGTKKTSKHAAADEALKILQKTQPTYPSVKSSQCHTGSSPRGSGKKKDIKDLVVYENSSNPVCTLNDTAQFNRMTVEYVYERMTGLRWKCKVILESEVIAEAVGVKKTVKYEAAGEAVKTLKKTQPTVINNLKKGAVEDVISRNEIQGRSAEEAYKQQIKEDNIGNQLLRKMGWTGGGLGKSGEGIREPISVKEQHKREGLGLDVERVNKIAKRDIEQIIRNYARSESHTDLTFSRELTNDERKQIHQIAQKYGLKSKSHGVGHDRYLVVGRKRRKEDLLDQLKQEGQVGHYELVMPQAN

SEQ ID NO: 56779 - protein, 387 aa, Homo sapiens
  Payload ID: 11162
  Gene Symbol: NKRF
  Gene Name: NFKB repressing factor
  ENSP ID: ENSP00000481262
MEKILQMAEGIDIGEMPSYDLVLSKPSKGQKRHLSTCDGQNPPKKQAGSKFHARPRFEPVHFVASSSKDERQEDPYGPQTKEVNEQTHFASMPRDIYQDYTQDSFSIQDGNSQYCDSSGFILTKDQPVTANMYFDSGNPAPSTTSQQANSQSTPEPSPSQTFPESVVAEKQYFIEKLTATIWKNLSNPEMTSGSDKINYTYMLTRCIQACKTNPEYIYAPLKEIPPADIPKNKKLLTDGYACEVRCQNIYLTTGYAGSKNGSRDRATELAVKLLQKRIEVRVVRRKFKHTFGEDLVVCQIGMSSYEFPPALKPPEDLVVLGKDASGQPIFNASAKHWTNFVITENANDAIGILNNSASFNKMSIEYKYEMMPNRTWRSSVFTRSLLS

SEQ ID NO: 56780 - protein, 189 aa, Homo sapiens
  Payload ID: 11163
  Gene Symbol: NFS1
  Gene Name: NFS1 cysteine desulfurase
  ENSP ID: ENSP00000304740
MLLRAAWRRAAVAVTAAPGPKPAAPTRGLRLRVGDRAPQSAVPADTAAAPEVGPVLRPLYMDVQATTPLDPRVLDAMLPYLINYYGNPHSRTHAYGWESEAAMERARQQVASLIGADPREIIFTSGATESNNIAIKTESHSVIQAGVQWHDLDSLQAPPPGFTPFSCLSLLSSWDYRRPPPHPANFLYF

SEQ ID NO: 56781 - protein, 397 aa, Homo sapiens
  Payload ID: 11163
  Gene Symbol: NFS1
  Gene Name: NFS1 cysteine desulfurase
  Uniprot ID: Q9Y697
  ENSP ID: ENSP00000363198
MDVQATTPLDPRVLDAMLPYLINYYGNPHSRTHAYGWESEAAMERARQQVASLIGADPREIIFTSGATESNNIAIKGVARFYRSRKKHLITTQTEHKCVLDSCRSLEAEGFQVTYLPVQKSGIIDLKELEAAIQPDTSLVSVMTVNNEIGVKQPIAEIGRICSSRKVYFHTDAAQAVGKIPLDVNDMKIDLMSISGHKIYGPKGVGAIYIRRRPRVRVEALQSGGGQERGMRSGTVPTPLVVGLGAACEVAQQEMEYDHKRISKLSERLIQNIMKSLPDVVMNGDPKHHYPGCINLSFAYVEGESLLMALKDVALSSGSACTSASLEPSYVLRAIGTDEDLAHSSIRFGIGRFTTEEEVDYTVEKCIQHVKRLREMSPLWEMVQDGIDLKSIKWTQH

SEQ ID NO: 56782 - protein, 457 aa, Homo sapiens
  Payload ID: 11163
  Gene Symbol: NFS1
  Gene Name: NFS1 cysteine desulfurase
  Uniprot ID: Q9Y697
  ENSP ID: ENSP00000363205
MLLRAAWRRAAVAVTAAPGPKPAAPTRGLRLRVGDRAPQSAVPADTAAAPEVGPVLRPLYMDVQATTPLDPRVLDAMLPYLINYYGNPHSRTHAYGWESEAAMERARQQVASLIGADPREIIFTSGATESNNIAIKGVARFYRSRKKHLITTQTEHKCVLDSCRSLEAEGFQVTYLPVQKSGIIDLKELEAAIQPDTSLVSVMTVNNEIGVKQPIAEIGRICSSRKVYFHTDAAQAVGKIPLDVNDMKIDLMSISGHKIYGPKGVGAIYIRRRPRVRVEALQSGGGQERGMRSGTVPTPLVVGLGAACEVAQQEMEYDHKRISKLSERLIQNIMKSLPDVVMNGDPKHHYPGCINLSFAYVEGESLLMALKDVALSSGSACTSASLEPSYVLRAIGTDEDLAHSSIRFGIGRFTTEEEVDYTVEKCIQHVKRLREMSPLWEMVQDGIDLKSIKWTQH

SEQ ID NO: 56783 - protein, 397 aa, Homo sapiens; identical to SEQ ID NO: 56781
  Payload ID: 11163
  Gene Symbol: NFS1
  Gene Name: NFS1 cysteine desulfurase
  Uniprot ID: Q9Y697
  ENSP ID: ENSP00000380570

SEQ ID NO: 56784 - protein, 204 aa, Homo sapiens
  Payload ID: 11163
  Gene Symbol: NFS1
  Gene Name: NFS1 cysteine desulfurase
  ENSP ID: ENSP00000392871
MDVQATTPLDPRVLDAMLPYLINYYGNPHSRTHAYGWESEAAMERARQQVASLIGADPREIIFTSGATESNNIAIKGVARFYRSRKKHLITTQTEHKCVLDSCRSLEAEGFQVTYLPVQKSGIIDLKELEAAIQPDTSLVSVMTVNNEIGVKQPIAEIGRICSSRKVYFHTDAAQAVGKIPLDVNDMKIDLMSISGHKIYGPKV

SEQ ID NO: 56785 - protein, 107 aa, Homo sapiens
  Payload ID: 11163
  Gene Symbol: NFS1
  Gene Name: NFS1 cysteine desulfurase
  ENSP ID: ENSP00000393482
MDVQATTPLDPRVLDAMLPYLINYYGNPHSRTHAYGWESEAAMERARQQVASLIGADPREIIFTSGATESNNIAIKGVARFYRSRKKHLITTQTEHKCVLDSCRSLE

SEQ ID NO: 56786 - protein, 87 aa, Homo sapiens
  Payload ID: 11163
  Gene Symbol: NFS1
  Gene Name: NFS1 cysteine desulfurase
  ENSP ID: ENSP00000393669
MDVQATTPLDPRVLDAMLPYLINYYGNPHSRTHAYGWESEAAMERARQQVASLIGADPREIIFTSGATESNNIAIKMESHPVAQARV

SEQ ID NO: 56787 - protein, 147 aa, Homo sapiens
  Payload ID: 11163
  Gene Symbol: NFS1
  Gene Name: NFS1 cysteine desulfurase
  ENSP ID: ENSP00000397572
MLLRAAWRRAAVAVTAAPGPKPAAPTRGLRLRVGDRAPQSAVPADTAAAPEVGPVLRPLYMDVQATTPLDPRVLDAMLPYLINYYGNPHSRTHAYGWESEAAMERARQQVASLIGADPREIIFTSGATESNNIAIKMESHPVAQARV

SEQ ID NO: 56788 - protein, 406 aa, Homo sapiens
  Payload ID: 11163
  Gene Symbol: NFS1
  Gene Name: NFS1 cysteine desulfurase
  Uniprot ID: Q9Y697
  ENSP ID: ENSP00000440897
MLLRAAWRRAAVAVTAAPGPKPAAPTRGLRLRVGDRAPQSAVPADTAAAPEVGPVLRPLYMDVQATTPLDPRVLDAMLPYLINYYGNPHSRTHAYGWESEAAMERARQQVASLIGADPREIIFTSGATESNNIAIKELEAAIQPDTSLVSVMTVNNEIGVKQPIAEIGRICSSRKVYFHTDAAQAVGKIPLDVNDMKIDLMSISGHKIYGPKGVGAIYIRRRPRVRVEALQSGGGQERGMRSGTVPTPLVVGLGAACEVAQQEMEYDHKRISKLSERLIQNIMKSLPDVVMNGDPKHHYPGCINLSFAYVEGESLLMALKDVALSSGSACTSASLEPSYVLRAIGTDEDLAHSSIRFGIGRFTTEEEVDYTVEKCIQHVKRLREMSPLWEMVQDGIDLKSIKWTQH

SEQ ID NO: 56789 - protein, 230 aa, Homo sapiens
  Payload ID: 11164
  Gene Symbol: NFU1
  Gene Name: NFU1 iron-sulfur cluster scaffold
  Uniprot ID: Q9UMS0
  ENSP ID: ENSP00000306965
MLKNPYTIKKQPLHQFVQRPLFPLPAAFYHPVRYMFIQTQDTPNPNSLKFIPGKPVLETRTMDFPTPAAAFRSPLARQLFRIEGVKSVFFGPDFITVTKENEELDWNLLKPDIYATIMDFFASGLPLVTEETPSGEAGSEEDDEVVAMIKELLDTRIRPTVQEDGGDVIYKGFEDGIVQLKLQGSCTSCPSSIITLKNGIQNMLQFYIPEVEGVEQVMDDESDEKEANSP

SEQ ID NO: 56790 - protein, 113 aa, Homo sapiens
  Payload ID: 11164
  Gene Symbol: NFU1
  Gene Name: NFU1 iron-sulfur cluster scaffold
  Uniprot ID: Q9UMS0
  ENSP ID: ENSP00000377842
MDFFASGLPLVTEETPSGEAGSEEDDEVVAMIKELLDTRIRPTVQEDGGDVIYKGFEDGIVQLKLQGSCTSCPSSIITLKNGIQNMLQFYIPEVEGVEQVMDDESDEKEANSP

SEQ ID NO: 56791 - protein, 254 aa, Homo sapiens
  Payload ID: 11164
  Gene Symbol: NFU1
  Gene Name: NFU1 iron-sulfur cluster scaffold
  Uniprot ID: Q9UMS0
  ENSP ID: ENSP00000387219
MAATARRGWGAAAVAAGLRRRFCHMLKNPYTIKKQPLHQFVQRPLFPLPAAFYHPVRYMFIQTQDTPNPNSLKFIPGKPVLETRTMDFPTPAAAFRSPLARQLFRIEGVKSVFFGPDFITVTKENEELDWNLLKPDIYATIMDFFASGLPLVTEETPSGEAGSEEDDEVVAMIKELLDTRIRPTVQEDGGDVIYKGFEDGIVQLKLQGSCTSCPSSIITLKNGIQNMLQFYIPEVEGVEQVMDDESDEKEANSP

SEQ ID NO: 56792 - protein, 39 aa, Homo sapiens
  Payload ID: 11164
  Gene Symbol: NFU1
  Gene Name: NFU1 iron-sulfur cluster scaffold
  ENSP ID: ENSP00000393338
MLKNPYTIKKQPLHQFVQRPLFPLPAAFYHPGSYLGLKE

SEQ ID NO: 56793 - protein, 42 aa, Homo sapiens
  Payload ID: 11164
  Gene Symbol: NFU1
  Gene Name: NFU1 iron-sulfur cluster scaffold
  ENSP ID: ENSP00000405495
MLKNPYTIKKQPLHQFVQRPLFPLPAAFYHPGSHYVAQAKVQ

SEQ ID NO: 56794 - protein, 99 aa, Homo sapiens
  Payload ID: 11164
  Gene Symbol: NFU1
  Gene Name: NFU1 iron-sulfur cluster scaffold
  ENSP ID: ENSP00000415102
MDFFASGLPLVTEETPSGEAGSEEDDEVVAMIKELLDTRIRPTVQEDGGDVIYKGFEDGIVQLKLQGSCTSCPSSIITLKNGIQNMLQFYIPEVEGVEQ

SEQ ID NO: 56795 - protein, 96 aa, Homo sapiens
  Payload ID: 11164
  Gene Symbol: NFU1
  Gene Name: NFU1 iron-sulfur cluster scaffold
  ENSP ID: ENSP00000417693
MDFFASGLPLVTEETPSGEAGSEEDDEVVAMIKELLDTRIRPTVQEDGGDVIYKGFEDGIVQLKLQGSCTSCPSSIITLKNGIQNMLQFYIPEVEG

SEQ ID NO: 56796 - protein, 113 aa, Homo sapiens; identical to SEQ ID NO: 56790
  Payload ID: 11164
  Gene Symbol: NFU1
  Gene Name: NFU1 iron-sulfur cluster scaffold
  Uniprot ID: Q9UMS0
  ENSP ID: ENSP00000418598

SEQ ID NO: 56797 - protein, 126 aa, Homo sapiens
  Payload ID: 11164
  Gene Symbol: NFU1
  Gene Name: NFU1 iron-sulfur cluster scaffold
  ENSP ID: ENSP00000418882
ENEELDWNLLKPDIYATIMDFFASGLPLVTEETPSGEAGSEEDDEVVAMIKELLDTRIRPTVQEDGGDVIYKGFEDGIVQLKLQGSCTSCPSSIITLKNGIQNMLQFYIPEVEGVEQEYNTAPCHQ

SEQ ID NO: 56798 - protein, 487 aa, Homo sapiens
  Payload ID: 11165
  Gene Symbol: NAB1
  Gene Name: NGFI-A binding protein 1 (EGR1 binding protein 1)
  Uniprot ID: Q13506
  ENSP ID: ENSP00000336894
MAAALPRTLGELQLYRILQKANLLSYFDAFIQQGGDDVQQLCEAGEEEFLEIMALVGMASKPLHVRRLQKALRDWVTNPGLFNQPLTSLPVSSIPIYKLPEGSPTWLGISCSSYERSSNAREPHLKIPKCAATTCVQSLGQGKSDVVGSLALQSVGESRLWQGHHATESEHSLSPADLGSPASPKESSEALDAAAALSVAECVERMAPTLPKSDLNEVKELLKTNKKLAKMIGHIFEMNDDDPHKEEEIRKYSAIYGRFDSKRKDGKHLTLHELTVNEAAAQLCVKDNALLTRRDELFALARQISREVTYKYTYRTTKSKCGERDELSPKRIKVEDGFPDFQDSVQTLFQQARAKSEELAALSSQQPEKVMAKQMEFLCNQAGYERLQHAERRLSAGLYRQSSEEHSPNGLTSDNSDGQGERPLNLRMPNLQNRQPHHFVVDGELSRLYPSEAKSHSSESLGILKDYPHSAFTLEKKVIKTEPEDSR

SEQ ID NO: 56799 - protein, 486 aa, Homo sapiens
  Payload ID: 11165
  Gene Symbol: NAB1
  Gene Name: NGFI-A binding protein 1 (EGR1 binding protein 1)
  ENSP ID: ENSP00000386682
MAAALPRTLGELQLYRILQKANLLSYFDAFIQQGGDDVQQLCEAGEEEFLEIMALVGMASKPLHVRRLQKALRDWVTNPGLFNQPLTSLPVSSIPIYKLPEGSPTWLGISCSSYERSSNAREPHLKIPKCAATTCVQSLGQGKSDVVGSLALQSVGESRLWQGHHATESEHSLSPADLGSPASPKESSEALDAAAALSVAECVERMAPTLPKSDLNEVKELLKTNKKLAKMIGHIFEMNDDDPHKEEEIRKYSAIYGRFDSKRKDGKHLTLHELTVNEAAAQLCVKDNALLTRRDELFALARQISREVTYKYTYRTTKSKCGERDELSPKRIKVEDGFPDFQDSVQTLFQQARAKSEELAALSSQPEKVMAKQMEFLCNQAGYERLQHAERRLSAGLYRQSSEEHSPNGLTSDNSDGQGERPLNLRMPNLQNRQPHHFVVDGELSRLYPSEAKSHSSESLGILKDYPHSAFTLEKKVIKTEPEDSR

SEQ ID NO: 56800 - protein, 487 aa, Homo sapiens; identical to SEQ ID NO: 56798
  Payload ID: 11165
  Gene Symbol: NAB1
  Gene Name: NGFI-A binding protein 1 (EGR1 binding protein 1)
  Uniprot ID: Q13506
  ENSP ID: ENSP00000387089

SEQ ID NO: 56801 - protein, 152 aa, Homo sapiens
  Payload ID: 11165
  Gene Symbol: NAB1
  Gene Name: NGFI-A binding protein 1 (EGR1 binding protein 1)
  ENSP ID: ENSP00000388301
MAAALPRTLGELQLYRILQKANLLSYFDAFIQQGGDDVQQLCEAGEEEFLEIMALVGMASKPLHVRRLQKALRDWVTNPGLFNQPLTSLPVSSIPIYKLPEGSPTWLGISCSSYERSSNAREPHLKIPKCAATTCVQSLGQGKSDVVGSLAL

SEQ ID NO: 56802 - protein, 240 aa, Homo sapiens
  Payload ID: 11165
  Gene Symbol: NAB1
  Gene Name: NGFI-A binding protein 1 (EGR1 binding protein 1)
  ENSP ID: ENSP00000390914
  MOD_RES (1)..(1): Any amino acid
XKELLKTNKKLAKMIGHIFEMNDDDPHKEEEIRKYSAIYGRFDSKRKDGKHLTLHELTVNEAAAQLCVKDNALLTRRDELFALARQISREVTYKYTYRTTKSKCGERDELSPKRIKVEQPEKVMAKQMEFLCNQAGYERLQHAERRLSAGLYRQSSEEHSPNGLTSDNSDGQGERPLNLRMPNLQNRQPHHFVVDGELSRLYPSEAKSHSSESLGILKDYPHSAFTLEKKVIKTEPEDSR

SEQ ID NO: 56803 - protein, 84 aa, Homo sapiens
  Payload ID: 11165
  Gene Symbol: NAB1
  Gene Name: NGFI-A binding protein 1 (EGR1 binding protein 1)
  ENSP ID: ENSP00000395444
MALVGMASKPLHVRRLQKALRDWVTNPGLFNQPLTSLPVSSIPIYKLPEGSPTWLGISCSSYERSSNAREPHLKIPKCAATTCV

SEQ ID NO: 56804 - protein, 100 aa, Homo sapiens
  Payload ID: 11165
  Gene Symbol: NAB1
  Gene Name: NGFI-A binding protein 1 (EGR1 binding protein 1)
  ENSP ID: ENSP00000397014
MAAALPRTLGELQLYRILQKANLLSYFDAFIQQGGDDVQQLCEAGEEEFLEIMALVGMASKPLHVRRLQKALRDWVTNPGLFNQPLTSLPVSSIPIYKLP

SEQ ID NO: 56805 - protein, 62 aa, Homo sapiens
  Payload ID: 11165
  Gene Symbol: NAB1
  Gene Name: NGFI-A binding protein 1 (EGR1 binding protein 1)
  ENSP ID: ENSP00000403243
MAAALPRTLGELQLYRILQKANLLSYFDAFIQQGGDDVQQLCEAGEEEFLEIMALVGMASKP

SEQ ID NO: 56806 - protein, 157 aa, Homo sapiens
  Payload ID: 11165
  Gene Symbol: NAB1
  Gene Name: NGFI-A binding protein 1 (EGR1 binding protein 1)
  ENSP ID: ENSP00000404104
MAAALPRTLGELQLYRILQKANLLSYFDAFIQQGGDDVQQLCEAGEEEFLEIMALVGMASKPLHVRRLQKALRDWVTNPGLFNQPLTSLPVSSIPIYKLPEGSPTWLGISCSSYERSSNAREPHLKIPKCAATTCVQSLGQGKSDVVGSLALQSVGE

SEQ ID NO: 56807 - protein, 525 aa, Homo sapiens
  Payload ID: 11166
  Gene Symbol: NAB2
  Gene Name: NGFI-A binding protein 2 (EGR1 binding protein 2)
  Uniprot ID: Q15742
  ENSP ID: ENSP00000300131
MHRAPSPTAEQPPGGGDSARRTLQPRLKPSARAMALPRTLGELQLYRVLQRANLLSYYETFIQQGGDDVQQLCEAGEEEFLEIMALVGMATKPLHVRRLQKALREWATNPGLFSQPVPAVPVSSIPLFKISETAGTRKGSMSNGHGSPGEKAGSARSFSPKSPLELGEKLSPLPGGPGAGDPRIWPGRSTPESDVGAGGEEEAGSPPFSPPAGGGVPEGTGAGGLAAGGTGGGPDRLEPEMVRMVVESVERIFRSFPRGDAGEVTSLLKLNKKLARSVGHIFEMDDNDSQKEEEIRKYSIIYGRFDSKRREGKQLSLHELTINEAAAQFCMRDNTLLLRRVELFSLSRQVARESTYLSSLKGSRLHPEELGGPPLKKLKQEVGEQSHPEIQQPPPGPESYVPPYRPSLEEDSASLSGESLDGHLQAVGSCPRLTPPPADLPLALPAHGLWSRHILQQTLMDEGLRLARLVSHDRVGRLSPCVPAKPPLAEFEEGLLDRCPAPGPHPALVEGRRSSVKVEAEASRQ

SEQ ID NO: 56808 - protein, 461 aa, Homo sapiens
  Payload ID: 11166
  Gene Symbol: NAB2
  Gene Name: NGFI-A binding protein 2 (EGR1 binding protein 2)
  Uniprot ID: Q15742
  ENSP ID: ENSP00000341491
MHRAPSPTAEQPPGGGDSARRTLQPRLKPSARAMALPRTLGELQLYRVLQRANLLSYYETFIQQGGDDVQQLCEAGEEEFLEIMALVGMATKPLHVRRLQKALREWATNPGLFSQPVPAVPVSSIPLFKISETAGTRKGSMSNGHGSPGEKAGSARSFSPKSPLELGEKLSPLPGGPGAGDPRIWPGRSTPESDVGAGGEEEAGSPPFSPPAGGGVPEGTGAGGLAAGGTGGGPDRLEPEMVRMVVESVERIFRSFPRGDAGEVTSLLKLNKKLARSVGHIFEMDDNDSQKEEEIRKYSIIYGRFDSKRREGKQLSLHELTINEAAAQFCMRDNTLLLRRVELFSLSRQVARESTYLSSLKGSRLHPEELGGPPLKKLKQEVGEQSHPEIQQPPPGPESYVPPYRPSLEEDSASLSGESLDGHLQEFEEGLLDRCPAPGPHPALVEGRRSSVKVEAEASRQ

SEQ ID NO: 56809 - protein, 240 aa, Homo sapiens
  Payload ID: 11167
  Gene Symbol: NGLY1
  Gene Name: N-glycanase 1
  ENSP ID: ENSP00000280699
  MOD_RES (1)..(1): Any amino acid
XSGSASPAVAELCQNTPETFLEASKLLLTYADNILRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKDIITLRNFWKQDVDGVASGPIVLHCAAEL

SEQ ID NO: 56810 - protein, 654 aa, Homo sapiens [sequence omitted]

SEQ ID NO: 56811 - protein, 633 aa, Homo sapiens
  Payload ID: 11167
  Gene Symbol: NGLY1
  Gene Name: N-glycanase 1
  ENSP ID: ENSP00000307980
AALGSSSGSASPAVAELCQNTPETFLEASKLLLTYADNILRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKGINISDEDFLLLELLHWFKEEFFHWVNNVLCSKCGGQTRSRDRSLLPSDDELKWGAKEVEDHYCDACQFSNRFPRYNNPEKLLETRCGRCGEWANCFTLCCRAVGFEARYVWDYTELQRTLSLKLTTLKEIGKTFLRISKRQKLIQVVDVTWRYSCKHEEVIARRTKVKEALLRDTINGLNKQRQLFLSENRRKELLQRIIVELVEFISPKTPKPGELGGRISGSVAWRVARGEMGLQRKETLFIPCENEKISKQLHLCYNIVKDRYVRVSNNNQTISGWENGVWKMESIFRKVETDWHMVYLARKEGSSFAYISWKFECGSVGLKVDSISIRTSSQTFQTGTVEWKLRSDTAQVELTGDNSLHSYADFSGATEVILEAELSRGDGDVAWQHTQLFRQSLNDHEENCLEIIIKFSDL

SEQ ID NO: 56812 - protein, 558 aa, Homo sapiens
  Payload ID: 11167
  Gene Symbol: NGLY1
  Gene Name: N-glycanase 1
  Uniprot ID: Q96IV0
  ENSP ID: ENSP00000379886
MAAAALGSSSGSASPAVAELCQNTPETFLEASKLLLTYADNILRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKGINISDEDFLLLELLHWFKEEFFHWVNNVLCSKCGGQTRSRDRSLLPSDDELKWGAKEVEDHYCDACQFSNRFPRYNNPEKLLETRCGRCGEWANCFTLCCRAVGFEARYVWDYTDHVWTEVYSPSQQRWLHCDACEDVCDKPLLYEIGWGKKLSYVIAFSKDEVVDVTWRYSCKHEEVIARRTKVKEALLRDTINGLNKQRQLFLSENRRKELLQRIIVELVEFISPKTPKPGELGGRISGSVAWRVARGEMGLQRKETLFIPCENEKISKQLHLCYNIVKDRYVRVSNNNQTISGWENGVWKMESIFRKVETDWHMITVFTPMLIFLVPLKLFWKQN

SEQ ID NO: 56813 - protein, 636 aa, Homo sapiens
  Payload ID: 11167
  Gene Symbol: NGLY1
  Gene Name: N-glycanase 1
  Uniprot ID: Q96IV0
  ENSP ID: ENSP00000387430
MAAAALGSSSGSASPAVAELCQNTPETFLEASKLLLTYADNILRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKGINISDEDFLLLELLHWFKEEFFHWVNNVLCSKCGGQTRSRDRSLLPSDDELKWGAKEVEDHYCDACQFSNRFPRYNNPEKLLETRCGRCGEWANCFTLCCRAVGFEARYVWDYTELQRTLSLKLTTLKEIGKTFLRISKRQKLIQVVDVTWRYSCKHEEVIARRTKVKEALLRDTINGLNKQRQLFLSENRRKELLQRIIVELVEFISPKTPKPGELGGRISGSVAWRVARGEMGLQRKETLFIPCENEKISKQLHLCYNIVKDRYVRVSNNNQTISGWENGVWKMESIFRKVETDWHMVYLARKEGSSFAYISWKFECGSVGLKVDSISIRTSSQTFQTGTVEWKLRSDTAQVELTGDNSLHSYADFSGATEVILEAELSRGDGDVAWQHTQLFRQSLNDHEENCLEIIIKFSDL

SEQ ID NO: 56814 - protein, 612 aa, Homo sapiens
  Payload ID: 11167
  Gene Symbol: NGLY1
  Gene Name: N-glycanase 1
  Uniprot ID: Q96IV0
  ENSP ID: ENSP00000389888
MRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKGINISDEDFLLLELLHWFKEEFFHWVNNVLCSKCGGQTRSRDRSLLPSDDELKWGAKEVEDHYCDACQFSNRFPRYNNPEKLLETRCGRCGEWANCFTLCCRAVGFEARYVWDYTDHVWTEVYSPSQQRWLHCDACEDVCDKPLLYEIGWGKKLSYVIAFSKDEVVDVTWRYSCKHEEVIARRTKVKEALLRDTINGLNKQRQLFLSENRRKELLQRIIVELVEFISPKTPKPGELGGRISGSVAWRVARGEMGLQRKETLFIPCENEKISKQLHLCYNIVKDRYVRVSNNNQTISGWENGVWKMESIFRKVETDWHMVYLARKEGSSFAYISWKFECGSVGLKVDSISIRTSSQTFQTGTVEWKLRSDTAQVELTGDNSLHSYADFSGATEVILEAELSRGDGDVAWQHTQLFRQSLNDHEENCLEIIIKFSDL

SEQ ID NO: 56815 - protein, 114 aa, Homo sapiens
  Payload ID: 11167
  Gene Symbol: NGLY1
  Gene Name: N-glycanase 1
  ENSP ID: ENSP00000412946
MGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQ

SEQ ID NO: 56816 - protein, 726 aa, Homo sapiens
  Payload ID: 11168
  Gene Symbol: NHLRC2
  Gene Name: NHL repeat containing 2
  Uniprot ID: Q8NBF2
  ENSP ID: ENSP00000358307
MAAPGGRGRSLSGLLPAQTSLEYALLDAVTQQEKDSLVYQYLQKVDGWEQDLSVPEFPEGLEWLNTEEPISVYKDLCGKIVVLDFFTYCCINCIHLLPDLHALEHTYSDKDGLLIIGVHSAKFPNEKVLDNIKSAVLRYNITHPMVNDADASLWQELEVSCWPTLVILGPRGNMLFSLIGEGHKDKLFLYTSIALKYYKDRGQIRDNKIGIKLYKDSLPPSPLLFPGKVTVDQVTDRLVIADTGHHRILVVWKNGQIQYSIGGPNPGRKDGIFSESTFNSPQGVAIMNNIIYVADTENHLIRKIDLEAEKVSTVAGIGIQGTDKEGGAKGEQQPISSPWDVVFGTSGSEVQRGDILWIAMAGTHQIWALLLDSGKLPKKNELTKGTCLRFAGSGNEENRNNAYPHKAGFAQPSGLSLASEDPWSCLFVADSESSTVRTVSLKDGAVKHLVGGERDPMNLFAFGDVDGVGINAKLQHPLGVTWDKKRNLLYVADSYNHKIKVVDPKTKNCTTLAGTGDTNNVTSSSFTESTFNEPGGLCIGENGELLYVADTNNHQIKVMDLETKMVSVLPIFRSENAVVDGPFLVEKQKTLPKLPKSAPSIRLSPVTACAGQTLQFKLRLDLPSGSKLTEGVSSCWFLTAEGNEWLLQGQIAAGDIENISSQPTISLQIPDDCLSLEAIVSVSVFLYYCSADSSACMMKAILFSQPLQITDTQQGCIAPVELRYVF

SEQ ID NO: 56817 - protein, 280 aa, Homo sapiens
  Payload ID: 11169
  Gene Symbol: NHLRC3
  Gene Name: NHL repeat containing 3
  Uniprot ID: Q5JS37
  ENSP ID: ENSP00000368919
MARFWVCVAGAGFFLAFLVLHSRFCGSPVLRNFTFAVSWRTEKILYRLDVGWPKHPEYFTGTTFCVAVDSLNGLVYIGQRGDNIPKILVFTEDGYFLRAWNYTVDTPHGIFAASTLYEQSVWITDVGSDFMILWLHGENGTGPAKFNIPHSVTLDSAGRVWVADRGNKRIQVFDKDTGEWLGAWNNCFTEEGPSSVRFTPDGKYLIVAQLNLSRLSVVAAPPVGSIGECSVISTIQLADQVLPHLLEVDRKTGAVYVAEIGAKQVQKYVPLNSYVPSFGS

SEQ ID NO: 56818 - protein, 347 aa, Homo sapiens
  Payload ID: 11169
  Gene Symbol: NHLRC3
  Gene Name: NHL repeat containing 3
  Uniprot ID: Q5JS37
  ENSP ID: ENSP00000368920
MARFWVCVAGAGFFLAFLVLHSRFCGSPVLRNFTFAVSWRTEKILYRLDVGWPKHPEYFTGTTFCVAVDSLNGLVYIGQRGDNIPKILVFTEDGYFLRAWNYTVDTPHGIFAASTLYEQSVWITDVGSGFFGHTVKKYSSFGDLVQVLGTPGKKGTSLNPLQFDNPAELYVEDTGDIYIVDGDGGLNNRLIKLSQDFMILWLHGENGTGPAKFNIPHSVTLDSAGRVWVADRGNKRIQVFDKDTGEWLGAWNNCFTEEGPSSVRFTPDGKYLIVAQLNLSRLSVVAAPPVGSIGECSVISTIQLADQVLPHLLEVDRKTGAVYVAEIGAKQVQKYVPLNSYVPSFGS

SEQ ID NO: 56819 - protein, 150 aa, Homo sapiens
  Payload ID: 11169
  Gene Symbol: NHLRC3
  Gene Name: NHL repeat containing 3
  ENSP ID: ENSP00000418127
MILWLHGENGTGPAKFNIPHSVTLDSAGRVWVADRGNKRIQVFDKDTGEWLGAWNNCFTEEGPSSVRFTPDGKYLIVAQLNLSRLSVVAAPPVGSIGECSVISTIQLADQVLPHLLEVDRKTGAVYVAEIGAKQVQKYVPLNSYVPSFGS

SEQ ID NO: 56820 - protein, 153 aa, Homo sapiens
  Payload ID: 11169
  Gene Symbol: NHLRC3
  Gene Name: NHL repeat containing 3
  ENSP ID: ENSP00000484853
MARFWVCVAGAGFFLAFLVLHSRFCGSPVLRNFTFAVSWRTEKILYRLDVGWPKHPEYFTGTTFCVAVDSLNGLVYIGQRGDNIPKILVFTEDGYFLRAWNYTVDTPHGIFAASTLYEQSVWITDVGSDFMILWLHGENGTGPAKFNIPHSVT

SEQ ID NO: 56821 - protein, 123 aa, Homo sapiens
  Payload ID: 11170
  Gene Symbol: NHLRC4
  Gene Name: NHL repeat containing 4
  Uniprot ID: P0CG21
  ENSP ID: ENSP00000410858
MLGLEGPCWVGPGPDGGLAVSEEFGDVRLFGSARQPLGSLGGWTGHTFGCPAGICSNSEGNVIVADEQRRQVTLFPRAGPPICLVSEGLGQPLGVACAPQGQLLVADAKDNSIKVYQGLKELA

SEQ ID NO: 56822 - protein, 123 aa, Homo sapiens; identical to SEQ ID NO: 56821
  Payload ID: 11170
  Gene Symbol: NHLRC4
  Gene Name: NHL repeat containing 4
  Uniprot ID: P0CG21
  ENSP ID: ENSP00000442223

SEQ ID NO: 56823 - protein, 395 aa, Homo sapiens
  Payload ID: 11171
  Gene Symbol: NHLRC1
  Gene Name: NHL repeat containing E3 ubiquitin protein ligase 1
  Uniprot ID: Q6VVB1
  ENSP ID: ENSP00000345464
MAAEASESGPALHELMREAEISLLECKVCFEKFGHRQQRRPRNLSCGHVVCLACVAALAHPRTLALECPFCRRACRGCDTSDCLPVLHLIELLGSALRQSPAAHRAAPSAPGALTCHHTFGGWGTLVNPTGLALCPKTGRVVVVHDGRRRVKIFDSGGGCAHQFGEKGDAAQDIRYPVDVTITNDCHVVVTDAGDRSIKVFDFFGQIKLVIGGQFSLPWGVETTPQNGIVVTDAEAGSLHLLDVDFAEGVLRRTERLQAHLCNPRGVAVSWLTGAIAVLEHPLALGTGVCSTRVKVFSSSMQLVGQVDTFGLSLYFPSKITASAVTFDHQGNVIVADTSGPAILCLGKPEEFPVPKPMVTHGLSHPVALTFTKENSLLVLDTASHSIKVYKVDWG

SEQ ID NO: 56824 - protein, 153 aa, Homo sapiens
  Payload ID: 11172
  Gene Symbol: NHP2
  Gene Name: NHP2 ribonucleoprotein
  Uniprot ID: Q9NX24
  ENSP ID: ENSP00000274606
MTKIKADPDGPEAQAEACSGERTYQELLVNQNPIAQPLASRRLTRKLYKCIKKAVKQKQIRRGVKEVQKFVNKGEKGIMVLAGDTLPIEVYCHLPVMCEDRNLPYVYIPSKTDLGAAAGSKRPTCVIMVKPHEEYQEAYDECLEEVQSLPLPL

SEQ ID NO: 56825 - protein, 90 aa, Homo sapiens
  Payload ID: 11172
  Gene Symbol: NHP2
  Gene Name: NHP2 ribonucleoprotein
  ENSP ID: ENSP00000366276
MTKIKADPDGPEAQAEACSGERTYQELLVNQNPIAQPLASRRLTRKLYKCIKKAVKQKQIRRGVKEVQKFVNKGEKGTWVQPQAPSAPPV

SEQ ID NO: 56826 - protein, 135 aa, Homo sapiens
  Payload ID: 11172
  Gene Symbol: NHP2
  Gene Name: NHP2 ribonucleoprotein
  ENSP ID: ENSP00000423803
MTKIKADPDGPEAQAEACSGERTYQELLVNQNPIAQPLASRRLTRKLYKCIKKAVKQKQIRRGVKEVQKFVNKGEKGIMVLAGDTLPIEVYCHLPVMCEDRNLPYVYIPSKTFPSCKVGIPAQALWLTPVILVLW

SEQ ID NO: 56827 - protein, 132 aa, Homo sapiens
  Payload ID: 11172
  Gene Symbol: NHP2
  Gene Name: NHP2 ribonucleoprotein
  ENSP ID: ENSP00000423849
MTKIKADPDGPEAQAEACSGERTYQELLVNQNPIAQPLASRRLTRKLYKCIKKAVKQKQIRRGVKEVQKFVNKGEKGIMVLAGDTLPIEVYCHLPVMCEDRNLPYVYIPSKTVRSTWPPDLAQHWGVWDSLP

SEQ ID NO: 56828 - protein, 85 aa, Homo sapiens
  Payload ID: 11172
  Gene Symbol: NHP2
  Gene Name: NHP2 ribonucleoprotein
  ENSP ID: ENSP00000431126
DSSVVAAVKQKQIRRGVKEVQKFVNKGEKGIMVLAGDTLPIEVYCHLPVMCEDRNLPYVYIPSKTVRSTWPPDLAQHWGVWDSLP

SEQ ID NO: 56829 - protein, 221 aa, Homo sapiens
  Payload ID: 11173
  Gene Symbol: NHSL1
  Gene Name: NHS-like 1
  ENSP ID: ENSP00000344582
MFCLKAVSNLDEESRWTVHYTAPWHQQENVFLPTTRPPCVEDLHRQAKLNLKSVLRECDKLRHDGYRSSQYYSQGPTFAANASPFCDDYQDEDEETDQKCSLSSSEEERFISIRRPKTPASSDFSDLNTQTNWTKSLPLPTPEEKMRQQAQTVQADVVPINITASGTGQDDADGHSVYTPDHYSTLGRFNSCRSAGQRSETRDSSCQTEDVKVVPPSMRRI

SEQ ID NO: 56830 - protein, 1606 aa, Homo sapiens
  Payload ID: 11173
  Gene Symbol: NHSL1
  Gene Name: NHS-like 1
  Uniprot ID: Q5SYE7
  ENSP ID: ENSP00000344672
MVVFINAKIKSLIKLFKKKTVSNLDEESRWTVHYTAPWHQQENVFLPTTRPPCVEDLHRQAKLNLKSVLRECDKLRHDGYRSSQYYSQGPTFAANASPFCDDYQDEDEETDQKCSLSSSEEERFISIRRPKTPASSDFSDLNTQTNWTKSLPLPTPEEKMRQQAQTVQADVVPINITGENFDRQASLRRSLIYTDTLVRRPKKVKRRKTITGVPDNIQKELASGTGQDDADGHSVYTPDHYSTLGRFNSCRSAGQRSETRDSSCQTEDVKVVPPSMRRIRAQKGQGIAAQMGHFSGSSGNMSVLSDSAGIVFPSRLDSDAGFHSLPRSGARANIQSLEPRLGALGPAGDMNGTFLYQRGHPQADENLGHLGGASGTGTLLRPKSQELRHFESENIMSPACVVSPHATYSTSIIPNATLSSSSEVIAIPTAQSAGQRESKSSGSSHARIKSRDHLISRHAVKGDPQSPGRHWNEGHATILSQDLDPHSPGEPALLSLCDSAVPLNAPANRENGSQAMPYNCRNNLAFPAHPQDVDGKSESSYSGGGGHSSSEPWEYKSSGNGRASPLKPHLATPGYSTPTSNMSSCSLDQTSNKEDAGSLYSEDHDGYCASVHTDSGHGSGNLCNSSDGFGNPRHSVINVFVGRAQKNQGDRSNYQDKSLSRNISLKKAKKPPLPPSRTDSLRRIPKKSSQCNGQVLNESLIATLQHSLQLSLPGKSGSSPSQSPCSDLEEPWLPRSRSQSTVSAGSSMTSATTPNVYSLCGATPSQSDTSSVKSEYTDPWGYYIDYTGMQEDPGNPAGGCSTSSGVPTGNGPVRHVQEGSRATMPQVPGGSVKPKIMSPEKSHRVISPSSGYSSQSNTPTALTPVPVFLKSVSPANGKGKPKPKVPERKSSLISSVSISSSSTSLSSSTSTEGSGTMKKLDPAVGSPPAPPPPPVPSPPFPCPADRSPFLPPPPPVTDCSQGSPLPHSPVFPPPPPEALIPFCSPPDWCLSPPRPALSPILPDSPVSLPLPPPLLPSSEPPPAPPLDPKFMKDTRPPFTNSGQPESSRGSLRPPSTKEETSRPPMPLITTEALQMVQLRPVRKNSGAEAAQLSERTAQEQRTPVAPQYHLKPSAFLKSRNSTNEMESESQPASVTSSLPTPAKSSSQGDHGSAAERGGPVSRSPGAPSAGEAEARPSPSTTPLPDSSPSRKPPPISKKPKLFLVVPPPQKDFAVEPAENVSEALRAVPSPTTGEEGSVHSREAKESSAAQAGSHATHPGTSVLEGGAAGSMSPSRVEANVPMVQPDVSPAPKQEEPAENSADTGGDGESCLSQQDGAAGVPETNAAGSSSEACDFLKEDGNDEVMTPSRPRTTEDLFAAIHRSKRKVLGRRDSDDDHSRNHSPSPPVTPTGAAPSLASPKQVGSIQRSIRKSSTSSDNFKALLLKKGSRSDTSARMSAAEMLKNTDPRFQRSRSEPSPDAPESPSSCSPSKNRRAQEEWAKNEGLMPRSLSFSGPRYGRSRTPPSAASSRYSMRNRIQSSPMTVISEGEGEAVEPVDSIARGALGAAEGCSLDGLAREEMDEGGLLCGEGPAASLQPQAPGPVDGTASAEGREPSPQCGGSLSEES

SEQ ID NO: 56831 - protein, 1610 aa, Homo sapiens
  Payload ID: 11173
  Gene Symbol: NHSL1
  Gene Name: NHS-like 1
  Uniprot ID: Q5SYE7
  ENSP ID: ENSP00000394546
MKKEGSSGSFRLQPNTGSLSRAVSWINFSSLSRQTKRLFRSDGELSVCGQQVEVDDENWIYRAQPRKAVSNLDEESRWTVHYTAPWHQQENVFLPTTRPPCVEDLHRQAKLNLKSVLRECDKLRHDGYRSSQYYSQGPTFAANASPFCDDYQDEDEETDQKCSLSSSEEERFISIRRPKTPASSDFSDLNTQTNWTKSLPLPTPEEKMRQQAQTVQADVVPINITASGTGQDDADGHSVYTPDHYSTLGRFNSCRSAGQRSETRDSSCQTEDVKVVPPSMRRIRAQKGQGIAAQMGHFSGSSGNMSVLSDSAGIVFPSRLDSDAGFHSLPRSGARANIQSLEPRLGALGPAGDMNGTFLYQRGHPQADENLGHLGGASGTGTLLRPKSQELRHFESENIMSPACVVSPHATYSTSIIPNATLSSSSEVIAIPTAQSAGQRESKSSGSSHARIKSRDHLISRHAVKGDPQSPGRHWNEGHATILSQDLDPHSPGEPALLSLCDSAVPLNAPANRENGSQAMPYNCRNNLAFPAHPQDVDGKSESSYSGGGGHSSSEPWEYKSSGNGRASPLKPHLATPGYSTPTSNMSSCSLDQTSNKEDAGSLYSEDHDGYCASVHTDSGHGSGNLCNSSDGFGNPRHSVINVFVGRAQKNQGDRSNYQDKSLSRNISLKKAKKPPLPPSRTDSLRRIPKKSSQCNGQVLNESLIATLQHSLQLSLPGKSGSSPSQSPCSDLEEPWLPRSRSQSTVSAGSSMTSATTPNVYSLCGATPSQSDTSSVKSEYTDPWGYYIDYTGMQEDPGNPAGGCSTSSGVPTGNGPVRHVQEGSRATMPQVPGGSVKPKIMSPEKSHRVISPSSGYSSQSNTPTALTPVPVFLKSVSPANGKGKPKPKVPERKSSLISSVSISSSSTSLSSSTSTEGSGTMKKLDPAVGSPPAPPPPPVPSPPFPCPADRSPFLPPPPPVTDCSQGSPLPHSPVFPPPPPEALIPFCSPPDWCLSPPRPALSPILPDSPVSLPLPPPLLPSSEPPPAPPLDPKFMKDTRPPFTNSGQPESSRGSLRPPSTKEETSRPPMPLITTEALQMVQLRPVRKNSGAEAAQLSERTAQEQRTPVAPQYHLKPSAFLKSRNSTNEMESESQPASVTSSLPTPAKSSSQGDHGSAAERGGPVSRSPGAPSAGEAEARPSPSTTPLPDSSPSRKPPPISKKPKLFLVVPPPQKDFAVEPAENVSEALRAVPSPTTGEEGSVHSREAKESSAAQAGSHATHPGTSVLEGGAAGSMSPSRVEANVPMVQPDVSPAPKQEEPAENSADTGGDGESCLSQQDGAAGVPETNAAGSSSEACDFLKEDGNDEVMTPSRPRTTEDLFAAIHRSKRKVLGRRDSDDDHSRNHSPSPPVTPTGAAPSLASPKQVGSIQRSIRKSSTSSDNFKALLLKKGSRSDTSARMSAAEMLKNTDPRFQRSRSEPSPDAPESPSSCSPSKNRRAQEEWAKNEGLMPRSLSFSGPRYGRSRTPPSAASSRYSMRNRIQSSPMTVISEGEGEAVEPVDSIARGALGAAEGCSLDGLAREEMDEGGLLCGEGPAASLQPQAPGPVDGTASAEGREPSPQCGGSLSEES

SEQ ID NO: 56832 - protein, 169 aa, Homo sapiens
  Payload ID: 11173
  Gene Symbol: NHSL1
  Gene Name: NHS-like 1
  ENSP ID: ENSP00000433523
  MOD_RES (1)..(1): Any amino acid
XAALGHRTAALHRRLDALQAAAARLDHRRVKIPVSNLDEESRWTVHYTAPWHQQENVFLPTTRPPCVEDLHRQAKLNLKSVLRECDKLRHDGYRSSQYYSQGPTFAANASPFCDDYQDEDEETDQKCSLSSSEEERFISIRRPKTPASSDFSDLNTQTNWTKSLPLPTP

SEQ ID NO: 56833 - protein, 137 aa, Homo sapiens
  Payload ID: 11173
  Gene Symbol: NHSL1
  Gene Name: NHS-like 1
  ENSP ID: ENSP00000434958
MNVIYCLESVTDSSFPWGAVAVSNLDEESRWTVHYTAPWHQQENVFLPTTRPPCVEDLHRQAKLNLKSVLRECDKLRHDGYRSSQYYSQGPTFAANASPFCDDYQDEDEETDQKCSLSSSEEERFISIRRPKTPASS

SEQ ID NO: 56834 - protein, 709 aa, Homo sapiens
  Payload ID: 11174
  Gene Symbol: NHSL2
  Gene Name: NHS-like 2
  Uniprot ID: Q5HYW2
  ENSP ID: ENSP00000424079
MESMGMVYSVPSSCNGPTESTFSTSWKGDAFTYMTPSATSQSNQVNENGKNPSCGNSWVSLNKVPPLVPKEAATLLVARDNPAGCSGSAGYPERLIQQRHMPERPSKIGLLTSGTSRLETGPGGASRFRERSLSVPTDSGTTDVDYDEEQKANEACALPFASTSSEGSNSADNIASLSAQQEAQHRRQRSKSISLRKAKKKPSPPTRSVSLVKDEPGLLPEGGSALPKDQRPKSLCLSLEHQGHHSSHPDAQGHPAIPNHKDPESTQFSHHWYLTDWKSGDTYQSLSSSSTATGTTVIECTQVQGSSESLASPSTSRATTPSQLSIEVEAREISSPGRPPGLMSPSSGYSSQSETPTPTVSMSLTLGHLPPPSSSVRVRPVVPERKSSLPPTSPMEKFPKSRLSFDLPLTSSPNLDLSGMSISIRSKTKVSRHHSETNFGVKLAQKTNPNQPIMPMVTQSDLRSVRLRSVSKSEPEDDIESPEYAEEPRAEEVFTLPERKTKPPVAEKPPVARRPPSLVHKPPSVPEEYALTSPTLAMPPRSSIQHARPLPQDSYTVVRKPKPSSFPDGRSPGESTAPSSLVFTPFASSSDAFFSGTQQPPQGSVEDEGPKVRVLPERISLQSQEEAEKKKGKIPPPVPKKPSVLYLPLTSPTAQMEAYVAEPRLPLSPIITLEEDTKCPATGDDLQSLGQRVTSTPQADSEREASPLG

SEQ ID NO: 56835 - protein, 835 aa, Homo sapiens
  Payload ID: 11174
  Gene Symbol: NHSL2
  Gene Name: NHS-like 2
  ENSP ID: ENSP00000487835
MERTDSVTLFWIRGGHSNSPAGSVAHSTTSDIRPSHSVPEGVHGRVAVGQDARFPSLTSPVLRTPSSEPDEPHQARSGPNPPGMESMGMVYSVPSSCNGPTESTFSTSWKGDAFTYMTPSATSQSNQVNENGKNPSCGNSWVSLNKVPPLVPKEAATLLVARDNPAGCSGSAGYPERLIQQRHMPERPSKIGLLTSGTSRLETGPGGASRFRERSLSVPTDSGTTDVDYDEEQKANEACALPFASTSSEGSNSADNIASLSAQQEAQHRRQRSKSISLRKAKKKPSPPTRSVSLVKDEPGLLPEGGSALPKDQRPKSLCLSLEHQGHHSSHPDAQGHPAIPNHKDPESTQFSHHWYLTDWKSGDTYQSLSSSSTATGTTVIECTQVQGSSESLASPSTSRATTPSQLSIEVEAREISSPGRPPGLMSPSSGYSSQSETPTPTVSMSLTLGHLPPPSSSVRVRPVVPERKSSLPPTSPMEKFPKSRLSFDLPLTSSPNLDLSGMSISIRSKTKVSRHHSETNFGVKLAQKTNPNQPIMPMVTQSDLRSVRLRSVSKSEPEDDIESPEYAEEPRAEEVFTLPERKTKPPVAEKPPVARRPPSLVHKPPSVPEEYALTSPTLAMPPRSSIQHARPLPQDSYTVVRKPKPSSFPDGRSPGESTAPSSLVFTPFASSSDAFFSGTQQPPQGSVEDEGPKVRVLPERISLQSQEEAEKKKGKIPPPVPKKPSVLYLPLTSPTAQMEAYVAEPRLPLSPIITLEEDTKCPATGDDLQSLGQRVTSTPQADSEREASPLGSSVEPGTEEKSLISDKTAEWIAEDDDDVFVASRTTEDLFTVIH

SEQ ID NO: 56836 - protein, 1225 aa, Homo sapiens
  Payload ID: 11174
  Gene Symbol: NHSL2
  Gene Name: NHS-like 2
  ENSP ID: ENSP00000488668
MPFYRRTVVPQRLCPRNPPQQLAELRDVSHLAALSLLRQLADLCGHSLALLEDLEGHLLALGRRTDSLYRRTVRLRRRLPCRLLGPEEDEEELAAANSGRENATATAHSRSSWRQPVNVFLSSGRPPSVEELLREAQLNLQSLLQEEYEEQYSEARLVGQTFRSSDEATKPTPNPRPQSARRLEFILMPTKRQLSEDETTTQGVRAPEASLSLSTTADKQTAWNSLFPLPILEEKRWPQLCSTQSDIVPINISGQQFDKHASLRHSLFNTETAVNPKSTLRRRRTIIGFSNFSQRDQGHSNSPAGSVAHSTTSDIRPSHSVPEGVHGRVAVGQDARFPSLTSPVLRTPSSEPDEPHQARSGPNPPGMESMGMVYSVPSSCNGPTESTFSTSWKGDAFTYMTPSATSQSNQVNENGKNPSCGNSWVSLNKVPPLVPKEAATLLVARDNPAGCSGSAGYPERLIQQRHMPERPSKIGLLTSGTSRLETGPGGASRFRERSLSVPTDSGTTDVDYDEEQKANEACALPFASTSSEGSNSADNIASLSAQQEAQHRRQRSKSISLRKAKKKPSPPTRSVSLVKDEPGLLPEGGSALPKDQRPKSLCLSLEHQGHHSSHPDAQGHPAIPNHKDPESTQFSHHWYLTDWKSGDTYQSLSSSSTATGTTVIECTQVQGSSESLASPSTSRATTPSQLSIEVEAREISSPGRPPGLMSPSSGYSSQSETPTPTVSMSLTLGHLPPPSSSVRVRPVVPERKSSLPPTSPMEKFPKSRLSFDLPLTSSPNLDLSGMSISIRSKTKVSRHHSETNFGVKLAQKTNPNQPIMPMVTQSDLRSVRLRSVSKSEPEDDIESPEYAEEPRAEEVFTLPERKTKPPVAEKPPVARRPPSLVHKPPSVPEEYALTSPTLAMPPRSSIQHARPLPQDSYTVVRKPKPSSFPDGRSPGESTAPSSLVFTPFASSSDAFFSGTQQPPQGSVEDEGPKVRVLPERISLQSQEEAEKKKGKIPPPVPKKPSVLYLPLTSPTAQMEAYVAEPRLPLSPIITLEEDTKCPATGDDLQSLGQRVTSTPQADSEREASPLGSSVEPGTEEKSLISDKTAEWIAEDDDDVFVASRTTEDLFTVIHRSKRKLLGWKEPGEAFVGGRTSSHSPIKNTAESPISESTATAGSGSSANLDAGRNDDFKALLQKKGSKATPRSRPSAAELLKTTNPLARRIIAQFSKDYETTDNPST

SEQ ID NO: 56837 - protein, 950 aa, Homo sapiens
  Payload ID: 11174
  Gene Symbol: NHSL2
  Gene Name: NHS-like 2
  ENSP ID: ENSP00000488715
MMGNSHHKQPRSKSQSRMHSATGHSNSPAGSVAHSTTSDIRPSHSVPEGVHGRVAVGQDARFPSLTSPVLRTPSSEPDEPHQARSGPNPPGMESMGMVYSVPSSCNGPTESTFSTSWKGDAFTYMTPSATSQSNQVNENGKNPSCGNSWVSLNKVPPLVPKEAATLLVARDNPAGCSGSAGYPERLIQQRHMPERPSKIGLLTSGTSRLETGPGGASRFRERSLSVPTDSGTTDVDYDEEQKANEACALPFASTSSEGSNSADNIASLSAQQEAQHRRQRSKSISLRKAKKKPSPPTRSVSLVKDEPGLLPEGGSALPKDQRPKSLCLSLEHQGHHSSHPDAQGHPAIPNHKDPESTQFSHHWYLTDWKSGDTYQSLSSSSTATGTTVIECTQVQGSSESLASPSTSRATTPSQLSIEVEAREISSPGRPPGLMSPSSGYSSQSETPTPTVSMSLTLGHLPPPSSSVRVRPVVPERKSSLPPTSPMEKFPKSRLSFDLPLTSSPNLDLSGMSISIRSKTKVSRHHSETNFGVKLAQKTNPNQPIMPMVTQSDLRSVRLRSVSKSEPEDDIESPEYAEEPRAEEVFTLPERKTKPPVAEKPPVARRPPSLVHKPPSVPEEYALTSPTLAMPPRSSIQHARPLPQDSYTVVRKPKPSSFPDGRSPGESTAPSSLVFTPFASSSDAFFSGTQQPPQGSVEDEGPKVRVLPERISLQSQEEAEKKKGKIPPPVPKKPSVLYLPLTSPTAQMEAYVAEPRLPLSPIITLEEDTKCPATGDDLQSLGQRVTSTPQADSEREASPLGSSVEPGTEEKSLISDKTAEWIAEDDDDVFVASRTTEDLFTVIHRSKRKLLGWKEPGEAFVGGRTSSHSPIKNTAESPISESTATAGSGSSANLDAGRNDDFKALLQKKGSKATPRSRPSAAELLKTTNPLARRIIAQFSKDYETTDNPST

SEQ ID NO: 56838 - protein, 754 aa, Homo sapiens
  Payload ID: 11175
  Gene Symbol: NBN
  Gene Name: nibrin
  Uniprot ID: O60934
  ENSP ID: ENSP00000265433
MWKLLPAAGPAGGEPYRLLTGVEYVVGRKNCAILIENDQSISRNHAVLTANFSVTNLSQTDEIPVLTLKDNSKYGTFVNEEKMQNGFSRTLKSGDGITFGVFGSKFRIEYEPLVACSSCLDVSGKTALNQAILQLGGFTVNNWTEECTHLVMVSVKVTIKTICALICGRPIVKPEYFTEFLKAVESKKQPPQIESFYPPLDEPSIGSKNVDLSGRQERKQIFKGKTFIFLNAKQHKKLSSAVVFGGGEARLITEENEEEHNFFLAPGTCVVDTGITNSQTLIPDCQKKWIQSIMDMLQRQGLRPIPEAEIGLAVIFMTTKNYCDPQGHPSTGLKTTTPGPSLSQGVSVDEKLMPSAPVNTTTYVADTESEQADTWDLSERPKEIKVSKMEQKFRMLSQDAPTVKESCKTSSNNNSMVSNTLAKMRIPNYQLSPTKLPSINKSKDRASQQQQTNSIRNYFQPSTKKRERDEENQEMSSCKSARIETSCSLLEQTQPATPSLWKNKEQHLSENEPVDTNSDNNLFTDTDLKSIVKNSASKSHAAEKLRSNKKREMDDVAIEDEVLEQLFKDTKPELEIDVKVQKQEEDVNVRKRPRMDIETNDTFSDEAVPESSKISQENEIGKKRELKEDSLWSAKEISNNDKLQDDSEMLPKKLLLTEFRSLVIKNSTSRNPSGINDDYGQLKNFKKFKKVTYPGAGKLPHIIGGSDLIAHHARKNTELEEWLRQEMEVQNQHAKEESLADDLFRYNPYLKRRR

SEQ ID NO: 56839 - protein, 58 aa, Homo sapiens
  Payload ID: 11175
  Gene Symbol: NBN
  Gene Name: nibrin
  ENSP ID: ENSP00000379551
MWKLLPAAGPAGGEPYRLLTGVEYVVGRKNCAILIENDQSISRNHAVLTANFSVTNLV

SEQ ID NO: 56840 - protein, 672 aa, Homo sapiens
  Payload ID: 11175
  Gene Symbol: NBN
  Gene Name: nibrin
  ENSP ID: ENSP00000386924
MQNGFSRTLKSGDGITFGVFGSKFRIEYEPLVACSSCLDVSGKTALNQAILQLGGFTVNNWTEECTHLVMVSVKVTIKTICALICGRPIVKPEYFTEFLKAVESKKQPPQIESFYPPLDEPSIGSKNVDLSGRQERKQIFKGKTFIFLNAKQHKKLSSAVVFGGGEARLITEENEEEHNFFLAPGTCVVDTGITNSQTLIPDCQKKWIQSIMDMLQRQGLRPIPEAEIGLAVIFMTTKNYCDPQGHPSTGLKTTTPGPSLSQGVSVDEKLMPSAPVNTTTYVADTESEQADTWDLSERPKEIKVSKMEQKFRMLSQDAPTVKESCKTSSNNNSMVSNTLAKMRIPNYQLSPTKLPSINKSKDRASQQQQTNSIRNYFQPSTKKRERDEENQEMSSCKSARIETSCSLLEQTQPATPSLWKNKEQHLSENEPVDTNSDNNLFTDTDLKSIVKNSASKSHAAEKLRSNKKREMDDVAIEDEVLEQLFKDTKPELEIDVKVQKQEEDVNVRKRPRMDIETNDTFSDEAVPESSKISQENEIGKKRELKEDSLWSAKEISNNDKLQDDSEMLPKKLLLTEFRSLVIKNSTSRNPSGINDDYGQLKNFKKFKKVTYPGAGKLPHIIGGSDLIAHHARKNTELEEWLRQEMEVQNQHAKEESLADDLFRYNPYLKRRR

SEQ ID NO: 56841 - protein, 58 aa, Homo sapiens; identical to SEQ ID NO: 56839
  Payload ID: 11175
  Gene Symbol: NBN
  Gene Name: nibrin
  ENSP ID: ENSP00000428252

SEQ ID NO: 56842 - protein, 164 aa, Homo sapiens
  Payload ID: 11175
  Gene Symbol: NBN
  Gene Name: nibrin
  ENSP ID: ENSP00000428717
MQNGFSRTLKSGDGITFGVFGSKFRIEYEPLVACSSCLDVSGKTALNQAILQLGGFTVNNWTEECTHLVMVSVKVTIKTICALICGRPIVKPEYFTEFLKAVESKKQPPQIESFYPPLDEPSIGSKNVDLSGRQERKQIFKGKTFIFLNAKQHKKLSSAVVFGG

SEQ ID NO: 56843 - protein, 92 aa, Homo sapiens
  Payload ID: 11175
  Gene Symbol: NBN
  Gene Name: nibrin
  ENSP ID: ENSP00000429971
MQNGFSRTLKSGDGITFGVFGSKFRIEYEPLVACSSCLDVSGKTALNQAILQLGGFTVNNWTEECTHLVMVSVKVTIKTICALICGRPIVKP

SEQ ID NO: 56844 - protein, 159 aa, Homo sapiens
  Payload ID: 11175
  Gene Symbol: NBN
  Gene Name: nibrin
  ENSP ID: ENSP00000430983
MWKLLPAAGPAGGEPYRLLTGVEYVVGRKNCAILIENDQSISRNHAVLTANFSVTNLSQTDEIPVLTLKDNSKYGTFVNEEKMQNGFSRTLKSGDGITFGVFGSKFSFYPPLDEPSIGSKNVDLSGRQERKQIFKGKTFIFLNAKQHKKLSSAVVFGGG

SEQ ID NO: 56845 - protein, 124 aa, Homo sapiens
  Payload ID: 11175
  Gene Symbol: NBN
  Gene Name: nibrin
  ENSP ID: ENSP00000484487
KVQKQEEDVNVRKRPRMDIETNDTFSDEAVPESSKISQENEIGKKRELKEDSLWSAKEISVTYPGAGKLPHIIGGSDLIAHHARKNTELEEWLRQEMEVQNQHAKEESLADDLFRYNPYLKRRR

SEQ ID NO: 56846 - protein, 563 aa, Homo sapiens
  Payload ID: 11176
  Gene Symbol: NCLN
  Gene Name: nicalin
  Uniprot ID: Q969V3
  ENSP ID: ENSP00000246117
MLEEAGEVLENMLKASCLPLGFIVFLPAVLLLVAPPLPAADAAHEFTVYRMQQYDLQGQPYGTRNAVLNTEARTMAAEVLSRRCVLMRLLDFSYEQYQKALRQSAGAVVIILPRAMAAVPQDVVRQFMEIEPEMLAMETAVPVYFAVEDEALLSIYKQTQAASASQGSASAAEVLLRTATANGFQMVTSGVQSKAVSDWLIASVEGRLTGLGGEDLPTIVIVAHYDAFGVAPWLSLGADSNGSGVSVLLELARLFSRLYTYKRTHAAYNLLFFASGGGKFNYQGTKRWLEDNLDHTDSSLLQDNVAFVLCLDTVGRGSSLHLHVSKPPREGTLQHAFLRELETVAAHQFPEVRFSMVHKRINLAEDVLAWEHERFAIRRLPAFTLSHLESHRDGQRSSIMDVRSRVDSKTLTRNTRIIAEALTRVIYNLTEKGTPPDMPVFTEQMQIQQEQLDSVMDWLTNQPRAAQLVDKDSTFLSTLEHHLSRYLKDVKQHHVKADKRDPEFVFYDQLKQVMNAYRVKPAVFDLLLAVGIAAYLGMAYVAVQHFSLLYKTVQRLLVKAKTQ

SEQ ID NO: 56847 - protein, 282 aa, Homo sapiens
  Payload ID: 11176
  Gene Symbol: NCLN
  Gene Name: nicalin
  ENSP ID: ENSP00000466296
  MOD_RES (1)..(1): Any amino acid
XYQGTKRWLEDNLDHTDSSLLQDNVAFVLCLDTVGRGSSLHLHVSKPPREGTLQHAFLRELETVAAHQFPEVRFSMVHKRINLAEDVLAWEHERFAIRRLPAFTLSHLESHRDGQRSSIMDVRSRVDSKTLTRNTRIIAEALTRVIYNLTEKGTPPDMPVFTEQMIQQEQLDSVMDWLTNQPRAAQLVDKDSTFLSTLEHHLSRYLKDVKQHHVKADKRDPEFVFYDQLKQVMNAYRVKPAVFDLLLAVGIAAYLGMAYVAVQHFSLLYKTVQRLLVKAKTQ

SEQ ID NO: 56848 - protein, 350 aa, Homo sapiens
  Payload ID: 11176
  Gene Symbol: NCLN
  Gene Name: nicalin
  ENSP ID: ENSP00000466300
EDLPTIVIVAHYDAFGVAPWLSLGADSNGSGVSVLLELARLFSRLYTYKRTHAAYNLLFFASGGGKFNYQGTKRWLEDNLDHTDSSLLQDNVAFVLCLDTVGRGSSLHLHVSKPPREGTLQHAFLRELETVAAHQFPEVRFSMVHKRINLAEDVLAWEHERFAIRRLPAFTLSHLESHRDGQRSSIMDVRSRVDSKTLTRNTRIIAEALTRVIYNLTEKGTPPDMPVFTEQMQIQQEQLDSVMDWLTNQPRAAQLVDKDSTFLSTLEHHLSRYLKDVKQHHVKADKRDPEFVFYDQLKQVMNAYRVKPAVFDLLLAVGIAAYLGMAYVAVQHFSLLYKTVQRLLVKAKTQ

SEQ ID NO: 56849 - protein, 489 aa, Homo sapiens
  Payload ID: 11176
  Gene Symbol: NCLN
  Gene Name: nicalin
  ENSP ID: ENSP00000466678
MAAEVLSRRCVLMRLLDFSYEQYQKALRQSAGAVVIILPRAMAAVPQDVVRQFMEIEPEMLAMETAVPVYFAVEDEALLSIYKQTQAASASQGSASAAEVLLRTATANGFQMVTSGVQSKAVSDWLIASVEGRLTGLGGEDLPTIVIVAHYDAFGVAPWLSLGADSNGSGVSVLLELARLFSRLYTYKRTHAAYNLLFFASGGGKFNYQGTKRWLEDNLDHTDSSLLQDNVAFVLCLDTVGRGSSLHLHVSKPPREGTLQHAFLRELETVAAHQFPEVRFSMVHKRINLAEDVLAWEHERFAIRRLPAFTLSHLESHRDGQRSSIMDVRSRVDSKTLTRNTRIIAEALTRVIYNLTEKGTPPDMPVFTEQMQIQQEQLDSVMDWLTNQPRAAQLVDKDSTFLSTLEHHLSRYLKDVKQHHVKADKRDPEFVFYDQLKQVMNAYRVKPAVFDLLLAVGIAAYLGMAYVAVQHFSLLYKTVQRLLVKAKTQ

SEQ ID NO: 56850 - protein, 72 aa, Homo sapiens
  Payload ID: 11176
  Gene Symbol: NCLN
  Gene Name: nicalin
  ENSP ID: ENSP00000466844
  MOD_RES (1)..(1): Any amino acid
XRDPEFVFYDQLKQVMNAYRVKPAVFDLLLAVGIAAYLGMAYVAVQVSSAQAQHFSLLYKTVQRLLVKAKTQ

SEQ ID NO: 56851 - protein, 328 aa, Homo sapiens
  Payload ID: 11176
  Gene Symbol: NCLN
  Gene Name: nicalin
  ENSP ID: ENSP00000467011
MLEEAGEVLENMLKASCLPLGFIVFLPAVLLLVAPPLPAADAAHEFTVYRMQQYDLQGQPYVLLRTATANGFQMVTSGVQSKAVSDWLIASVEGRLTGLGGEDLPTIVIVAHYDAFGVAPWLSLGADSNGSGVSVLLELARLFSRLYTYKRTHAAYNLLFFASGGGKFNYQGTKRWLEDNLDHTDSSLLQDNVAFVLCLDTVGRGSSLHLHVSKPPREGTLQHAFLRELETVAAHQFPEVRFSMVHKRINLAEDVLAWEHERFAIRRLPAFTLSHLESHRDGQRSSIMDVRSRVDSKTLTRNTRIIAEALTRVIYNLTEKGTPPDMPV

SEQ ID NO: 56852 - protein, 110 aa, Homo sapiens
  Payload ID: 11176
  Gene Symbol: NCLN
  Gene Name: nicalin
  ENSP ID: ENSP00000467693
  MOD_RES (1)..(1): Any amino acid
XLQDNVAFVLCLDTVGRGSSLHLHVSKPPREGTLQHAFLRELETVAAHQFPEVRFSMVHKRINLAEDVLAWEHERFAIRRLPAFTLSHLESHRDGQRSSIMDVRQSLTVS

SEQ ID NO: 56853 - protein, 709 aa, Homo sapiens
  Payload ID: 11177
  Gene Symbol: NCSTN
  Gene Name: nicastrin
  Uniprot ID: Q92542
  ENSP ID: ENSP00000294785
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 56854 - protein, 689 aa, Homo sapiens
  Payload ID: 11177
  Gene Symbol: NCSTN
  Gene Name: nicastrin
  Uniprot ID: Q92542
  ENSP ID: ENSP00000357042
MDFNLILESLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 56855 - protein, 319 aa, Homo sapiens
  Payload ID: 11177
  Gene Symbol: NCSTN
  Gene Name: nicastrin
  ENSP ID: ENSP00000388118
  MOD_RES (1)..(1): Any amino acid
XGFGVYSNSYGPEFAHCREIQWNSLGNGLAYEDFSFPIFLLEDENETKVIKQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDT

SEQ ID NO: 56856 - protein, 232 aa, Homo sapiens
  Payload ID: 11177
  Gene Symbol: NCSTN
  Gene Name: nicastrin
  ENSP ID: ENSP00000389370
MATAGGGSGADPGSRGLLRLLSFCVLLAGLFLDFEPDPLPLCPDVSFFPQPQPPTPQSKGTGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDH

SEQ ID NO: 56857 - protein, 255 aa, Homo sapiens
  Payload ID: 11177
  Gene Symbol: NCSTN
  Gene Name: nicastrin
  ENSP ID: ENSP00000390409
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQETFDYIGSSRMVYDMEKGKFPVQLENVDSFVELGQVALRTSLELWMHTDPVSQKNESVRNQ

SEQ ID NO: 56858 - protein, 275 aa, Homo sapiens
  Payload ID: 11177
  Gene Symbol: NCSTN
  Gene Name: nicastrin
  ENSP ID: ENSP00000407849
  MOD_RES (1)..(1): Any amino acid
XNVAPGAESAVASFVTQLAAAEALQKAPDVTTLPRNVMFVFFQGVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKD

SEQ ID NO: 56859 - protein, 219 aa, Homo sapiens
  Payload ID: 11177
  Gene Symbol: NCSTN
  Gene Name: nicastrin
  ENSP ID: ENSP00000410124
RSSIQSTFSINPEIVCDPLSDYNVWSMLKPINTTGTLKPDDRVVVAATRLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEE

SEQ ID NO: 56860 - protein, 134 aa, Homo sapiens
  Payload ID: 11177
  Gene Symbol: NCSTN
  Gene Name: nicastrin
  ENSP ID: ENSP00000415442
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRQNVRLSDTFLCSFMEFLSYSRDLMEKLKG

SEQ ID NO: 56861 - protein, 213 aa, Homo sapiens
  Payload ID: 11178
  Gene Symbol: NICN1
  Gene Name: nicolin 1
  Uniprot ID: Q9BSH3
  ENSP ID: ENSP00000273598
MSRVLVPCHVKGSVALQVGDVRTSQGRPGVLVIDVTFPSVAPFELQEITFKNYYTAFLSIRVRQYTSAHTPAKWVTCLRDYCLMPDPHSEEGAQEYVSLFKHQMLCDMARISELRLILRQPSPLWLSFTVEELQIYQQGPKSPSVTFPKWLSHPVPCEQPALLREGLPDPSRVSSEVQQMWALTEMIRASHTSARIGRFDVDGCYDLNLLSYT

SEQ ID NO: 56862 - protein, 175 aa, Homo sapiens
  Payload ID: 11178
  Gene Symbol: NICN1
  Gene Name: nicolin 1
  ENSP ID: ENSP00000402335
MSRVLVPCHVKGSVALQVGDVRTSQGRPGVLVIDVTFPSVAPFELQEITFKNYYTAFLSIRVRQYTSAHTPAKWVTCLRDYCLMPDPHSEEGAQEYVSLFKHQSPSVTFPKWLSHPVPCEQPALLREGLPDPSRVSSEVQQMWALTEMIRASHTSARIGRFDVDGCYDLNLLSYT

SEQ ID NO: 56863 - protein, 213 aa, Homo sapiens; identical to SEQ ID NO: 56861
  Payload ID: 11178
  Gene Symbol: NICN1
  Gene Name: nicolin 1
  Uniprot ID: Q9BSH3
  ENSP ID: ENSP00000413115

SEQ ID NO: 56864 - protein, 213 aa, Homo sapiens; identical to SEQ ID NO: 56861
  Payload ID: 11178
  Gene Symbol: NICN1
  Gene Name: nicolin 1
  Uniprot ID: Q9BSH3
  ENSP ID: ENSP00000478287

SEQ ID NO: 56865 - protein, 264 aa, Homo sapiens
  Payload ID: 11179
  Gene Symbol: NNMT
  Gene Name: nicotinamide N-methyltransferase
  Uniprot ID: P40261
  ENSP ID: ENSP00000299964
MESGFTSKDTYLSHFNPRDYLEKYYKFGSRHSAESQILKHLLKNLFKIFCLDGVKGDLLIDIGSGPTIYQLLSACESFKEIVVTDYSDQNLQELEKWLKKEPEAFDWSPVVTYVCDLEGNRVKGPEKEEKLRQAVKQVLKCDVTQSQPLGAVPLPPADCVLSTLCLDAACPDLPTYCRALRNLGSLLKPGGFLVIMDALKSSYYMIGEQKFSSLPLGREAVEAAVKEAGYTIEWFEVISQSYSSTMANNEGLFSLVARKLSRPL

SEQ ID NO: 56866 - protein, 264 aa, Homo sapiens; identical to SEQ ID NO: 56865
  Payload ID: 11179
  Gene Symbol: NNMT
  Gene Name: nicotinamide N-methyltransferase
  Uniprot ID: P40261
  ENSP ID: ENSP00000441434

SEQ ID NO: 56867 - protein, 279 aa, Homo sapiens
  Payload ID: 11180
  Gene Symbol: NMNAT1
  Gene Name: nicotinamide nucleotide adenylyltransferase 1
  Uniprot ID: Q9HAN9
  ENSP ID: ENSP00000366410
MENSEKTEVVLLACGSFNPITNMHLRLFELAKDYMNGTGRYTVVKGIISPVGDAYKKKGLIPAYHRVIMAELATKNSKWVEVDTWESLQKEWKETLKVLRHHQEKLEASDCDHQQNSPTLERPGRKRKWTETQDSSQKKSLEPKTKAVPKVKLLCGADLLESFAVPNLWKSEDITQIVANYGLICVTRAGNDAQKFIYESDVLWKHRSNIHVVNEWIANDISSTKIRRALRRGQSIRYLVPDLVQEYIEKHNLYSSESEDRNAGVILAPLQRNTAEAKT

SEQ ID NO: 56868 - protein, 160 aa, Homo sapiens
  Payload ID: 11180
  Gene Symbol: NMNAT1
  Gene Name: nicotinamide nucleotide adenylyltransferase 1
  ENSP ID: ENSP00000385131
MENSEKTEVVLLACGSFNPITNMHLRLFELAKDYMNGTGRYTVVKGIISPVGDAYKKKGLIPAYHRVIMAELATKNSKWVEVDTWESLQKEWKETLKVLRHHQEKLEASDCDHQQNSPTLERPGRKRKWTETQDSSQKKSLEPKTKDGVSLYHPGWSAVA

SEQ ID NO: 56869 - protein, 279 aa, Homo sapiens; identical to SEQ ID NO: 56867
  Payload ID: 11180
  Gene Symbol: NMNAT1
  Gene Name: nicotinamide nucleotide adenylyltransferase 1
  Uniprot ID: Q9HAN9
  ENSP ID: ENSP00000435134

SEQ ID NO: 56870 - protein, 42 aa, Homo sapiens
  Payload ID: 11180
  Gene Symbol: NMNAT1
  Gene Name: nicotinamide nucleotide adenylyltransferase 1
  ENSP ID: ENSP00000467340
  MOD_RES (1)..(1): Any amino acid
XASDCDHQQNSPTLERPGRKRKWTETQDSSQKKSLEPKTKGL

SEQ ID NO: 56871 - protein, 307 aa, Homo sapiens
  Payload ID: 11181
  Gene Symbol: NMNAT2
  Gene Name: nicotinamide nucleotide adenylyltransferase 2
  Uniprot ID: Q9BZQ4
  ENSP ID: ENSP00000287713
MTETTKTHVILLACGSFNPITKGHIQMFERARDYLHKTGRFIVIGGIVSPVHDSYGKQGLVSSRHRLIMCQLAVQNSDWIRVDPWECYQDTWQTTCSVLEHHRDLMKRVTGCILSNVNTPSMTPVIGQPQNETPQPIYQNSNVATKPTAAKILGKVGESLSRICCVRPPVERFTFVDENANLGTVMRYEEIELRILLLCGSDLLESFCIPGLWNEADMEVIVGDFGIVVVPRDAADTDRIMNHSSILRKYKNNIMVVKDDINHPMSVVSSTKSRLALQHGDGHVVDYLSQPVIDYILKSQLYINASG

SEQ ID NO: 56872 - protein, 302 aa, Homo sapiens
  Payload ID: 11181
  Gene Symbol: NMNAT2
  Gene Name: nicotinamide nucleotide adenylyltransferase 2
  Uniprot ID: Q9BZQ4
  ENSP ID: ENSP00000294868
MEIQELEEIQACQGLWEVFVTLSERARDYLHKTGRFIVIGGIVSPVHDSYGKQGLVSSRHRLIMCQLAVQNSDWIRVDPWECYQDTWQTTCSVLEHHRDLMKRVTGCILSNVNTPSMTPVIGQPQNETPQPIYQNSNVATKPTAAKILGKVGESLSRICCVRPPVERFTFVDENANLGTVMRYEEIELRILLLCGSDLLESFCIPGLWNEADMEVIVGDFGIVVVPRDAADTDRIMNHSSILRKYKNNIMVVKDDINHPMSVVSSTKSRLALQHGDGHVVDYLSQPVIDYILKSQLYINASG

SEQ ID NO: 56873 - protein, 252 aa, Homo sapiens
  Payload ID: 11182
  Gene Symbol: NMNAT3
  Gene Name: nicotinamide nucleotide adenylyltransferase 3
  Uniprot ID: Q96T66
  ENSP ID: ENSP00000296202
MKSRIPVVLLACGSFNPITNMHLRMFEVARDHLHQTGMYQVIQGIISPVNDTYGKKDLAASHHRVAMARLALQTSDWIRVDPWESEQAQWMETVKVLRHHHSKLLRSPPQMEGPDHGKALFSTPAAVPELKLLCGADVLKTFQTPNLWKDAHIQEIVEKFGLVCVGRVGHDPKGYIAESPILRMHQHNIHLAKEPVQNEISATYIRRALGQGQSVKYLIPDAVITYIKDHGLYTKGSTWKGKSTQSTEGKTS

SEQ ID NO: 56874 - protein, 215 aa, Homo sapiens
  Payload ID: 11182
  Gene Symbol: NMNAT3
  Gene Name: nicotinamide nucleotide adenylyltransferase 3
  Uniprot ID: Q96T66
  ENSP ID: ENSP00000340523
MYQVIQGIISPVNDTYGKKDLAASHHRVAMARLALQTSDWIRVDPWESEQAQWMETVKVLRHHHSKLLRSPPQMEGPDHGKALFSTPAAVPELKLLCGADVLKTFQTPNLWKDAHIQEIVEKFGLVCVGRVGHDPKGYIAESPILRMHQHNIHLAKEPVQNEISATYIRRALGQGQSVKYLIPDAVITYIKDHGLYTKGSTWKGKSTQSTEGKTS

SEQ ID NO: 56875 - protein, 252 aa, Homo sapiens; identical to SEQ ID NO: 56873
  Payload ID: 11182
  Gene Symbol: NMNAT3
  Gene Name: nicotinamide nucleotide adenylyltransferase 3
  Uniprot ID: Q96T66
  ENSP ID: ENSP00000384319

SEQ ID NO: 56876 - protein, 163 aa, Homo sapiens
  Payload ID: 11182
  Gene Symbol: NMNAT3
  Gene Name: nicotinamide nucleotide adenylyltransferase 3
  Uniprot ID: Q96T66
  ENSP ID: ENSP00000412953
MKSRIPVVLLACGSFNPITNMHLRMFEVARDHLHQTAVPELKLLCGADVLKTFQTPNLWKDAHIQEIVEKFGLVCVGRVGHDPKGYIAESPILRMHQHNIHLAKEPVQNEISATYIRRALGQGQSVKYLIPDAVITYIKDHGLYTKGSTWKGKSTQSTEGKTS

SEQ ID NO: 56877 - protein, 98 aa, Homo sapiens
  Payload ID: 11182
  Gene Symbol: NMNAT3
  Gene Name: nicotinamide nucleotide adenylyltransferase 3
  ENSP ID: ENSP00000423335
MKSRIPVVLLACGSFNPITNMHLRMFEVARDHLHQTGMYQVIQGIISPVNDTYGKKDLAASHHRVAMARLALQTSDWIRVDPWESEQAQWMETVKVLR

SEQ ID NO: 56878 - protein, 63 aa, Homo sapiens
  Payload ID: 11182
  Gene Symbol: NMNAT3
  Gene Name: nicotinamide nucleotide adenylyltransferase 3
  ENSP ID: ENSP00000425041
MYQVIQGIISPVNDTYGKKDLAASHHRVAMARLALQTSDWIRVDPWESEQAQWMETVKVLSCA

SEQ ID NO: 56879 - protein, 100 aa, Homo sapiens
  Payload ID: 11182
  Gene Symbol: NMNAT3
  Gene Name: nicotinamide nucleotide adenylyltransferase 3
  ENSP ID: ENSP00000426357
MKSRIPVVLLACGSFNPITNMHLRMFEVARDHLHQTGMYQVIQGIISPVNDTYGKKDLAASHHRVAMARLALQTSDWIRVDPWESEQAQWMETVKVLSCA

SEQ ID NO: 56880 - protein, 98 aa, Homo sapiens
  Payload ID: 11182
  Gene Symbol: NMNAT3
  Gene Name: nicotinamide nucleotide adenylyltransferase 3
  ENSP ID: ENSP00000426375
MKSRIPVVLLACGSFNPITNMHLRMFEVARDHLHQTDFCLSRPLFPRVHFSQHNQGKKKMGKSVHEVVGARLCLCPQKHQASPSKSPRTEVCKREEAN

SEQ ID NO: 56881 - protein, 113 aa, Homo sapiens
  Payload ID: 11182
  Gene Symbol: NMNAT3
  Gene Name: nicotinamide nucleotide adenylyltransferase 3
  ENSP ID: ENSP00000427634
MKSRIPVVLLACGSFNPITNMHLRMFEVARDHLHQTGMYQVIQGIISPVNDTYGKKDLAASHHRVAMARLALQTSDWIRVDPWESEQAQWMETVKVLRHHHSKLLRSPPQMEG

SEQ ID NO: 56882 - protein, 1086 aa, Homo sapiens
  Payload ID: 11183
  Gene Symbol: NNT
  Gene Name: nicotinamide nucleotide transhydrogenase
  Uniprot ID: Q13423
  ENSP ID: ENSP00000264663
MANLLKTVVTGCSCPLLSNLGSCKGLRVKKDFLRTFYTHQELWCKAPVKPGIPYKQLTVGVPKEIFQNEKRVALSPAGVQNLVKQGFNVVVESGAGEASKFSDDHYRVAGAQIQGAKEVLASDLVVKVRAPMVNPTLGVHEADLLKTSGTLISFIYPAQNPELLNKLSQRKTTVLAMDQVPRVTIAQGYDALSSMANIAGYKAVVLAANHFGRFFTGQITAAGKVPPAKILIVGGGVAGLASAGAAKSMGAIVRGFDTRAAALEQFKSLGAEPLEVDLKESGEGQGGYAKEMSKEFIEAEMKLFAQQCKEVDILISTALIPGKKAPVLFNKEMIESMKEGSVVVDLAAEAGGNFETTKPGELYIHKGITHIGYTDLPSRMATQASTLYSNNITKLLKAISPDKDNFYFDVKDDFDFGTMGHVIRGTVVMKDGKVIFPAPTPKNIPQGAPVKQKTVAELEAEKAATITPFRKTMSTASAYTAGLTGILGLGIAAPNLAFSQMVTTFGLAGIVGYHTVWGVTPALHSPLMSVTNAISGLTAVGGLALMGGHLYPSTTSQGLAALAAFISSVNIAGGFLVTQRMLDMFKRPTDPPEYNYLYLLPAGTFVGGYLAALYSGYNIEQIMYLGSGLCCVGALAGLSTQGTARLGNALGMIGVAGGLAATLGVLKPGPELLAQMSGAMALGGTIGLTIAKRIQISDLPQLVAAFHSLVGLAAVLTCIAEYIIEYPHFATDAAANLTKIVAYLGTYIGGVTFSGSLIAYGKLQGLLKSAPLLLPGRHLLNAGLLAASVGGIIPFMVDPSFTTGITCLGSVSALSAVMGVTLTAAIGGADMPVVITVLNSYSGWALCAEGFLLNNNLLTIVGALIGSSGAILSYIMCVAMNRSLANVILGGYGTTSTAGGKPMEISGTHTEINLDNAIDMIREANSIIITPGYGLCAAKAQYPIADLVKMLTEQGKKVRFGIHPVAGRMPGQLNVLLAEAGVPYDIVLEMDEINHDFPDTDLVLVIGANDTVNSAAQEDPNSIIAGMPVLEVWKSKQVIVMKRSLGVGYAAVDNPIFYKPNTAMLLGDAKKTCDALQAKVRESYQK

SEQ ID NO: 56883 - protein, 1086 aa, Homo sapiens; identical to SEQ ID NO: 56882
  Payload ID: 11183
  Gene Symbol: NNT
  Gene Name: nicotinamide nucleotide transhydrogenase
  Uniprot ID: Q13423
  ENSP ID: ENSP00000343873

SEQ ID NO: 56884 - protein, 57 aa, Homo sapiens
  Payload ID: 11183
  Gene Symbol: NNT
  Gene Name: nicotinamide nucleotide transhydrogenase
  ENSP ID: ENSP00000421674
DGKVIFPAPTPKNIPQGAPVKQKTVAELEAEKAATITPFRKTMSTASAYTADEDREG

SEQ ID NO: 56885 - protein, 217 aa, Homo sapiens
  Payload ID: 11183
  Gene Symbol: NNT
  Gene Name: nicotinamide nucleotide transhydrogenase
  ENSP ID: ENSP00000421886
MANLLKTVVTGCSCPLLSNLGSCKGLRVKKDFLRTFYTHQELWCKAPVKPGIPYKQLTVGVPKEIFQNEKRVALSPAGVQNLVKQGFNVVVESGAGEASKFSDDHYRVAGAQIQGAKEVLASDLVVKVRAPMVNPTLGVHEADLLKTSGTLISFIYPAQNPELLNKLSQRKTTVLAMDQVPRVTIAQGYDALSSMANIAGYKAVVLAANHFGRFFTG

SEQ ID NO: 56886 - protein, 11 aa, Homo sapiens
  Payload ID: 11183
  Gene Symbol: NNT
  Gene Name: nicotinamide nucleotide transhydrogenase
  ENSP ID: ENSP00000424782
  MOD_RES (1)..(1): Any amino acid
XLTEQGKKVRY

SEQ ID NO: 56887 - protein, 58 aa, Homo sapiens
  Payload ID: 11183
  Gene Symbol: NNT
  Gene Name: nicotinamide nucleotide transhydrogenase
  ENSP ID: ENSP00000425542
MVNPTLGVHEADLLKTSGTLISFIYPAQNPELLNKLSQRKTTVLAMDQVPRVTIAQGY

SEQ ID NO: 56888 - protein, 955 aa, Homo sapiens
  Payload ID: 11183
  Gene Symbol: NNT
  Gene Name: nicotinamide nucleotide transhydrogenase
  ENSP ID: ENSP00000426343
MVNPTLGVHEADLLKTSGTLISFIYPAQNPELLNKLSQRKTTVLAMDQVPRVTIAQGYDALSSMANIAGYKAVVLAANHFGRFFTGQITAAGKVPPAKILIVGGGVAGLASAGAAKSMGAIVRGFDTRAAALEQFKSLGAEPLEVDLKESGEGQGGYAKEMSKEFIEAEMKLFAQQCKEVDILISTALIPGKKAPVLFNKEMIESMKEGSVVVDLAAEAGGNFETTKPGELYIHKGITHIGYTDLPSRMATQASTLYSNNITKLLKAISPDKDNFYFDVKDDFDFGTMGHVIRGTVVMKDGKVIFPAPTPKNIPQGAPVKQKTVAELEAEKAATITPFRKTMSTASAYTAGLTGILGLGIAAPNLAFSQMVTTFGLAGIVGYHTVWGVTPALHSPLMSVTNAISGLTAVGGLALMGGHLYPSTTSQGLAALAAFISSVNIAGGFLVTQRMLDMFKRPTDPPEYNYLYLLPAGTFVGGYLAALYSGYNIEQIMYLGSGLCCVGALAGLSTQGTARLGNALGMIGVAGGLAATLGVLKPGPELLAQMSGAMALGGTIGLTIAKRIQISDLPQLVAAFHSLVGLAAVLTCIAEYIIEYPHFATDAAANLTKIVAYLGTYIGGVTFSGSLIAYGKLQGLLKSAPLLLPGRHLLNAGLLAASVGGIIPFMVDPSFTTGITCLGSVSALSAVMGVTLTAAIGGADMPVVITVLNSYSGWALCAEGFLLNNNLLTIVGALIGSSGAILSYIMCVAMNRSLANVILGGYGTTSTAGGKPMEISGTHTEINLDNAIDMIREANSIIITPGYGLCAAKAQYPIADLVKMLTEQGKKVRFGIHPVAGRMPGQLNVLLAEAGVPYDIVLEMDEINHDFPDTDLVLVIGANDTVNSAAQEDPNSIIAGMPVLEVWKSKQVIVMKRSLGVGYAAVDNPIFYKPNTAMLLGDAKKTCDALQAKVRESYQK

SEQ ID NO: 56889 - protein, 199 aa, Homo sapiens
  Payload ID: 11183
  Gene Symbol: NNT
  Gene Name: nicotinamide nucleotide transhydrogenase
  ENSP ID: ENSP00000427670
MANLLKTVVTGCSCPLLSNLGSCKGLRVKKDFLRTFYTHQELWCKAPVKPGIPYKQLTVGVPKEIFQNEKRVALSPAGVQNLVKQGFNVVVESGAGEASKFSDDHYRVAGAQIQGAKEVLASDLVVKVRAPMVNPTLGVHEADLLKTSGTLISFIYPAQNPELLNKLSQRKTTVLAMDQVPRVTIAQGYDALSSMANIA

SEQ ID NO: 56890 - protein, 491 aa, Homo sapiens [sequence omitted]

SEQ ID NO: 56891 - protein, 368 aa, Homo sapiens
  Payload ID: 11184
  Gene Symbol: NAMPT
  Gene Name: nicotinamide phosphoribosyltransferase
  ENSP ID: ENSP00000346242
MNPAAEAEFNILLATDSYKVTHYKQYPPNTSKVYSYFECREKKTENSKLRKVKYEETVFYGLQYILNKYLKGKVVTKEKIQEAKDVYKEHFQDDVFNEKGWNYILEKYDGHLPIEIKAVPEGFVIPRGNVLFTVENTDPECYWLTNWIETILVQSWYPITVATNSREQKKILAKYLLETSGNLDGLEYKLHDFGYRGVSSQETAGIGASAHLVNFKGTDTVAGLALIKKYYGTKDPVPGYSVPAAEHSTITAWGKDHEKDAFEHIVTQFSSVPVSVVSDSYDIYNACEKIWGEDLRHLIVSRSTQAPLIIRPDSGNPLDTVLKVLEILGKKFPVTENSKGYKLLPPYLRVIQGDGVDINTLQEVCVLY

SEQ ID NO: 56892 - protein, 88 aa, Homo sapiens
  Payload ID: 11184
  Gene Symbol: NAMPT
  Gene Name: nicotinamide phosphoribosyltransferase
  ENSP ID: ENSP00000390591
MNPAAEAEFNILLATDSYKVTHYKQYPPNTSKVYSYFECREKKTENSKLRKVKYEETVFYGLQYILNKYLKGKVVTKEKIQEAKDVYK

SEQ ID NO: 56893 - protein, 60 aa, Homo sapiens
  Payload ID: 11184
  Gene Symbol: NAMPT
  Gene Name: nicotinamide phosphoribosyltransferase
  ENSP ID: ENSP00000390896
MNPAAEAEFNILLATDSYKVTHYKQYPPNTSKVYSYFECREKKTENSKLRKVKYEETVFY

SEQ ID NO: 56894 - protein, 199 aa, Homo sapiens
  Payload ID: 11185
  Gene Symbol: NMRK1
  Gene Name: nicotinamide riboside kinase 1
  Uniprot ID: Q9NWW6
  ENSP ID: ENSP00000354387
MKTFIIGISGVTNSGKTTLAKNLQKHLPNCSVISQDDFFKPESEIETDKNGFLQYDVLEALNMEKMMSAISCWMESARHSVVSTDQESAEEIPILIIEGFLLFNYKPLDTIWNRSYFLTIPYEECKRRRSTRVYQPPDSPGYFDGHVWPMYLKYRQEMQDITWEVVYLDGTKSEEDLFLQVYEDLIQELAKQKCLQVTA

SEQ ID NO: 56895 - protein, 175 aa, Homo sapiens
  Payload ID: 11185
  Gene Symbol: NMRK1
  Gene Name: nicotinamide riboside kinase 1
  Uniprot ID: Q9NWW6
  ENSP ID: ENSP00000366004
MKTFIIGISGVTNSGKTTLAKNLQKHLPNCSVISQDDFFKPESEIETDKNGFLQYDVLEALNMEKMMSAISCWMESARHSVVSTDQESAEEIPILIIEGFLLFNYNTRVYQPPDSPGYFDGHVWPMYLKYRQEMQDITWEVVYLDGTKSEEDLFLQVYEDLIQELAKQKCLQVTA

SEQ ID NO: 56896 - protein, 203 aa, Homo sapiens
  Payload ID: 11185
  Gene Symbol: NMRK1
  Gene Name: nicotinamide riboside kinase 1
  ENSP ID: ENSP00000366007
MGKRRHRRGNVISCVTNSGKTTLAKNLQKHLPNCSVISQDDFFKPESEIETDKNGFLQYDVLEALNMEKMMSAISCWMESARHSVVSTDQESAEEIPILIIEGFLLFNYKPLDTIWNRSYFLTIPYEECKRRRSTRVYQPPDSPGYFDGHVWPMYLKYRQEMQDITWEVVYLDGTKSEEDLFLQVYEDLIQELAKQKCLQVTA

SEQ ID NO: 56897 - protein, 106 aa, Homo sapiens
  Payload ID: 11185
  Gene Symbol: NMRK1
  Gene Name: nicotinamide riboside kinase 1
  ENSP ID: ENSP00000435736
MKTFIIGISGVTNSGKTTLAKNLQKHLPNCSVISQDDFFKPESEIETDKNGFLQYDVLEALNMEKMMSAISCWMESARHSVVSTDQESAEEIPILIIEGFLLFNYK

SEQ ID NO: 56898 - protein, 230 aa, Homo sapiens
  Payload ID: 11186
  Gene Symbol: NMRK2
  Gene Name: nicotinamide riboside kinase 2
  Uniprot ID: Q9NPI5
  ENSP ID: ENSP00000168977
MKLIVGIGGMTNGGKTTLTNSLLRALPNCCVIHQDDFFKPQDQIAVGEDGFKQWDVLESLDMEAMLDTVQAWLSSPQKFARAHGVSVQPEASDTHILLLEGFLLYSYKPLVDLYSRRYFLTVPYEECKWRRSTRNYTVPDPPGLFDGHVWPMYQKYRQEMEANGVEVVYLDGMKSREELFREVLEDIQNSLLNRSQESAPSPARPARTQGPGRGCGHRTARPAASQQDSM

SEQ ID NO: 56899 - protein, 83 aa, Homo sapiens
  Payload ID: 11186
  Gene Symbol: NMRK2
  Gene Name: nicotinamide riboside kinase 2
  ENSP ID: ENSP00000468935
  MOD_RES (1)..(1): Any amino acid
XLPNCCVIHQDDFFKPQDQIAVGEDGFKQWDVLESLDMEAMLDTVQAWLSSPQKPRTPTSSSWKASCSTATSPWWTCTAAGTS

SEQ ID NO: 56900 - protein, 112 aa, Homo sapiens
  Payload ID: 11186
  Gene Symbol: NMRK2
  Gene Name: nicotinamide riboside kinase 2
  ENSP ID: ENSP00000471436
MTNGGKTTLTNSLLRALPNCCVIHQDDFFKPQDQIAVGEDGFKQWDVLESLDMEAMLDTVQAWLSSPQKFARAHGVSVQPEASDTHILLLEGFLLYSYNLPGRHEVPRGALP

SEQ ID NO: 56901 - protein, 235 aa, Homo sapiens
  Payload ID: 11186
  Gene Symbol: NMRK2
  Gene Name: nicotinamide riboside kinase 2
  Uniprot ID: Q9NPI5
  ENSP ID: ENSP00000472581
MKLIVGIGGMTNGGKTTLTNSLLRALPNCCVIHQDDFFKAPLFQPQDQIAVGEDGFKQWDVLESLDMEAMLDTVQAWLSSPQKFARAHGVSVQPEASDTHILLLEGFLLYSYKPLVDLYSRRYFLTVPYEECKWRRSTRNYTVPDPPGLFDGHVWPMYQKYRQEMEANGVEVVYLDGMKSREELFREVLEDIQNSLLNRSQESAPSPARPARTQGPGRGCGHRTARPAASQQDSM

SEQ ID NO: 56902 - protein, 235 aa, Homo sapiens; identical to SEQ ID NO: 56901
  Payload ID: 11186
  Gene Symbol: NMRK2
  Gene Name: nicotinamide riboside kinase 2
  Uniprot ID: Q9NPI5
  ENSP ID: ENSP00000480091

SEQ ID NO: 56903 - protein, 584 aa, Homo sapiens
  Payload ID: 11187
  Gene Symbol: NAPRT
  Gene Name: nicotinate phosphoribosyltransferase
  ENSP ID: ENSP00000341136
MAAEQDPEARAAARPLLTDLYQATMALGYWRAGRARDAAEFELFFRRCPFGGAFALAAGLRDCVRFLRAFRLRDADVQFLASVLPPDTDPAFFEHLRALDCSEVTVRALPEGSLAFPGVPLLQVSGPLLVVQLLETPLLCLVSYASLVATNAARLRLIAGPEKRLLEMGLRRAQGPDGGLTASTYSYLGGFDSSSNVLAGQLRGVPVAGTLAHSFVTSFSGSEVPPDPMLAPAAGEGPGVDLAAKAQVWLEQVCAHLGLGVQEPHPGERAAFVAYALAFPRAFQGLLDTYSVWRSGLPNFLAVALALGELGYRAVGVRLDSGDLLQQAQEIRKVFRAAAAQFQVPWLESVLIVVSNNIDEEALARLAQEGSEVNVIGIGTSVVTCPQQPSLGGVYKLVAVGGQPRMKLTEDPEKQTLPGSKAAFRLLGSDGSPLMDMLQLAEEPVPQAGQELRVWPPGAQEPCTVRPAQVEPLLRLCLQQGQLCEPLPSLAESRALAQLSLSRLSPEHRRLRSPAQYQVGGRPTLSFCPVRPRPHPAHRSCPLLPAGGAVREAAGPGEQSVCGAVPLRLGAGLTGNNTNHSLFP

SEQ ID NO: 56904 - protein, 525 aa, Homo sapiens
  Payload ID: 11187
  Gene Symbol: NAPRT
  Gene Name: nicotinate phosphoribosyltransferase
  Uniprot ID: Q6XQN6
  ENSP ID: ENSP00000390949
MAAEQDPEARAAARPLLTDLYQATMALGYWRAGRARDAAEFELFFRRCPFGGAFALAAGLRDCVRFLRAFRLRDADVQFLASVLPPDTDPAFFEHLRALDCSEVTVRALPEGSLAFPGVPLLQVSGPLLVVQLLETPLLCLVSYASLVATNAARLRLIAGPEKRLLEMGLRRAQGPDGGLTASTYSYLGGFDSSSNVLAGQLRGVPVAGTLAHSFVTSFSGSEVPPDPMLAPAAGEGPGVDLAAKAQVWLEQVCAHLGLGVQEPHPGERAAFVAYALAFPRAFQGLLDTYSVWRSGLPNFLAVALALGELGYRAVGVRLDSGDLLQQAQEIRKVFRAAAAQFQVPWLESVLIVVSNNIDEEALARLAQEGSEVNVIGIGTSVVTCPQQPSLGGVYKLVAVGGQPRMKLTEDPEKQTLPGSKAAFRLLGSDGSPLMDMLQLAEEPVPQAGQELRVWPPGAQEPCTVRPAQLCEPLPSLAESRALAQLSLSRLSPEHRRLRSPAQYQVVLSERLQALVNSLCAGQSP

SEQ ID NO: 56905 - protein, 538 aa, Homo sapiens
  Payload ID: 11187
  Gene Symbol: NAPRT
  Gene Name: nicotinate phosphoribosyltransferase
  Uniprot ID: Q6XQN6
  ENSP ID: ENSP00000401508
MAAEQDPEARAAARPLLTDLYQATMALGYWRAGRARDAAEFELFFRRCPFGGAFALAAGLRDCVRFLRAFRLRDADVQFLASVLPPDTDPAFFEHLRALDCSEVTVRALPEGSLAFPGVPLLQVSGPLLVVQLLETPLLCLVSYASLVATNAARLRLIAGPEKRLLEMGLRRAQGPDGGLTASTYSYLGGFDSSSNVLAGQLRGVPVAGTLAHSFVTSFSGSEVPPDPMLAPAAGEGPGVDLAAKAQVWLEQVCAHLGLGVQEPHPGERAAFVAYALAFPRAFQGLLDTYSVWRSGLPNFLAVALALGELGYRAVGVRLDSGDLLQQAQEIRKVFRAAAAQFQVPWLESVLIVVSNNIDEEALARLAQEGSEVNVIGIGTSVVTCPQQPSLGGVYKLVAVGGQPRMKLTEDPEKQTLPGSKAAFRLLGSDGSPLMDMLQLAEEPVPQAGQELRVWPPGAQEPCTVRPAQVEPLLRLCLQQGQLCEPLPSLAESRALAQLSLSRLSPEHRRLRSPAQYQVVLSERLQALVNSLCAGQSP

SEQ ID NO: 56906 - protein, 490 aa, Homo sapiens
  Payload ID: 11187
  Gene Symbol: NAPRT
  Gene Name: nicotinate phosphoribosyltransferase
  ENSP ID: ENSP00000405670
MAAEQDPEARAAARPLLTDLYQATMALGYWRAGRARDAAEFELFFRRCPFGGAFALAAGLRDCVRFLRAFRLRDADVQFLASVLPPDTDPAFFEHLRALDCSEVTVRALPEGSLAFPGVPLLQVSGPLLVVQLLETPLLCLVSYASLVATNAARLRLIAGPEKRLLEMGLRRAQGPDGGLTASTYSYLGGFDSSSNVLAGQLRGVPVAGTLAHSFVTSFSGSEVPPDPMLAPAAGEGPGVDLAAKAQVWLEQVCAHLGLGVQEPHPGERAAFVAYALAFPRAFQGLLDTYSVWRSGLPNFLAVALALGELGYRAVGVRLDSGDLLQQAQEIRKVFRAAAAQFQVPWLESVLIVVSNNIDEEALARLAQEGSEVNVIGIGTSVVTCPQQPSLGGVYKLVAVGGQPRMKLTEDPEKQTLPGSKAAFRLLGSDGSPLMDMLQLAEEPVPQAGQELRVWPPGAQEPCTVRPAQVEPLLRLCLQQGQVAAPPPSS

SEQ ID NO: 56907 - protein, 128 aa, Homo sapiens
  Payload ID: 11187
  Gene Symbol: NAPRT
  Gene Name: nicotinate phosphoribosyltransferase
  ENSP ID: ENSP00000433245
  MOD_RES (1)..(1): Any amino acid
XALAAGLRDCVRFLRAFRLRDADVQFLASVLPPDTDPAFFEHLRALDCSEVPLLQVSGPLLVVQLLETPLLCLVSYASLVATNAARLRLIAGPEKRLLEMGLRRAQGPDGGLTASTYSYLGDVGASSW

SEQ ID NO: 56908 - protein, 163 aa, Homo sapiens
  Payload ID: 11187
  Gene Symbol: NAPRT
  Gene Name: nicotinate phosphoribosyltransferase
  ENSP ID: ENSP00000437102
  MOD_RES (1)..(1): Any amino acid
XARDAAEFELFFRRCPFGGAFALAAGLRDCVRFLRAFRLRDADVQFLASVLPPDTDPAFFEHLRALDCSEVTVRALPEGSLAFPGVPLLQVSGPLLVVQLLETPLLCLVSYASLVATNAARLRLIAGPEKRLLEMGLRRAQGPDGGLTASTYSYLGDVGASSW

SEQ ID NO: 56909 - protein, 232 aa, Homo sapiens
  Payload ID: 11187
  Gene Symbol: NAPRT
  Gene Name: nicotinate phosphoribosyltransferase
  ENSP ID: ENSP00000478911
  MOD_RES (1)..(1): Any amino acid
XFQVPWLESVLIVVSNNIDEEALARLAQEGSEVNVIGIGTSVVTCPQQPSLGGVYKLVAVGGQPRMKLTEDPEKQTLPGSKAAFRLLGSDGSPLMDMLQLAEEPVPQAGQELRVWPPGAQEPCTVRPAQLCEPLPSLAESRALAQLSLSRLSPEHRRLRSPAQYQVGGRPTLSFCPVRPRPHPAHRSCPLLPAGGAVREAAGPGEQSVCGAVPLRLGAGLTGNNTNHSLFPT

SEQ ID NO: 56910 - protein, 538 aa, Homo sapiens; identical to SEQ ID NO: 56905
  Payload ID: 11187
  Gene Symbol: NAPRT
  Gene Name: nicotinate phosphoribosyltransferase
  Uniprot ID: Q6XQN6
  ENSP ID: ENSP00000480017

SEQ ID NO: 56911 - protein, 128 aa, Homo sapiens; identical to SEQ ID NO: 56907
  Payload ID: 11187
  Gene Symbol: NAPRT
  Gene Name: nicotinate phosphoribosyltransferase
  ENSP ID: ENSP00000487629
  MOD_RES (1)..(1): Any amino acid

SEQ ID NO: 56912 - protein, 232 aa, Homo sapiens; identical to SEQ ID NO: 56909
  Payload ID: 11187
  Gene Symbol: NAPRT
  Gene Name: nicotinate phosphoribosyltransferase
  ENSP ID: ENSP00000487892
  MOD_RES (1)..(1): Any amino acid

SEQ ID NO: 56913 - protein, 163 aa, Homo sapiens; identical to SEQ ID NO: 56908
  Payload ID: 11187
  Gene Symbol: NAPRT
  Gene Name: nicotinate phosphoribosyltransferase
  ENSP ID: ENSP00000488253
  MOD_RES (1)..(1): Any amino acid

SEQ ID NO: 56914 - protein, 584 aa, Homo sapiens; identical to SEQ ID NO: 56903
  Payload ID: 11187
  Gene Symbol: NAPRT
  Gene Name: nicotinate phosphoribosyltransferase
  ENSP ID: ENSP00000488704

SEQ ID NO: 56915 - protein, 525 aa, Homo sapiens; identical to SEQ ID NO: 56904
  Payload ID: 11187
  Gene Symbol: NAPRT
  Gene Name: nicotinate phosphoribosyltransferase
  Uniprot ID: Q6XQN6
  ENSP ID: ENSP00000488794

SEQ ID NO: 56916 - protein, 1247 aa, Homo sapiens
  Payload ID: 11188
  Gene Symbol: NID1
  Gene Name: nidogen 1
  Uniprot ID: P14543
  ENSP ID: ENSP00000264187
MLASSSRIRAAWTRALLLPLLLAGPVGCLSRQELFPFGPGQGDLELEDGDDFVSPALELSGALRFYDRSDIDAVYVTTNGIIATSEPPAKESHPGLFPPTFGAVAPFLADLDTTDGLGKVYYREDLSPSITQRAAECVHRGFPEISFQPSSAVVVTWESVAPYQGPSRDPDQKGKRNTFQAVLASSDSSSYAIFLYPEDGLQFHTTFSKKENNQVPAVVAFSQGSVGFLWKSNGAYNIFANDRESVENLAKSSNSGQQGVWVFEIGSPATTNGVVPADVILGTEDGAEYDDEDEDYDLATTRLGLEDVGTTPFSYKALRRGGADTYSVPSVLSPRRAATERPLGPPTERTRSFQLAVETFHQQHPQVIDVDEVEETGVVFSYNTDSRQTCANNRHQCSVHAECRDYATGFCCSCVAGYTGNGRQCVAEGSPQRVNGKVKGRIFVGSSQVPIVFENTDLHSYVVMNHGRSYTAISTIPETVGYSLLPLAPVGGIIGWMFAVEQDGFKNGFSITGGEFTRQAEVTFVGHPGNLVIKQRFSGIDEHGHLTIDTELEGRVPQIPFGSSVHIEPYTELYHYSTSVITSSSTREYTVTEPERDGASPSRIYTYQWRQTITFQECVHDDSRPALPSTQQLSVDSVFVLYNQEEKILRYALSNSIGPVREGSPDALQNPCYIGTHGCDTNAACRPGPRTQFTCECSIGFRGDGRTCYDIDECSEQPSVCGSHTICNNHPGTFRCECVEGYQFSDEGTCVAVVDQRPINYCETGLHNCDIPQRAQCIYTGGSSYTCSCLPGFSGDGQACQDVDECQPSRCHPDAFCYNTPGSFTCQCKPGYQGDGFRCVPGEVEKTRCQHEREHILGAAGATDPQRPIPPGLFVPECDAHGHYAPTQCHGSTGYCWCVDRDGREVEGTRTRPGMTPPCLSTVAPPIHQGPAVPTAVIPLPPGTHLLFAQTGKIERLPLEGNTMRKTEAKAFLHVPAKVIIGLAFDCVDKMVYWTDITEPSIGRASLHGGEPTTIIRQDLGSPEGIAVDHLGRNIFWTDSNLDRIEVAKLDGTQRRVLFETDLVNPRGIVTDSVRGNLYWTDWNRDNPKIETSYMDGTNRRILVQDDLGLPNGLTFDAFSSQLCWVDAGTNRAECLNPSQPSRRKALEGLQYPFAVTSYGKNLYFTDWKMNSVVALDLAISKETDAFQPHKQTRLYGITTALSQCPQGHNYCSVNNGGCTHLCLATPGSRTCRCPDNTLGVDCIEQK

SEQ ID NO: 56917 - protein, 1114 aa, Homo sapiens
  Payload ID: 11188
  Gene Symbol: NID1
  Gene Name: nidogen 1
  Uniprot ID: P14543
  ENSP ID: ENSP00000355554
MLASSSRIRAAWTRALLLPLLLAGPVGCLSRQELFPFGPGQGDLELEDGDDFVSPALELSGALRFYDRSDIDAVYVTTNGIIATSEPPAKESHPGLFPPTFGAVAPFLADLDTTDGLGKVYYREDLSPSITQRAAECVHRGFPEISFQPSSAVVVTWESVAPYQGPSRDPDQKGKRNTFQAVLASSDSSSYAIFLYPEDGLQFHTTFSKKENNQVPAVVAFSQGSVGFLWKSNGAYNIFANDRESVENLAKSSNSGQQGVWVFEIGSPATTNGVVPADVILGTEDGAEYDDEDEDYDLATTRLGLEDVGTTPFSYKALRRGGADTYSVPSVLSPRRAATERPLGPPTERTRSFQLAVETFHQQHPQVIDVDEVEETGVVFSYNTDSRQTCANNRHQCSVHAECRDYATGFCCSCVAGYTGNGRQCVAEGSPQRVNGKVKGRIFVGSSQVPIVFENTDLHSYVVMNHGRSYTAISTIPETVGYSLLPLAPVGGIIGWMFAVEQDGFKNGFSITGGEFTRQAEVTFVGHPGNLVIKQRFSGIDEHGHLTIDTELEGRVPQIPFGSSVHIEPYTELYHYSTSVITSSSTREYTVTEPERDGASPSRIYTYQWRQTITFQECVHDDSRPALPSTQQLSVDSVFVLYNQEEKILRYALSNSIGPVREGSPDALQNPCYIGTHGCDTNAACRPGPRTQFTCECSIGFRGDGRTCYEVEKTRCQHEREHILGAAGATDPQRPIPPGLFVPECDAHGHYAPTQCHGSTGYCWCVDRDGREVEGTRTRPGMTPPCLSTVAPPIHQGPAVPTAVIPLPPGTHLLFAQTGKIERLPLEGNTMRKTEAKAFLHVPAKVIIGLAFDCVDKMVYWTDITEPSIGRASLHGGEPTTIIRQDLGSPEGIAVDHLGRNIFWTDSNLDRIEVAKLDGTQRRVLFETDLVNPRGIVTDSVRGNLYWTDWNRDNPKIETSYMDGTNRRILVQDDLGLPNGLTFDAFSSQLCWVDAGTNRAECLNPSQPSRRKALEGLQYPFAVTSYGKNLYFTDWKMNSVVALDLAISKETDAFQPHKQTRLYGITTALSQCPQGHNYCSVNNGGCTHLCLATPGSRTCRCPDNTLGVDCIEQK

SEQ ID NO: 56918 - protein, 1375 aa, Homo sapiens
  Payload ID: 11189
  Gene Symbol: NID2
  Gene Name: nidogen 2 (osteonidogen)
  Uniprot ID: Q14112
  ENSP ID: ENSP00000216286
MEGDRVAGRPVLSSLPVLLLLPLLMLRAAALHPDELFPHGESWGDQLLQEGDDESSAVVKLANPLHFYEARFSNLYVGTNGIISTQDFPRETQYVDYDFPTDFPAIAPFLADIDTSHGRGRVLYREDTSPAVLGLAARYVRAGFPRSARFTPTHAFLATWEQVGAYEEVKRGALPSGELNTFQAVLASDGSDSYALFLYPANGLQFLGTRPKESYNVQLQLPARVGFCRGEADDLKSEGPYFSLTSTEQSVKNLYQLSNLGIPGVWAFHIGSTSPLDNVRPAAVGDLSAAHSSVPLGRSFSHATALESDYNEDNLDYYDVNEEEAEYLPGEPEEALNGHSSIDVSFQSKVDTKPLEESSTLDPHTKEGTSLGEVGGPDLKGQVEPWDERETRSPAPPEVDRDSLAPSWETPPPYPENGSIQPYPDGGPVPSEMDVPPAHPEEEIVLRSYPASGHTTPLSRGTYEVGLEDNIGSNTEVFTYNAANKETCEHNHRQCSRHAFCTDYATGFCCHCQSKFYGNGKHCLPEGAPHRVNGKVSGHLHVGHTPVHFTDVDLHAYIVGNDGRAYTAISHIPQPAAQALLPLTPIGGLFGWLFALEKPGSENGFSLAGAAFTHDMEVTFYPGEETVRITQTAEGLDPENYLSIKTNIQGQVPYVSANFTAHISPYKELYHYSDSTVTSTSSRDYSLTFGAINQTWSYRIHQNITYQVCRHAPRHPSFPTTQQLNVDRVFALYNDEERVLRFAVTNQIGPVKEDSDPTPGNPCYDGSHMCDTTARCHPGTGVDYTCECASGYQGDGRNCVDENECATGFHRCGPNSVCINLPGSYRCECRSGYEFADDRHTCILITPPANPCEDGSHTCAPAGQARCVHHGGSTFSCACLPGYAGDGHQCTDVDECSENRCHPAATCYNTPGSFSCRCQPGYYGDGFQCIPDSTSSLTPCEQQQRHAQAQYAYPGARFHIPQCDEQGNFLPLQCHGSTGFCWCVDPDGHEVPGTQTPPGSTPPHCGPSPEPTQRPPTICERWRENLLEHYGGTPRDDQYVPQCDDLGHFIPLQCHGKSDFCWCVDKDGREVQGTRSQPGTTPACIPTVAPPMVRPTPRPDVTPPSVGTFLLYTQGQQIGYLPLNGTRLQKDAAKTLLSLHGSIIVGIDYDCRERMVYWTDVAGRTISRAGLELGAEPETIVNSGLISPEGLAIDHIRRTMYWTDSVLDKIESALLDGSERKVLFYTDLVNPRAIAVDPIRGNLYWTDWNREAPKIETSSLDGENRRILINTDIGLPNGLTFDPFSKLLCWADAGTKKLECTLPDGTGRRVIQNNLKYPFSIVSYADHFYHTDWRRDGVVSVNKHSGQFTDEYLPEQRSHLYGITAVYPYCPTGRK

SEQ ID NO: 56919 - protein, 1373 aa, Homo sapiens
  Payload ID: 11189
  Gene Symbol: NID2
  Gene Name: nidogen 2 (osteonidogen)
  ENSP ID: ENSP00000443730
MEGDRVAGRPVLSSLPVLLLLPLLMLRAAALHPDELFPHGESWGDQLLQEGDRKLSRGEAGESPALTKPDSATSTWAPTASSPLRTSPGKRSMWTMISPPTSRPSPLFWRTSTRATAEAESCTERTPPPQCWAWPPAMCALASRALRALPHPRLPGHLGAGRRLRGGQARALPSGELNTFQAVLASDGSDSYALFLYPANGLQFLGTRPKESYNVQLQLPARVGFCRGEADDLKSEGPYFSLTSTEQSVKNLYQLSNLGIPGVWAFHIGSTSPLDNVRPAAVGDLSAAHSSVPLGRSFSHATALESDYNEDNLDYYDVNEEEAEYLPGEPEEALNGHSSIDVSFQSKVDTKPLEESSTLDPHTKEGTSLGEVGGPDLKGQVEPWDERETRSPAPPEVDRDSLAPSWETPPPYPENGSIQPYPDGGPVPSEMDVPPAHPEEEIVLRSYPASGHTTPLSRGTYEVGLEDNIGSNTEVFTYNAANKETCEHNHRQCSRHAFCTDYATGFCCHCQSKFYGNGKHCLPEGAPHRVNGKVSGHLHVGHTPVHFTDVDLHAYIVGNDGRAYTAISHIPQPAAQALLPLTPIGGLFGWLFALEKPGSENGFSLAGAAFTHDMEVTFYPGEETVRITQTAEGLDPENYLSIKTNIQGQVPYVSANFTAHISPYKELYHYSDSTVTSTSSRDYSLTFGAINQTWSYRIHQNITYQVCRHAPRHPSFPTTQQLNVDRVFALYNDEERVLRFAVTNQIGPVKEDSDPTPGNPCYDGSHMCDTTARCHPGTGVDYTCECASGYQGDGRNCVDENECATGFHRCGPNSVCINLPGSYRCECRSGYEFADDRHTCILITPPANPCEDGSHTCAPAGQARCVHHGGSTFSCACLPGYAGDGHQCTDVDECSENRCHPAATCYNTPGSFSCRCQPGYYGDGFQCIPDSTSSLTPCEQQQRHAQAQYAYPGARFHIPQCDEQGNFLPLQCHGSTGFCWCVDPDGHEVPGTQTPPGSTPPHCGPSPEPTQRPPTICERWRENLLEHYGGTPRDDQYVPQCDDLGHFIPLQCHGKSDFCWCVDKDGREVQGTRSQPGTTPACIPTVAPPMVRPTPRPDVTPPSVGTFLLYTQGQQIGYLPLNGTRLQKDAAKTLLSLHGSIIVGIDYDCRERMVYWTDVAGRTISRAGLELGAEPETIVNSGLISPEGLAIDHIRRTMYWTDSVLDKIESALLDGSERKVLFYTDLVNPRAIAVDPIRGNLYWTDWNREAPKIETSSLDGENRRILINTDIGLPNGLTFDPFSKLLCWADAGTKKLECTLPDGTGRRVIQNNLKYPFSIVSYADHFYHTDWRRDGVVSVNKHSGQFTDEYLPEQRSHLYGITAVYPYCPTGRK

SEQ ID NO: 56920 - protein, 644 aa, Homo sapiens
  Payload ID: 11189
  Gene Symbol: NID2
  Gene Name: nidogen 2 (osteonidogen)
  ENSP ID: ENSP00000452190
  MOD_RES (1)..(1): Any amino acid
XYSLTFGAINQTWSYRIHQNITYQVCRHAPRHPSFPTTQQLNVDRVFALYNDEERVLRFAVTNQIGPVKEDSDPTPGNPCYDGSHMCDTTARCHPGTGVDYTCECASGYQGDGRNCVDENECATGFHRCGPNSVCINLPGSYRCECRSGYEFADDRHTCIYVDECSENRCHPAATCYNTPGSFSCRCQPGYYGDGFQCIPDSTSSLTPCEQQQRHAQAQYAYPGARFHIPQCDEQGNFLPLQCHGSTGFCWCVDPDGHEVPGTQTPPGSTPPHCGPSPEPTQRPPTICERWRENLLEHYGGTPRDDQYVPQCDDLGHFIPLQCHGKSDFCWCVDKDGREVQGTRSQPGTTPACIPTVAPPMVRPTPRPDVTPPSVGTFLLYTQGQQIGYLPLNGTRLQKDAAKTLLSLHGSIIVGIDYDCRERMVYWTDVAGRTISRAGLELGAEPETIVNSGLISPEGLAIDHIRRTMYWTDSVLDKIESALLDGSERKVLFYTDLVNPRAIAVDPIRGNLYWTDWNREAPKIETSSLDGENRRILINTDIGLPNGLTFDPFSKLLCWADAGTKKLECTLPDGTGRRVIQNNLKYPFSIVSYADHFYHTDWRRDGVVSVNKHSGQFTDEYLPEQRSHLYGITAVYPYCPTGRK

SEQ ID NO: 56921 - protein, 969 aa, Homo sapiens
  Payload ID: 11189
  Gene Symbol: NID2
  Gene Name: nidogen 2 (osteonidogen)
  ENSP ID: ENSP00000482803
MEGDRVAGRPVLSSLPVLLLLPLLMLRAAALHPDELFPHGESWGDQLLQEGDDESSAVVKLANPLHFYEARFSNLYVGTNGIISTQDFPRETQYVDYDFPTDFPAIAPFLADIDTSHGRGRVLYRVNGKVSGHLHVGHTPVHFTDVDLHAYIVGNDGRAYTAISHIPQPAAQALLPLTPIGGLFGWLFALEKPGSENGFSLAGAAFTHDMEVTFYPGEETVRITQTAEGLDPENYLSIKTNIQGQVPYVSANFTAHISPYKELYHYSDSTVTSTSSRDYSLTFGAINQTWSYRIHQNITYQVCRHAPRHPSFPTTQQLNVDRVFALYNDEERVLRFAVTNQIGPVKEDSDPTPGNPCYDGSHMCDTTARCHPGTGVDYTCECASGYQGDGRNCVDENECATGFHRCGPNSVCINLPGSYRCECRSGYEFADDRHTCILITPPANPCEDGSHTCAPAGQARCVHHGGSTFSCACLPGYAGDGHQCTDVDECSENRCHPAATCYNTPGSFSCRCQPGYYGDGFQCIPDSTSSLTPCEQQQRHAQAQYAYPGARFHIPQCDEQGNFLPLQCHGSTGFCWCVDPDGHEVPGTQTPPGSTPPHCGPSPEPTQRPPTICERWRENLLEHYGGTPRDDQYVPQCDDLGHFIPLQCHGKSDFCWCVDKDGREVQGTRSQPGTTPACIPTVAPPMVRPTPRPDVTPPSVGTFLLYTQGQQIGYLPLNGTRLQKDAAKTLLSLHGSIIVGIDYDCRERMVYWTDVAGRTISRAGLELGAEPETIVNSGLISPEGLAIDHIRRTMYWTDSVLDKIESALLDGSERKVLFYTDLVNPRAIAVDPIRGNLYWTDWNREAPKIETSSLDGENRRILINTDIGLPNGLTFDPFSKLLCWADAGTKKLECTLPDGTGRRVIQNNLKYPFSIVSYADHFYHTDWRRDGVVSVNKHSGQFTDEYLPEQRSHLYGITAVYPYCPTGRK

SEQ ID NO: 56922 - protein, 1278 aa, Homo sapiens
  Payload ID: 11190
  Gene Symbol: NPC1
  Gene Name: Niemann-Pick disease, type C1
  Uniprot ID: O15118
  ENSP ID: ENSP00000269228
MTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHMKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIGPSVNKAKSCATEERYKGTERERLLNF

SEQ ID NO: 56923 - protein, 59 aa, Homo sapiens
  Payload ID: 11190
  Gene Symbol: NPC1
  Gene Name: Niemann-Pick disease, type C1
  ENSP ID: ENSP00000464755
VFSGITLTKFGGIVVLAFAKSQIFQIFYFRMYLAMVLLGATHGLIFLPVLLSYIGPFNS

SEQ ID NO: 56924 - protein, 42 aa, Homo sapiens
  Payload ID: 11190
  Gene Symbol: NPC1
  Gene Name: Niemann-Pick disease, type C1
  ENSP ID: ENSP00000467150
  MOD_RES (1)..(1): Any amino acid
XFYFRMYLAMVLLGATHGLIFLPVLLSYIDDLKVPVLQSETG

SEQ ID NO: 56925 - protein, 971 aa, Homo sapiens
  Payload ID: 11190
  Gene Symbol: NPC1
  Gene Name: Niemann-Pick disease, type C1
  ENSP ID: ENSP00000467636
  MOD_RES (1)..(1): Any amino acid
XAPWTILGLDAMYVIMWITYMAFLLVFFGAFFAVWCYRKRYFVSEYTPIDSNIAFSVNASDKGTAWLLTSTFPSSPVLPGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRFINFVKNYKNPNLTISFTAERSIEDELNRESDSDVFTVVISYAIMFLYISLALGHMKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIGPSVNKAKSCATEERYKGTERERLLNF

SEQ ID NO: 56926 - protein, 175 aa, Homo sapiens
  Payload ID: 11190
  Gene Symbol: NPC1
  Gene Name: Niemann-Pick disease, type C1
  ENSP ID: ENSP00000468321
  MOD_RES (1)..(1): Any amino acid
XVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIATSLF

SEQ ID NO: 56927 - protein, 179 aa, Homo sapiens
  Payload ID: 11190
  Gene Symbol: NPC1
  Gene Name: Niemann-Pick disease, type C1
  ENSP ID: ENSP00000468438
  MOD_RES (1)..(1): Any amino acid
XIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIAKLLERTIYLCISQHIHYATQMAPLQCLMTASDRC

SEQ ID NO: 56928 - protein, 148 aa, Homo sapiens
  Payload ID: 11191
  Gene Symbol: NPC2
  Gene Name: Niemann-Pick disease, type C2
  ENSP ID: ENSP00000238633
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSIKLVVEWQLQDDKNQSLFCWEIPVSHL

SEQ ID NO: 56929 - protein, 201 aa, Homo sapiens
  Payload ID: 11191
  Gene Symbol: NPC2
  Gene Name: Niemann-Pick disease, type C2
  ENSP ID: ENSP00000412103
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSIKLVVEWQLQDDKNQSLFCWEIPVQIMFPCLFSAHCPMLATEHRCLQLQMETKSLRFWSRRGMSVWLPSPAGAWRRTAPF

SEQ ID NO: 56930 - protein, 125 aa, Homo sapiens
  Payload ID: 11191
  Gene Symbol: NPC2
  Gene Name: Niemann-Pick disease, type C2
  Uniprot ID: P61916
  ENSP ID: ENSP00000442488
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSVSHL

SEQ ID NO: 56931 - protein, 173 aa, Homo sapiens
  Payload ID: 11191
  Gene Symbol: NPC2
  Gene Name: Niemann-Pick disease, type C2
  ENSP ID: ENSP00000450502
  MOD_RES (1)..(1): Any amino acid
XPLRVRPPTWTQLSVRRICPSPASGLEDDASRRAWGPREAVRSLRAREEGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSIKLVVEWQLQDDKNQSLFCWEIPVQIVSHL

SEQ ID NO: 56932 - protein, 122 aa, Homo sapiens
  Payload ID: 11191
  Gene Symbol: NPC2
  Gene Name: Niemann-Pick disease, type C2
  ENSP ID: ENSP00000450887
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSV

SEQ ID NO: 56933 - protein, 151 aa, Homo sapiens
  Payload ID: 11191
  Gene Symbol: NPC2
  Gene Name: Niemann-Pick disease, type C2
  Uniprot ID: P61916
  ENSP ID: ENSP00000451112
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSIKLVVEWQLQDDKNQSLFCWEIPVQIVSHL

SEQ ID NO: 56934 - protein, 221 aa, Homo sapiens
  Payload ID: 11191
  Gene Symbol: NPC2
  Gene Name: Niemann-Pick disease, type C2
  ENSP ID: ENSP00000451180
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSIKLVVEWQLQDDKNQSLFCWEIPVQIVSLSGGFSSLSASLSSVHLANESAETLDSTSSSAASTTVTCSPMVSSDSLKRRCSVAETELRVAGSQWLSHVSF

SEQ ID NO: 56935 - protein, 174 aa, Homo sapiens
  Payload ID: 11191
  Gene Symbol: NPC2
  Gene Name: Niemann-Pick disease, type C2
  ENSP ID: ENSP00000451206
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSIKLVVEWQLQDDKNQSLFCWEIPVQIVSLSGGERAWVEGRKWRRNQTETKSVP

SEQ ID NO: 56936 - protein, 53 aa, Homo sapiens
  Payload ID: 11191
  Gene Symbol: NPC2
  Gene Name: Niemann-Pick disease, type C2
  ENSP ID: ENSP00000451314
GAQHRCPGRTGAVQGLRFCGWSYKGSECEPMPHPTLPAEQRTVLQRQCHLHQQ

SEQ ID NO: 56937 - protein, 350 aa, Homo sapiens
  Payload ID: 11192
  Gene Symbol: NIF3L1
  Gene Name: NIF3 NGG1 interacting factor 3-like 1
  Uniprot ID: Q9GZT8
  ENSP ID: ENSP00000352711
MDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGIDGVSVTSFSARTGNEEQTRINLNCTQKALMQVVDFLSRNKQLYQKTEILSLEKPLLLHTGMGRLCTLDESVSLATMIDRIKRHLKLSHIRLALGVGRTLESQVKVVALCAGSGSSVLQGVEADLYLTGEMSHHDTLDAASQGINVILCEHSNTERGFLSDLRDMLDSHLENKINIILSETDRDPLQVV

SEQ ID NO: 56938 - protein, 377 aa, Homo sapiens
  Payload ID: 11192
  Gene Symbol: NIF3L1
  Gene Name: NIF3 NGG1 interacting factor 3-like 1
  Uniprot ID: Q9GZT8
  ENSP ID: ENSP00000386394
MLSSCVRPVPTTVRFVDSLICNSSRSFMDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGIDGVSVTSFSARTGNEEQTRINLNCTQKALMQVVDFLSRNKQLYQKTEILSLEKPLLLHTGMGRLCTLDESVSLATMIDRIKRHLKLSHIRLALGVGRTLESQVKVVALCAGSGSSVLQGVEADLYLTGEMSHHDTLDAASQGINVILCEHSNTERGFLSDLRDMLDSHLENKINIILSETDRDPLQVV

SEQ ID NO: 56939 - protein, 285 aa, Homo sapiens
  Payload ID: 11192
  Gene Symbol: NIF3L1
  Gene Name: NIF3 NGG1 interacting factor 3-like 1
  Uniprot ID: Q9GZT8
  ENSP ID: ENSP00000387021
MLSSCVRPVPTTVRFVDSLICNSSRSFMDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGIDGVSVTSFSARTGNEEQTRINLNCTQKALMQVVDFLSRNKQLYQKTEILSLEKSLKSKSWPCVLVLGAAFCRVLRLTFTSQVRCPIMILWMLLPKE

SEQ ID NO: 56940 - protein, 162 aa, Homo sapiens
  Payload ID: 11192
  Gene Symbol: NIF3L1
  Gene Name: NIF3 NGG1 interacting factor 3-like 1
  ENSP ID: ENSP00000387061
MDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGI

SEQ ID NO: 56941 - protein, 377 aa, Homo sapiens; identical to SEQ ID NO: 56938
  Payload ID: 11192
  Gene Symbol: NIF3L1
  Gene Name: NIF3 NGG1 interacting factor 3-like 1
  Uniprot ID: Q9GZT8
  ENSP ID: ENSP00000387315

SEQ ID NO: 56942 - protein, 162 aa, Homo sapiens
  Payload ID: 11192
  Gene Symbol: NIF3L1
  Gene Name: NIF3 NGG1 interacting factor 3-like 1
  ENSP ID: ENSP00000394955
MLSSCVRPVPTTVRFVDSLICNSSRSFMDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYP

SEQ ID NO: 56943 - protein, 84 aa, Homo sapiens
  Payload ID: 11192
  Gene Symbol: NIF3L1
  Gene Name: NIF3 NGG1 interacting factor 3-like 1
  ENSP ID: ENSP00000399336
  MOD_RES (1)..(1): Any amino acid
XPLLLHTGMGRLCTLDESVSLATMIDRIKRHLKLSHIRLALGVGRTLESQVKVVALCAGSGSSVLQGVEADLYLTGGIIAETSG

SEQ ID NO: 56944 - protein, 252 aa, Homo sapiens
  Payload ID: 11192
  Gene Symbol: NIF3L1
  Gene Name: NIF3 NGG1 interacting factor 3-like 1
  ENSP ID: ENSP00000400787
MLSSCVRPVPTTVRFVDSLICNSSRSFMDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGIDGVSVTSFSARTGNEEQTRINLNCTQKALMQVVDFLSRNKQLYQKHQDNTFYKSAGCQLKFVT

SEQ ID NO: 56945 - protein, 209 aa, Homo sapiens
  Payload ID: 11192
  Gene Symbol: NIF3L1
  Gene Name: NIF3 NGG1 interacting factor 3-like 1
  ENSP ID: ENSP00000412761
MDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGIDGVSVTSFSARTGNEEQTRINLNCTQKALMQVVDFLSRNKQLYQKTE

SEQ ID NO: 56946 - protein, 1582 aa, Homo sapiens
  Payload ID: 11193
  Gene Symbol: NRK
  Gene Name: Nik related kinase
  Uniprot ID: Q7Z2Y5
  ENSP ID: ENSP00000434830
MAGPGGWRDREVTDLGHLPDPTGIFSLDKTIGLGTYGRIYLGLHEKTGAFTAVKVMNARKTPLPEIGRRVRVNKYQKSVGWRYSDEEEDLRTELNLLRKYSFHKNIVSFYGAFFKLSPPGQRHQLWMVMELCAAGSVTDVVRMTSNQSLKEDWIAYICREILQGLAHLHAHRVIHRDIKGQNVLLTHNAEVKLVDFGVSAQVSRTNGRRNSFIGTPYWMAPEVIDCDEDPRRSYDYRSDVWSVGITAIEMAEGAPPLCNLQPLEALFVILRESAPTVKSSGWSRKFHNFMEKCTIKNFLFRPTSANMLQHPFVRDIKNERHVVESLTRHLTGIIKKRQKKGIPLIFEREEAIKEQYTVRRFRGPSCTHELLRLPTSSRCRPLRVLHGEPSQPRWLPDREEPQVQALQQLQGAARVFMPLQALDSAPKPLKGQAQAPQRLQGAARVFMPLQAQVKAKASKPLQMQIKAPPRLRRAARVLMPLQAQVRAPRLLQVQSQVSKKQQAQTQTSEPQDLDQVPEEFQGQDQVPEQQRQGQAPEQQQRHNQVPEQELEQNQAPEQPEVQEQAAEPAQAETEAEEPESLRVNAQVFLPLLSQDHHVLLPLHLDTQVLIPVEGQTEGSPQAQAWTLEPPQAIGSVQALIEGLSRDLLRAPNSNNSKPLGPLQTLMENLSSNRFYSQPEQAREKKSKVSTLRQALAKRLSPKRFRAKSSWRPEKLELSDLEARRQRRQRRWEDIFNQHEEELRQVDKDKEDESSDNDEVFHSIQAEVQIEPLKPYISNPKKIEVQERSPSVPNNQDHAHHVKFSSSVPQRSLLEQAQKPIDIRQRSSQNRQNWLAASESSSEEESPVTGRRSQSSPPYSTIDQKLLVDIHVPDGFKVGKISPPVYLTNEWVGYNALSEIFRNDWLTPAPVIQPPEEDGDYVELYDASADTDGDDDDESNDTFEDTYDHANGNDDLDNQVDQANDVCKDHDDDNNKFVDDVNNNYYEAPSCPRASYGRDGSCKQDGYDGSRGKEEAYRGYGSHTANRSHGGSAASEDNAAIGDQEEHAANIGSERRGSEGDGGKGVVRTSEESGALGLNGEENCSETDGPGLKRPASQDFEYLQEEPGGGNEASNAIDSGAAPSAPDHESDNKDISESSTQSDFSANHSSPSKGSGMSADANFASAILYAGFVEVPEESPKQPSEVNVNPLYVSPACKKPLIHMYEKEFTSEICCGSLWGVNLLLGTRSNLYLMDRSGKADITKLIRRRPFRQIQVLEPLNLLITISGHKNRLRVYHLTWLRNKILNNDPESKRRQEEMLKTEEACKAIDKLTGCEHFSVLQHEETTYIAIALKSSIHLYAWAPKSFDESTAIKVCIDQSADSEGDYMSYQAYIRILAKIQAADPVNRFKRPDELLHLLKLKVFPTLDHKPVTVDLAIGSEKRLKIFFSSADGYHLIDAESEVMSDVTLPKNPLEIIIPQNIIILPDCLGIGMMLTFNAEALSVEANEQLFKKILEMWKDIPSSIAFECTQRTTGWGQKAIEVRSLQSRVLESELKRRSIKKLRFLCTRGDKLFFTSTLRNHHSRVYFMTLGKLEELQSNYDV

SEQ ID NO: 56947 - protein, 163 aa, Homo sapiens
  Payload ID: 11193
  Gene Symbol: NRK
  Gene Name: Nik related kinase
  ENSP ID: ENSP00000438148
MQVPRERIKIAFRLWIPILVIRIVVAGTWPQAPGLSTLGLNIIILPDCLGIGMMLTFNAEALSVEANEQLFKKILEMWKDIPSSIAFECTQRTTGWGQKAIEVRSLQSRVLESELKRRSIKKLRFLCTRGDKLFFTSTLRNHHSRVYFMTLGKLEELQSNYDV

SEQ ID NO: 56948 - protein, 355 aa, Homo sapiens
  Payload ID: 11193
  Gene Symbol: NRK
  Gene Name: Nik related kinase
  ENSP ID: ENSP00000438378
MAGPGGWRDREVTDLGHLPDPTGIFSLDKTIGLGTYGRIYLGLHEKTGAFTAVKVMNARKTPLPEIGRRVRVNKYQKSVGWRYSDEEEDLRTELNLLRKYSFHKNIVSFYGAFFKLSPPGQRHQLWMVMELCAAGSVTDVVRMTSNQSLKEDWIAYICREILQGLAHLHAHRVIHRDIKGQNVLLTHNAEVKLVDFGVSAQVSRTNGRRNSFIGTPYWMAPEVIDCDEDPRRSYDYRSDVWSVGITAIEMAEGAPPLCNLQPLEALFVILRESAPTVKSSGWSRKFHNFMEKCTIKNFLFRPTSANMLQHPFVRDIKNERHVVESLTRHLTGIIKKRQKKGFAVSQDHATALQPG

SEQ ID NO: 56949 - protein, 188 aa, Homo sapiens
  Payload ID: 11193
  Gene Symbol: NRK
  Gene Name: Nik related kinase
  Uniprot ID: Q7Z2Y5
  ENSP ID: ENSP00000438785
MAGPGGWRDREVTDLGHLPDPTGIFSLDKTIGLGTYGRIYLGLHEKTGAFTAVKVMNARKTPLPEIGRRVRVNKYQKSVGWRYSDEEEDLRTELNLLRKYSFHKNIVSFYGAFFKLSPPGQRHQLWMVMELCAAGSVTDVVRMTSNQSLKEDWIAYICREILQPKVIFLGTGCSDSSLKKELCLKHQN

SEQ ID NO: 56950 - protein, 436 aa, Homo sapiens
  Payload ID: 11194
  Gene Symbol: NIM1K
  Gene Name: NIM1 serine/threonine protein kinase
  Uniprot ID: Q8IY84
  ENSP ID: ENSP00000313572
MTAVYMNGGGLVNPHYARWDRRDSVESGCQTESSKEGEEGQPRQLTPFEKLTQDMSQDEKVVREITLGKRIGFYRIRGEIGSGNFSQVKLGIHSLTKEKVAIKILDKTKLDQKTQRLLSREISSMEKLHHPNIIRLYEVVETLSKLHLVMEYAGGGELFGKISTEGKLSEPESKLIFSQIVSAVKHMHENQIIHRDLKAENVFYTSNTCVKVGDFGFSTVSKKGEMLNTFCGSPPYAAPELFRDEHYIGIYVDIWALGVLLYFMVTGTMPFRAETVAKLKKSILEGTYSVPPHVSEPCHRLIRGVLQQIPTERYGIDCIMNDEWMQGVPYPTPLEPFQLDPKHLSETSTLKEEENEVKSTLEHLGITEEHIRNNQGRDARSSITGVYRIILHRVQRKKALESVPVMMLPDPKERDLKKGSRVYRGIRHTSKFCSIL

SEQ ID NO: 56951 - protein, 436 aa, Homo sapiens; identical to SEQ ID NO: 56950
  Payload ID: 11194
  Gene Symbol: NIM1K
  Gene Name: NIM1 serine/threonine protein kinase
  Uniprot ID: Q8IY84
  ENSP ID: ENSP00000420849

SEQ ID NO: 56952 - protein, 1258 aa, Homo sapiens
  Payload ID: 11195
  Gene Symbol: NEK1
  Gene Name: NIMA-related kinase 1
  Uniprot ID: Q96PY6
  ENSP ID: ENSP00000408020
MEKYVRLQKIGEGSFGKAILVKSTEDGRQYVIKEINISRMSSKEREESRREVAVLANMKHPNIVQYRESFEENGSLYIVMDYCEGGDLFKRINAQKGVLFQEDQILDWFVQICLALKHVHDRKILHRDIKSQNIFLTKDGTVQLGDFGIARVLNSTVELARTCIGTPYYLSPEICENKPYNNKSDIWALGCVLYELCTLKHAFEAGSMKNLVLKIISGSFPPVSLHYSYDLRSLVSQLFKRNPRDRPSVNSILEKGFIAKRIEKFLSPQLIAEEFCLKTFSKFGSQPIPAKRPASGQNSISVMPAQKITKPAAKYGIPLAYKKYGDKKLHEKKPLQKHKQAHQTPEKRVNTGEERRKISEEAARKRRLEFIEKEKKQKDQIISLMKAEQMKRQEKERLERINRAREQGWRNVLSAGGSGEVKAPFLGSGGTIAPSSFSSRGQYEHYHAIFDQMQQQRAEDNEAKWKREIYGRGLPERGILPGVRPGFPYGAAGHHHFPDADDIRKTLKRLKAVSKQANANRQKGQLAVERAKQVEEFLQRKREAMQNKARAEGHMVYLARLRQIRLQNFNERQQIKAKLRGEKKEANHSEGQEGSEEADMRRKKIESLKAHANARAAVLKEQLERKRKEAYEREKKVWEEHLVAKGVKSSDVSPPLGQHETGGSPSKQQMRSVISVTSALKEVGVDSSLTDTRETSEEMQKTNNAISSKREILRRLNENLKAQEDEKGKQNLSDTFEINVHEDAKEHEKEKSVSSDRKKWEAGGQLVIPLDELTLDTSFSTTERHTVGEVIKLGPNGSPRRAWGKSPTDSVLKILGEAELQLQTELLENTTIRSEISPEGEKYKPLITGEKKVQCISHEINPSAIVDSPVETKSPEFSEASPQMSLKLEGNLEEPDDLETEILQEPSGTNKDESLPCTITDVWISEEKETKETQSADRITIQENEVSEDGVSSTVDQLSDIHIEPGTNDSQHSKCDVDKSVQPEPFFHKVVHSEHLNLVPQVQSVQCSPEESFAFRSHSHLPPKNKNKNSLLIGLSTGLFDANNPKMLRTCSLPDLSKLFRTLMDVPTVGDVRQDNLEIDEIEDENIKEGPSDSEDIVFEETDTDLQELQASMEQLLREQPGEEYSEEEESVLKNSDVEPTANGTDVADEDDNPSSESALNEEWHSDNSDGEIASECECDSVFNHLEELRLHLEQEMGFEKFFEVYEKIKAIHEDEDENIEICSKIVQNILGNEHQHLYAKILHLVMADGAYQEDNDE

SEQ ID NO: 56953 - protein, 123 aa, Homo sapiens
  Payload ID: 11195
  Gene Symbol: NEK1
  Gene Name: NIMA-related kinase 1
  ENSP ID: ENSP00000421525
  MOD_RES (1)..(1): Any amino acid
XFPPVSLHYSYDLRSLVSQLFKRNPRDRPSVNSILEKGFIAKRIEKFLSPQLIAEEFCLKTFSKFGSQPIPAKRPASGQNSISVMPAQKITKPAAKYGIPLAYKKYGDKKLHEKKPLQKHKQV

SEQ ID NO: 56954 - protein, 1242 aa, Homo sapiens
  Payload ID: 11195
  Gene Symbol: NEK1
  Gene Name: NIMA-related kinase 1
  Uniprot ID: Q96PY6
  ENSP ID: ENSP00000423332
MEKYVRLQKIGEGSFGKAILVKSTEDGRQYVIKEINISRMSSKEREESRREVAVLANMKHPNIVQYRESFEENGSLYIVMDYCEGGDLFKRINAQKGVLFQEDQILDWFVQICLALKHVHDRKILHRDIKSQNIFLTKDGTVQLGDFGIARVLNSTVELARTCIGTPYYLSPEICENKPYNNKSDIWALGCVLYELCTLKHAFEAGSMKNLVLKIISGSFPPVSLHYSYDLRSLVSQLFKRNPRDRPSVNSILEKGFIAKRIEKFLSPQLIAEEFCLKTFSKFGSQPIPAKRPASGQNSISVMPAQKITKPAAKYGIPLAYKKYGDKKLHEKKPLQKHKQAHQTPEKRVNTGEERRKISEEAARKRRLEFIEKEKKQKDQIISLMKAEQMKRQEKERLERINRAREQGWRNVLSAGGSGEVKAPFLGSGGTIAPSSFSSRGQYEHYHAIFDQMQQQRAEDNEAKWKREIYGRGLPERQKGQLAVERAKQVEEFLQRKREAMQNKARAEGHMGILQNLAAMYGGRPSSSRGGKPRNKEEEVYLARLRQIRLQNFNERQQIKAKLRGEKKEANHSEGQEGSEEADMRRKKIESLKAHANARAAVLKEQLERKRKEAYEREKKVWEEHLVAKGVKSSDVSPPLGQHETGGSPSKQQMRSVISVTSALKEVGVDSSLTDTRETSEEMQKTNNAISSKREILRRLNENLKAQEDEKGKQNLSDTFEINVHEDAKEHEKEKSVSSDRKKWEAGGQLVIPLDELTLDTSFSTTERHTVGEVIKLGPNGSPRRAWGKSPTDSVLKILGEAELQLQTELLENTTIRSEISPEGEKYKPLITGEKKVQCISHEINPSAIVDSPVETKSPEFSEASPQMSLKLEGNLEEPDDLETEILQEPSGTNKDESLPCTITDVWISEEKETKETQSADRITIQENEVSEDGVSSTVDQLSDIHIEPGTNDSQHSKCDVDKSVQPEPFFHKVVHSEHLNLVPQVQSVQCSPEESFAFRSHSHLPPKNKNKNSLLIGLSTGLFDANNPKMLRTCSLPDLSKLFRTLMDVPTVGDVRQDNLEIDEIEDENIKEGPSDSEDIVFEETDTDLQELQASMEQLLREQPGEEYSEEEESVLKNSDVEPTANGTDVADEDDNPSSESALNEEWHSDNSDGEIASECECDSVFNHLEELRLHLEQEMGFEKFFEVYEKIKAIHEDEDENIEICSKIVQNILGNEHQHLYAKILHLVMADGAYQEDNDE

SEQ ID NO: 56955 - protein, 45 aa, Homo sapiens
  Payload ID: 11195
  Gene Symbol: NEK1
  Gene Name: NIMA-related kinase 1
  ENSP ID: ENSP00000424152
MEKYVRLQKIGEGSFGKAILVKSTEDGRQYVIKEINISRKMALST

SEQ ID NO: 56956 - protein, 1286 aa, Homo sapiens
  Payload ID: 11195
  Gene Symbol: NEK1
  Gene Name: NIMA-related kinase 1
  Uniprot ID: Q96PY6
  ENSP ID: ENSP00000424757
MEKYVRLQKIGEGSFGKAILVKSTEDGRQYVIKEINISRMSSKEREESRREVAVLANMKHPNIVQYRESFEENGSLYIVMDYCEGGDLFKRINAQKGVLFQEDQILDWFVQICLALKHVHDRKILHRDIKSQNIFLTKDGTVQLGDFGIARVLNSTVELARTCIGTPYYLSPEICENKPYNNKSDIWALGCVLYELCTLKHAFEAGSMKNLVLKIISGSFPPVSLHYSYDLRSLVSQLFKRNPRDRPSVNSILEKGFIAKRIEKFLSPQLIAEEFCLKTFSKFGSQPIPAKRPASGQNSISVMPAQKITKPAAKYGIPLAYKKYGDKKLHEKKPLQKHKQAHQTPEKRVNTGEERRKISEEAARKRRLEFIEKEKKQKDQIISLMKAEQMKRQEKERLERINRAREQGWRNVLSAGGSGEVKAPFLGSGGTIAPSSFSSRGQYEHYHAIFDQMQQQRAEDNEAKWKREIYGRGLPERGILPGVRPGFPYGAAGHHHFPDADDIRKTLKRLKAVSKQANANRQKGQLAVERAKQVEEFLQRKREAMQNKARAEGHMGILQNLAAMYGGRPSSSRGGKPRNKEEEVYLARLRQIRLQNFNERQQIKAKLRGEKKEANHSEGQEGSEEADMRRKKIESLKAHANARAAVLKEQLERKRKEAYEREKKVWEEHLVAKGVKSSDVSPPLGQHETGGSPSKQQMRSVISVTSALKEVGVDSSLTDTRETSEEMQKTNNAISSKREILRRLNENLKAQEDEKGKQNLSDTFEINVHEDAKEHEKEKSVSSDRKKWEAGGQLVIPLDELTLDTSFSTTERHTVGEVIKLGPNGSPRRAWGKSPTDSVLKILGEAELQLQTELLENTTIRSEISPEGEKYKPLITGEKKVQCISHEINPSAIVDSPVETKSPEFSEASPQMSLKLEGNLEEPDDLETEILQEPSGTNKDESLPCTITDVWISEEKETKETQSADRITIQENEVSEDGVSSTVDQLSDIHIEPGTNDSQHSKCDVDKSVQPEPFFHKVVHSEHLNLVPQVQSVQCSPEESFAFRSHSHLPPKNKNKNSLLIGLSTGLFDANNPKMLRTCSLPDLSKLFRTLMDVPTVGDVRQDNLEIDEIEDENIKEGPSDSEDIVFEETDTDLQELQASMEQLLREQPGEEYSEEEESVLKNSDVEPTANGTDVADEDDNPSSESALNEEWHSDNSDGEIASECECDSVFNHLEELRLHLEQEMGFEKFFEVYEKIKAIHEDEDENIEICSKIVQNILGNEHQHLYAKILHLVMADGAYQEDNDE

SEQ ID NO: 56957 - protein, 1189 aa, Homo sapiens
  Payload ID: 11195
  Gene Symbol: NEK1
  Gene Name: NIMA-related kinase 1
  Uniprot ID: Q96PY6
  ENSP ID: ENSP00000424938
MEKYVRLQKIGEGSFGKAILVKSTEDGRQYVIKEINISRMSSKEREESRREVAVLANMKHPNIVQYRESFEENGSLYIVMDYCEGGDLFKRINAQKGVLFQEDQILDWFVQICLALKHVHDRKILHRDIKSQNIFLTKDGTVQLGDFGIARVLNSTVELARTCIGTPYYLSPEICENKPYNNKSDIWALGCVLYELCTLKHAFEAGSMKNLVLKIISGSFPPVSLHYSYDLRSLVSQLFKRNPRDRPSVNSILEKGFIAKRIEKFLSPQLIAEEFCLKTFSKFGSQPIPAKRPASGQNSISVMPAQKITKPAAKYGIPLAYKKYGDKKLHEKKPLQKHKQAHQTPEKRVNTGEERRKISEEAARKRRLEFIEKEKKQKDQIISLMKAEQMKRQEKERAPFLGSGGTIAPSSFSSRGQYEHYHAIFDQMQQQRAEDNEAKWKREIYGRGLPERQKGQLAVERAKQVEEFLQRKREAMQNKARAEGHMVYLARLRQIRLQNFNERQQIKAKLRGEKKEANHSEGQEGSEEADMRRKKIESLKAHANARAAVLKEQLERKRKEAYEREKKVWEEHLVAKGVKSSDVSPPLGQHETGGSPSKQQMRSVISVTSALKEVGVDSSLTDTRETSEEMQKTNNAISSKREILRRLNENLKAQEDEKGKQNLSDTFEINVHEDAKEHEKEKSVSSDRKKWEAGGQLVIPLDELTLDTSFSTTERHTVGEVIKLGPNGSPRRAWGKSPTDSVLKILGEAELQLQTELLENTTIRSEISPEGEKYKPLITGEKKVQCISHEINPSAIVDSPVETKSPEFSEASPQMSLKLEGNLEEPDDLETEILQEPSGTNKDESLPCTITDVWISEEKETKETQSADRITIQENEVSEDGVSSTVDQLSDIHIEPGTNDSQHSKCDVDKSVQPEPFFHKVVHSEHLNLVPQVQSVQCSPEESFAFRSHSHLPPKNKNKNSLLIGLSTGLFDANNPKMLRTCSLPDLSKLFRTLMDVPTVGDVRQDNLEIDEIEDENIKEGPSDSEDIVFEETDTDLQELQASMEQLLREQPGEEYSEEEESVLKNSDVEPTANGTDVADEDDNPSSESALNEEWHSDNSDGEIASECECDSVFNHLEELRLHLEQEMGFEKFFEVYEKIKAIHEDEDENIEICSKIVQNILGNEHQHLYAKILHLVMADGAYQEDNDE

SEQ ID NO: 56958 - protein, 1214 aa, Homo sapiens
  Payload ID: 11195
  Gene Symbol: NEK1
  Gene Name: NIMA-related kinase 1
  Uniprot ID: Q96PY6
  ENSP ID: ENSP00000427653
MEKYVRLQKIGEGSFGKAILVKSTEDGRQYVIKEINISRMSSKEREESRREVAVLANMKHPNIVQYRESFEENGSLYIVMDYCEGGDLFKRINAQKGVLFQEDQILDWFVQICLALKHVHDRKILHRDIKSQNIFLTKDGTVQLGDFGIARVLNSTVELARTCIGTPYYLSPEICENKPYNNKSDIWALGCVLYELCTLKHAFEAGSMKNLVLKIISGSFPPVSLHYSYDLRSLVSQLFKRNPRDRPSVNSILEKGFIAKRIEKFLSPQLIAEEFCLKTFSKFGSQPIPAKRPASGQNSISVMPAQKITKPAAKYGIPLAYKKYGDKKLHEKKPLQKHKQAHQTPEKRVNTGEERRKISEEAARKRRLEFIEKEKKQKDQIISLMKAEQMKRQEKERLERINRAREQGWRNVLSAGGSGEVKAPFLGSGGTIAPSSFSSRGQYEHYHAIFDQMQQQRAEDNEAKWKREIYGRGLPERQKGQLAVERAKQVEEFLQRKREAMQNKARAEGHMVYLARLRQIRLQNFNERQQIKAKLRGEKKEANHSEGQEGSEEADMRRKKIESLKAHANARAAVLKEQLERKRKEAYEREKKVWEEHLVAKGVKSSDVSPPLGQHETGGSPSKQQMRSVISVTSALKEVGVDSSLTDTRETSEEMQKTNNAISSKREILRRLNENLKAQEDEKGKQNLSDTFEINVHEDAKEHEKEKSVSSDRKKWEAGGQLVIPLDELTLDTSFSTTERHTVGEVIKLGPNGSPRRAWGKSPTDSVLKILGEAELQLQTELLENTTIRSEISPEGEKYKPLITGEKKVQCISHEINPSAIVDSPVETKSPEFSEASPQMSLKLEGNLEEPDDLETEILQEPSGTNKDESLPCTITDVWISEEKETKETQSADRITIQENEVSEDGVSSTVDQLSDIHIEPGTNDSQHSKCDVDKSVQPEPFFHKVVHSEHLNLVPQVQSVQCSPEESFAFRSHSHLPPKNKNKNSLLIGLSTGLFDANNPKMLRTCSLPDLSKLFRTLMDVPTVGDVRQDNLEIDEIEDENIKEGPSDSEDIVFEETDTDLQELQASMEQLLREQPGEEYSEEEESVLKNSDVEPTANGTDVADEDDNPSSESALNEEWHSDNSDGEIASECECDSVFNHLEELRLHLEQEMGFEKFFEVYEKIKAIHEDEDENIEICSKIVQNILGNEHQHLYAKILHLVMADGAYQEDNDE

SEQ ID NO: 56959 - protein, 484 aa, Homo sapiens
  Payload ID: 11196
  Gene Symbol: NEK10
  Gene Name: NIMA-related kinase 10
  Uniprot ID: Q6ZWH5
  ENSP ID: ENSP00000295720
MVPVQPAEPPEVLKSEPYGEKADVWAVGCILYQMATLSPPFYSTNMLSLATKIVEAVYEPVPEGIYSEKVTDTISRCLTPDAEARPDIVEVSSMISDVMMKYLDNLSTSQLSLEKKLERERRRTQRYFMEANRNTVTCHHELAVLSHETFEKASLSSSSSGAASLKSELSESADLPPEGFQASYGKDEDRACDEILSDDNFNLENAEKDTYSEVDDELDISDNSSSSSSSPLKESTFNILKRSFSASGGERQSQTRDFTGGTGSRPRPALLPLDLLLKVPPHMLRAHIKEIEAELVTGWQSHSLPAVILRNLKDHGPQMGTFLWQASAGIAVSQRKVRQISDPIQQILIQLHKIIYITQLPPALHHNLKRRVIERFKKSLFSQQSNPCNLKSEIKKLSQGSPEPIEPNFFTADYHLLHRSSGGNSLSPNDPTGLPTSIELEEGITYEQMQTVIEEVLEESGYYNFTSNRYHSYPWGTKNHPTKR

SEQ ID NO: 56960 - protein, 712 aa, Homo sapiens
  Payload ID: 11196
  Gene Symbol: NEK10
  Gene Name: NIMA-related kinase 10
  Uniprot ID: Q6ZWH5
  ENSP ID: ENSP00000343847
MPDQDKKVKTTEKSTDKQQEITIRDYSDLKRLRCLLNVQSSKQQLPAINFDSAQNSMTKSEPAIRAGGHRARGQWHESTEAVELENFSINYKNERNFSKHPQRKLFQEIFTALVKNRLISREWVNRAPSIHFLRVLICLRLLMRDPCYQEILHSLGGIENLAQYMEIVANEYLGYGEEQHTVDKLVNMTYIFQKLAAVKDQREWVTTSGAHKTLVNLLGARDTNVLLGSLLALASLAESQECREKISELNIVENLLMILHEYDLLSKRLTAELLRLLCAEPQVKEQVKLYEGIPVLLSLLHSDHLKLLWSIVWILVQVCEDPETSVEIRIWGGIKQLLHILQGDRNFVSDHSSIGSLSSANAAGRIQQLHLSEDLSPREIQENTFSLQAACCAALTELVLNDTNAHQVVQENGVYTIAKLILPNKQKNAAKSNLLQCYAFRALRFLFSMERNRPLFKRLFPTDLFEIFIDIGHYVRDISAYEELVSKLNLLVEDELKQIAENIESINQNKAPLKYIGNYAILDHLGSGAFGCVYKVRKHSGQNLLAMKEVNLHNPAFGKDKKDRDSSVRNIVSELTIIKEQLYHPNIVRYYKTFLENDRLYIVMELIEGAPLGEHFSSLKEKHHHFTEERLWKIFIQLCLALRYLHKEKRIVHRDLTPNNIMLGDKDKVTVTDFGLAKQKQENSKLTSVVGTILYSCVQHLYLRSPAPALAT

SEQ ID NO: 56961 - protein, 418 aa, Homo sapiens
  Payload ID: 11196
  Gene Symbol: NEK10
  Gene Name: NIMA-related kinase 10
  ENSP ID: ENSP00000373280
PEVLKSEPYGEKADVWAVGCILYQMATLSPPFYSTNMLSLATKIVEAVYEPVPEGIYSEKVTDTISRCLTPDAEARPDIVEVSSMISDVMMKYLDNLSTSQLSLEKKLERERRRTQRYFMEANRNTVTCHHELAVLSHETFEKASLSSSSSGAASLKSELSESADLPPEGFQASYGKDEDRACDEILSDDNFNLENAEKDTYSEVDDELDISDNSSSSSSSPLKESTFNILKRSFSASGGERQSQTRDFTGGTGSRPRPASAGIAVSQRKVRQISDPIQQILIQLHKIIYITQLPPALHHNLKRRVIERFKKSLFSQQSNPCNLKSEIKKLSQGSPEPIEPNFFTADYHLLHRSSGGNSLSPNDPTGLPTSIELEEGITYEQMQTVIEEVLEESGYYNFTSNRYHSYPWGTKNHPTKR

SEQ ID NO: 56962 - protein, 474 aa, Homo sapiens
  Payload ID: 11196
  Gene Symbol: NEK10
  Gene Name: NIMA-related kinase 10
  Uniprot ID: Q6ZWH5
  ENSP ID: ENSP00000373281
MVPVQPAEPPEVLKSEPYGEKADVWAVGCILYQMATLSPPFYSTNMLSLATKIVEAVYEPVPEGIYSEKVTDTISRCLTPDAEARPDIVEVSSMISDVMMKYLDNLSTSQLSLEKKLERERRRTQRYFMEANRNTVTCHHELAVLSHETFEKASLSSSSSGAASLKSELSESADLPPEGFQASYGKDEDRACDEILSDDNFNLENAEKDTYSEVDDELDISDNSSSSSSSPLKESTFNILKRSFSASGGERQSQTRDFTGGTGSRPRPALLPLDLLLKVPPHMLRAHIKEIEAELVTGWQSHSLPAVILRNLKDHASAGIAVSQRKVRQISDPIQQILIQLHKIIYITQLPPALHHNLKRRVIERFKKSLFSQQSNPCNLKSEIKKLSQGSPEPIEPNFFTADYHLLHRSSGGNSLSPNDPTGLPTSIELEEGITYEQMQTVIEEVLEESGYYNFTSNRYHSYPWGTKNHPTKR

SEQ ID NO: 56963 - protein, 196 aa, Homo sapiens
  Payload ID: 11196
  Gene Symbol: NEK10
  Gene Name: NIMA-related kinase 10
  ENSP ID: ENSP00000392344
  MOD_RES (1)..(1): Any amino acid
XIDIGHYVRDISAYEELVSKLNLLVEDELKQIAENIESINQNKAPLKYIGNYAILDHLGSGAFGCVYKLYHPNIVRYYKTFLENDRLYIVMELIEGAPLGEHFSSLKEKHHHFTEERLWKIFIQLCLALRYLHKEKRIVHRDLTPNNIMLGDKDKVTVTDFGLAKQKQENSKLTSVVGTILYSCGFMRRCKETVAG

SEQ ID NO: 56964 - protein, 132 aa, Homo sapiens
  Payload ID: 11196
  Gene Symbol: NEK10
  Gene Name: NIMA-related kinase 10
  ENSP ID: ENSP00000395338
MPDQDKKVKTTEKSTDKQQEITIRDYSDLKRLRCLLNVQSSKQQLPAINFDSAQNSMTKSEPAIRAGGHRARGQWHESTEAVELENFSINYKNERNFSKHPQRKLFQEIFTALVKNRLISREWVNRAPSIHF

SEQ ID NO: 56965 - protein, 1172 aa, Homo sapiens
  Payload ID: 11196
  Gene Symbol: NEK10
  Gene Name: NIMA-related kinase 10
  Uniprot ID: Q6ZWH5
  ENSP ID: ENSP00000395849
MPDQDKKVKTTEKSTDKQQEITIRDYSDLKRLRCLLNVQSSKQQLPAINFDSAQNSMTKSEPAIRAGGHRARGQWHESTEAVELENFSINYKNERNFSKHPQRKLFQEIFTALVKNRLISREWVNRAPSIHFLRVLICLRLLMRDPCYQEILHSLGGIENLAQYMEIVANEYLGYGEEQHTVDKLVNMTYIFQKLAAVKDQREWVTTSGAHKTLVNLLGARDTNVLLGSLLALASLAESQECREKISELNIVENLLMILHEYDLLSKRLTAELLRLLCAEPQVKEQVKLYEGIPVLLSLLHSDHLKLLWSIVWILVQVCEDPETSVEIRIWGGIKQLLHILQGDRNFVSDHSSIGSLSSANAAGRIQQLHLSEDLSPREIQENTFSLQAACCAALTELVLNDTNAHQVVQENGVYTIAKLILPNKQKNAAKSNLLQCYAFRALRFLFSMERNRPLFKRLFPTDLFEIFIDIGHYVRDISAYEELVSKLNLLVEDELKQIAENIESINQNKAPLKYIGNYAILDHLGSGAFGCVYKVRKHSGQNLLAMKEVNLHNPAFGKDKKDRDSSVRNIVSELTIIKEQLYHPNIVRYYKTFLENDRLYIVMELIEGAPLGEHFSSLKEKHHHFTEERLWKIFIQLCLALRYLHKEKRIVHRDLTPNNIMLGDKDKVTVTDFGLAKQKQENSKLTSVVGTILYSCPEVLKSEPYGEKADVWAVGCILYQMATLSPPFYSTNMLSLATKIVEAVYEPVPEGIYSEKVTDTISRCLTPDAEARPDIVEVSSMISDVMMKYLDNLSTSQLSLEKKLERERRRTQRYFMEANRNTVTCHHELAVLSHETFEKASLSSSSSGAASLKSELSESADLPPEGFQASYGKDEDRACDEILSDDNFNLENAEKDTYSEVDDELDISDNSSSSSSSPLKESTFNILKRSFSASGGERQSQTRDFTGGTGSRPRPALLPLDLLLKVPPHMLRAHIKEIEAELVTGWQSHSLPAVILRNLKDHGPQMGTFLWQASAGIAVSQRKVRQISDPIQQILIQLHKIIYITQLPPALHHNLKRRVIERFKKSLFSQQSNPCNLKSEIKKLSQGSPEPIEPNFFTADYHLLHRSSGGNSLSPNDPTGLPTSIELEEGITYEQMQTVIEEVLEESGYYNFTSNRYHSYPWGTKNHPTKR

SEQ ID NO: 56966 - protein, 166 aa, Homo sapiens
  Payload ID: 11196
  Gene Symbol: NEK10
  Gene Name: NIMA-related kinase 10
  ENSP ID: ENSP00000412651
  MOD_RES (1)..(1): Any amino acid
XLAMKEVNLHNPAFGKDKKDRDSSVRNIVSELTIIKEQLYHPNIVRYYKTFLENDRLYIVMELIEGAPLGEHFSSLKEKHHHFTEERLWKIFIQLCLALRYLHKEKRIVHRDLTPNNIMLGDKDKVTVTDFGLAKQKQENSKLTSVVGTILYSCGFMRRCKETVAG

SEQ ID NO: 56967 - protein, 470 aa, Homo sapiens
  Payload ID: 11197
  Gene Symbol: NEK11
  Gene Name: NIMA-related kinase 11
  Uniprot ID: Q8NG66
  ENSP ID: ENSP00000349389
MLKFQEAAKCVSGSTAISTYPKTLIARRYVLQQKLGSGSFGTVYLVSDKKAKRGEELKVLKEISVGELNPNETVQANLEAQLLSKLDHPAIVKFHASFVEQDNFCIITEYCEGRDLDDKIQEYKQAGKIFPENQIIEWFIQLLLGVDYMHERRILHRDLKSKNVFLKNNLLKIGDFGVSRLLMGSCDLATTLTGTPHYMSPEALKHQGYDTKSDIWSLACILYEMCCMNHAFAGSNFLSIVLKIVEGDTPSLPERYPKELNAIMESMLNKNPSLRPSAIEILKIPYLDEQLQNLMCRYSEMTLEDKNLDCQKEAAHIINAMQKRIHLQTLRALSEVQKMTPRERMRLRKLQAADEKARKLKKIVEEKYEENSKRMQELRSRNFQQLSVDVLHEKTHLKGMEEKEEQPEGRLSCSPQDEDEERWQGREEESDEPTLENLPESQPIPSMDLHELESIVEDATSDLGYHATHS

SEQ ID NO: 56968 - protein, 645 aa, Homo sapiens
  Payload ID: 11197
  Gene Symbol: NEK11
  Gene Name: NIMA-related kinase 11
  Uniprot ID: Q8NG66
  ENSP ID: ENSP00000372857
MLKFQEAAKCVSGSTAISTYPKTLIARRYVLQQKLGSGSFGTVYLVSDKKAKRGEELKVLKEISVGELNPNETVQANLEAQLLSKLDHPAIVKFHASFVEQDNFCIITEYCEGRDLDDKIQEYKQAGKIFPENQIIEWFIQLLLGVDYMHERRILHRDLKSKNVFLKNNLLKIGDFGVSRLLMGSCDLATTLTGTPHYMSPEALKHQGYDTKSDIWSLACILYEMCCMNHAFAGSNFLSIVLKIVEGDTPSLPERYPKELNAIMESMLNKNPSLRPSAIEILKIPYLDEQLQNLMCRYSEMTLEDKNLDCQKEAAHIINAMQKRIHLQTLRALSEVQKMTPRERMRLRKLQAADEKARKLKKIVEEKYEENSKRMQELRSRNFQQLSVDVLHEKTHLKGMEEKEEQPEGRLSCSPQDEDEERWQGREEESDEPTLENLPESQPIPSMDLHELESIVEDATSDLGYHEIPEDPLVAEEYYADAFDSYCEESDEEEEEIALERPEKEIRNEGSQPAYRTNQQDSDIEALARCLENVLGCTSLDTKTITTMAEDMSPGPPIFNSVMARTKMKRMRESAMQKLGTEVFEEVYNYLKRARHQNASEAEIRECLEKVVPQASDCFEVDQLLYFEEQLLITMGKEPTLQNHL

SEQ ID NO: 56969 - protein, 79 aa, Homo sapiens
  Payload ID: 11197
  Gene Symbol: NEK11
  Gene Name: NIMA-related kinase 11
  ENSP ID: ENSP00000421192
MLKFQEAAKCVSGSTAISTYPKTLIARRYVLQQKLGSGSFGTVYLVSDKKAKRGEELAEIWTIKFRNINKLEKSFQKIK

SEQ ID NO: 56970 - protein, 540 aa, Homo sapiens
  Payload ID: 11197
  Gene Symbol: NEK11
  Gene Name: NIMA-related kinase 11
  ENSP ID: ENSP00000421549
MLKFQEAAKCVSGSTAISTYPKTLIARRYVLQQKLGSGSFGTVYLVSDKKAKRGEELKVLKEISVGELNPNETVQANLEAQLLSKLDHPAIVKFHASFVEQDNFCIITEYCEGRDLDDKIQEYKQAGKIFPENQIIEWFIQLLLGVDYMHERRILHRDLKSKNVFLKNNLLKIGDFGVSRLLMGSCDLATTLTGTPHYMSPEALKHQGYDTKSDIWQKRIHLQTLRALSEVQKMTPRERMRLRKLQAADEKARKLKKIVEEKYEENSKRMQELRSRNFQQLSVDVLHEKTHLKGMEEKEEQPEGRLSCSPQDEDEERWQGREEESDEPTLENLPESQPIPSMDLHELESIVEDATSDLGYHEIPEDPLVAEEYYADAFDSYCEESDEEEEEIALERPEKEIRNEGSQPAYRTNQQDSDIEALARCLENVLGCTSLDTKTITTMAEDMSPGPPIFNSVMARTKMKRMRESAMQKLGTEVFEEVYNYLKRARHQNASEAEIRECLEKVVPQASDCFEVDQLLYFEEQLLITMGKEPTLQNHL

SEQ ID NO: 56971 - protein, 645 aa, Homo sapiens; identical to SEQ ID NO: 56968
  Payload ID: 11197
  Gene Symbol: NEK11
  Gene Name: NIMA-related kinase 11
  Uniprot ID: Q8NG66
  ENSP ID: ENSP00000421851

SEQ ID NO: 56972 - protein, 599 aa, Homo sapiens
  Payload ID: 11197
  Gene Symbol: NEK11
  Gene Name: NIMA-related kinase 11
  Uniprot ID: Q8NG66
  ENSP ID: ENSP00000423458
MLKFQEAAKCVSGSTAISTYPKTLIARRYVLQQKLGSGSFGTVYLVSDKKAKRGEELKVLKEISVGELNPNETVQANLEAQLLSKLDHPAIVKFHASFVEQDNFCIITEYCEGRDLDDKIQEYKQAGKIFPENQIIEWFIQLLLGVDYMHERRILHRDLKSKNVFLKNNLLKIGDFGVSRLLMGSCDLATTLTGTPHYMSPEALKHQGYDTKSDIWSLACILYEMCCMNHAFAGSNFLSIVLKIVEGDTPSLPERYPKELNAIMESMLNKNPSLRPSAIEILKIPYLDEQLQNLMCRYSEMTLEDKNLDCQKEAAHIINAMQKRIHLQTLRALSEVQKMTPRERMRLRKLQAADEKARKLKKIVEEKYEENSKRMQELRSRNFQQLSVDVLHEKTHLKGMEEKEEQPEGRLSCSPQDEDEERWQGREEESDEPTLENLPESQPIPSMDLHELESIVEDATSDLGYHEIPEDPLVAEEYYADAFDSYCEESDEEEEEIALERPEKEIRNEGSQPAYRTNQQDSDIEALARCLENVLGCTSLDQPCRSWGQKYLKRSIITSREQGIRMLAKQRSASVWKKWCLKPATVLKWTSSCTLKSSC

SEQ ID NO: 56973 - protein, 470 aa, Homo sapiens; identical to SEQ ID NO: 56967
  Payload ID: 11197
  Gene Symbol: NEK11
  Gene Name: NIMA-related kinase 11
  Uniprot ID: Q8NG66
  ENSP ID: ENSP00000425114

SEQ ID NO: 56974 - protein, 212 aa, Homo sapiens
  Payload ID: 11197
  Gene Symbol: NEK11
  Gene Name: NIMA-related kinase 11
  ENSP ID: ENSP00000425662
MLKFQEAAKCVSGSTAISTYPKTLIARRYVLQQKLGSGSFGTVYLVSDKKAKRGEELKVLKEISVGELNPNETVQANLEAQLLSKLDHPAIVKFHASFVEQDNFCIITEYCEGRDLDDKIQEYKQAGKIFPENQIIEWFIQLLLGVDYMHERRILHRDLKSKNVFLKNNLLKIATGSSNHHIGCTWGRKEGRNKSVQLVRRFWSFSTSNGIL

SEQ ID NO: 56975 - protein, 482 aa, Homo sapiens
  Payload ID: 11197
  Gene Symbol: NEK11
  Gene Name: NIMA-related kinase 11
  Uniprot ID: Q8NG66
  ENSP ID: ENSP00000426662
MLKFQEAAKCVSGSTAISTYPKTLIARRYVLQQKLGSGSFGTVYLVSDKKAKRGEELKVLKEISVGELNPNETVQANLEAQLLSKLDHPAIVKFHASFVEQDNFCIITEYCEGRDLDDKIQEYKQAGKIFPENQIIEWFIQLLLGVDYMHERRILHRDLKSKNVFLKNNLLKIGDFGVSRLLMGSCDLATTLTGTPHYMSPEALKHQGYDTKSDIWSLACILYEMCCMNHAFAGSNFLSIVLKIVEGDTPSLPERYPKELNAIMESMLNKNPSLRPSAIEILKIPYLDEQLQNLMCRYSEMTLEDKNLDCQKEAAHIINAMQKRIHLQTLRALSEVQKMTPRERMRLRKLQAADEKARKLKKIVEEKYEENSKRMQELRSRNFQQLSVDVLHEKTHLKGMEEKEEQPEGRLSCSPQDEDEERWQGREEESDEPTLENLPESQPIPSMDLHELESIVEDATSDLGYHGDCNLISLDEYWKNEK

SEQ ID NO: 56976 - protein, 220 aa, Homo sapiens
  Payload ID: 11197
  Gene Symbol: NEK11
  Gene Name: NIMA-related kinase 11
  ENSP ID: ENSP00000473422
  MOD_RES (1)..(1): Any amino acid
XKVLKEISVGELNPNETVQANLEAQLLSKLDHPAIVKFHASFVEQDNFCIITEYCEGRDLDDKIQEYKQAGKIFPENQIIEWFIQLLLGVDYMHERRILHRDLKSKNVFLKNNLLKIGDFGVSRLLMGSCDLATTLTGTPHYMSPEALKHQGYDTKSDIWSLACILYEMCCMNHAFAGSNFLSIVLKIVEGDTPSLPERYPKELNAIMERYRNKHVVTEI

SEQ ID NO: 56977 - protein, 384 aa, Homo sapiens
  Payload ID: 11198
  Gene Symbol: NEK2
  Gene Name: NIMA-related kinase 2
  Uniprot ID: P51955
  ENSP ID: ENSP00000355965
MPSRAEDYEVLYTIGTGSYGRCQKIRRKSDGKILVWKELDYGSMTEAEKQMLVSEVNLLRELKHPNIVRYYDRIIDRTNTTLYIVMEYCEGGDLASVITKGTKERQYLDEEFVLRVMTQLTLALKECHRRSDGGHTVLHRDLKPANVFLDGKQNVKLGDFGLARILNHDTSFAKTFVGTPYYMSPEQMNRMSYNEKSDIWSLGCLLYELCALMPPFTAFSQKELAGKIREGKFRRIPYRYSDELNEIITRMLNLKDYHRPSVEEILENPLIADLVADEQRRNLERRGRQLGEPEKSQDSSPVLSELKLKEIQLQERERALKAREERLEQKEQELCVRERLAEDKLARAENLLKNYSLLKERKFLSLASNPGMRINLVNRSWCYK

SEQ ID NO: 56978 - protein, 445 aa, Homo sapiens
  Payload ID: 11198
  Gene Symbol: NEK2
  Gene Name: NIMA-related kinase 2
  Uniprot ID: P51955
  ENSP ID: ENSP00000355966
MPSRAEDYEVLYTIGTGSYGRCQKIRRKSDGKILVWKELDYGSMTEAEKQMLVSEVNLLRELKHPNIVRYYDRIIDRTNTTLYIVMEYCEGGDLASVITKGTKERQYLDEEFVLRVMTQLTLALKECHRRSDGGHTVLHRDLKPANVFLDGKQNVKLGDFGLARILNHDTSFAKTFVGTPYYMSPEQMNRMSYNEKSDIWSLGCLLYELCALMPPFTAFSQKELAGKIREGKFRRIPYRYSDELNEIITRMLNLKDYHRPSVEEILENPLIADLVADEQRRNLERRGRQLGEPEKSQDSSPVLSELKLKEIQLQERERALKAREERLEQKEQELCVRERLAEDKLARAENLLKNYSLLKERKFLSLASNPELLNLPSSVIKKKVHFSGESKENIMRSENSESQLTSKSKCKDLKKRLHAAQLRAQALSDIEKNYQLKSRQILGMR

SEQ ID NO: 56979 - protein, 388 aa, Homo sapiens
  Payload ID: 11198
  Gene Symbol: NEK2
  Gene Name: NIMA-related kinase 2
  ENSP ID: ENSP00000440237
MPSRAEDYEVLYTIGTGSYGRCQKIRRKSDGKILVWKELDYGSMTEAEKQMLVSEVNLLRELKHPNIVRYYDRIIDRTNTTLYIVMEYCEGGDLASVITKGTKERQYLDEEFVLRVMTQLTLALKECHRRSDGGHTVLHRDLKPANVFLDGKQNVKLGDFGLARILNHDTSFAKTFVGTPYYMSPEQMNRMSYNEKSDIWSLGCLLYELCALMPPFTAFSQKELAGKIREGKFRRIPYRYSDELNEIITRMLNLKDYHRPSVEEILENPLIADLVADEQRRNLERRGRQLGEPEKSQDSSPVLSELKLKEIQLQERERALKAREERLEQKEQELCVRERLAEDKLARAENLLKNYSLLKERKFLSLASNPESHFVAQAGMQWCDHSSM

SEQ ID NO: 56980 - protein, 46 aa, Homo sapiens
  Payload ID: 11199
  Gene Symbol: NEK3
  Gene Name: NIMA-related kinase 3
  ENSP ID: ENSP00000447995
MDDYMVLRMIGEGSFGRALLVQHESSNQMFAMKEIRLPKLKDTCIL

SEQ ID NO: 56981 - protein, 58 aa, Homo sapiens
  Payload ID: 11199
  Gene Symbol: NEK3
  Gene Name: NIMA-related kinase 3
  ENSP ID: ENSP00000449679
MDDYMVLRMIGEGSFGRALLVQHESSNQMFAMKEIRLPKSFSNTQNSRKEAVLLAKMK

SEQ ID NO: 56982 - protein, 506 aa, Homo sapiens
  Payload ID: 11199
  Gene Symbol: NEK3
  Gene Name: NIMA-related kinase 3
  Uniprot ID: P51956
  ENSP ID: ENSP00000480328
MDDYMVLRMIGEGSFGRALLVQHESSNQMFAMKEIRLPKSFSNTQNSRKEAVLLAKMKHPNIVAFKESFEAEGHLYIVMEYCDGGDLMQKIKQQKGKLFPEDMILNWFTQMCLGVNHIHKKRVLHRDIKSKNIFLTQNGKVKLGDFGSARLLSNPMAFACTYVGTPYYVPPEIWENLPYNNKSDIWSLGCILYELCTLKHPFQANSWKNLILKVCQGCISPLPSHYSYELQFLVKQMFKRNPSHRPSATTLLSRGIVARLVQKCLPPEIIMEYGEEVLEEIKNSKHNTPRKKTNPSRIRIALGNEASTVQEEEQDRKGSHTDLESINENLVESALRRVNREEKGNKSVHLRKASSPNLHRRQWEKNVPNTALTALENASILTSSLTAEDDRGGSVIKYSKNTTRKQWLKETPDTLLNILKNADLSLAFQTYTIYRPGSEGFLKGPLSEETEASDSVDGGHDSVILDPERLEPGLDEEDTDFEEEDDNPDWVSELKKRAGWQGLCDR

SEQ ID NO: 56983 - protein, 497 aa, Homo sapiens
  Payload ID: 11199
  Gene Symbol: NEK3
  Gene Name: NIMA-related kinase 3
  ENSP ID: ENSP00000481533
MDDYMVLRMIGEGSFGRALLVQHESSNQMFAMKEIRLPKSFSNTQNSRKEAVLLAKMKHPNIVAFKESFEAEGHLYIVMEYCDGGDLMQKIKQQKGKLFPEDMILNWFTQMCLGVNHIHKKRVLHRDIKSKNIFLTQNGKVKLGDFGSARLLSNPMAFACTYVGTPYYVPPEIWENLPYNNKSDIWSLGCILYELCTLKHPFQANSWKNLILKVCQGCISPLPSHYSYELQFLVKQMFKRNPSHRPSATTLLSRGIVARLVQKCLPPEIIMEYGEEVLEEIKNSKHNTPRKKTNPSRIRIALGNEASTVQEEEQDRKGSHTDLESINENLVESALRRVNREEKASSPNLHRRQWEKNVPNTALTALENASILTSSLTAEDDRGGSVIKYSKNTTRKQWLKETPDTLLNILKNADLSLAFQTYTIYRPGSEGFLKGPLSEETEASDSVDGGHDSVILDPERLEPGLDEEDTDFEEEDDNPDWVSELKKRAGWQGLCDR

SEQ ID NO: 56984 - protein, 181 aa, Homo sapiens
  Payload ID: 11199
  Gene Symbol: NEK3
  Gene Name: NIMA-related kinase 3
  ENSP ID: ENSP00000483058
  MOD_RES (1)..(1): Any amino acid
XEYGEEVLEEIKNSKHNTPRKKTNPSRIRIALGNEASTVQEEEQDRKGSHTDLESINENLVESALRRVNREEKGNKSVHLRKASSPNLHRRQWEKNVPNTALTALENASILTSSLTAEDDRGSEGFLKGPLSEETEASDSVDGGHDSVILDPERLEPGLDEEDTDFEEEDDNPDWVSELKK

SEQ ID NO: 56985 - protein, 489 aa, Homo sapiens
  Payload ID: 11199
  Gene Symbol: NEK3
  Gene Name: NIMA-related kinase 3
  Uniprot ID: P51956
  ENSP ID: ENSP00000484086
MDDYMVLRMIGEGSFGRALLVQHESSNQMFAMKEIRLPKSFSNTQNSRKEAVLLAKMKHPNIVAFKESFEAEGHLYIVMEYCDGGDLMQKIKQQKGKLFPEDMILNWFTQMCLGVNHIHKKRVLHRDIKSKNIFLTQNGKVKLGDFGSARLLSNPMAFACTYVGTPYYVPPEIWENLPYNNKSDIWSLGCILYELCTLKHPFQANSWKNLILKVCQGCISPLPSHYSYELQFLVKQMFKRNPSHRPSATTLLSRGIVARLVQKCLPPEIIMEYGEEVLEEIKNSKHNTPRKKQEEEQDRKGSHTDLESINENLVESALRRVNREEKGNKSVHLRKASSPNLHRRQWEKNVPNTALTALENASILTSSLTAEDDRGGSVIKYSKNTTRKQWLKETPDTLLNILKNADLSLAFQTYTIYRPGSEGFLKGPLSEETEASDSVDGGHDSVILDPERLEPGLDEEDTDFEEEDDNPDWVSELKKRAGWQGLCDR

SEQ ID NO: 56986 - protein, 506 aa, Homo sapiens; identical to SEQ ID NO: 56982
  Payload ID: 11199
  Gene Symbol: NEK3
  Gene Name: NIMA-related kinase 3
  Uniprot ID: P51956
  ENSP ID: ENSP00000484443

SEQ ID NO: 56987 - protein, 298 aa, Homo sapiens
  Payload ID: 11199
  Gene Symbol: NEK3
  Gene Name: NIMA-related kinase 3
  ENSP ID: ENSP00000484594
MDDYMVLRMIGEGSFGRALLVQHESSNQMFAMKEIRLPKSFSNTQNSRKEAVLLAKMKHPNIVAFKESFEAEGHLYIVMEYCDGGDLMQKIKQQKGKLFPEDMILNWFTQMCLGVNHIHKKRVLHRDIKSKNIFLTQNGKVKLGDFGSARLLSNPMAFACTYVGTPYYVPPEIWENLPYNNKSDIWSLGCILYELCTLKHPFQANSWKNLILKVCQGCISPLPSHYSYELQFLVKQMFKRNPSHRPSATTLLSRGIVARLVQKCLPPEIIMEYGEEVLEEIKNSKHNTPRKKTRGRTR

SEQ ID NO: 56988 - protein, 46 aa, Homo sapiens; identical to SEQ ID NO: 56980
  Payload ID: 11199
  Gene Symbol: NEK3
  Gene Name: NIMA-related kinase 3
  ENSP ID: ENSP00000487230

SEQ ID NO: 56989 - protein, 841 aa, Homo sapiens
  Payload ID: 11200
  Gene Symbol: NEK4
  Gene Name: NIMA-related kinase 4
  Uniprot ID: P51957
  ENSP ID: ENSP00000233027
MPLAAYCYLRVVGKGSYGEVTLVKHRRDGKQYVIKKLNLRNASSRERRAAEQEAQLLSQLKHPNIVTYKESWEGGDGLLYIVMGFCEGGDLYRKLKEQKGQLLPENQVVEWFVQIAMALQYLHEKHILHRDLKTQNVFLTRTNIIKVGDLGIARVLENHCDMASTLIGTPYYMSPELFSNKPYNYKSDVWALGCCVYEMATLKHAFNAKDMNSLVYRIIEGKLPPMPRDYSPELAELIRTMLSKRPEERPSVRSILRQPYIKRQISFFLEATKIKTSKNNIKNGDSQSKPFATVVSGEAESNHEVIHPQPLSSEGSQTYIMGEGKCLSQEKPRASGLLKSPASLKAHTCKQDLSNTTELATISSVNIDILPAKGRDSVSDGFVQENQPRYLDASNELGGICSISQVEEEMLQDNTKSSAQPENLIPMWSSDIVTGEKNEPVKPLQPLIKEQKPKDQSLALSPKLECSGTILAHSNLRLLGSSDSPASASRVAGITGVCHHAQDQVAGECIIEKQGRIHPDLQPHNSGSEPSLSRQRRQKRREQTEHRGEKRQVRRDLFAFQESPPRFLPSHPIVGKVDVTSTQKEAENQRRVVTGSVSSSRSSEMSSSKDRPLSARERRRLKQSQEEMSSSGPSVRKASLSVAGPGKPQEEDQPLPARRLSSDCSVTQERKQIHCLSEDELSSSTSSTDKSDGDYGEGKGQTNEINALVQLMTQTLKLDSKESCEDVPVANPVSEFKLHRKYRDTLILHGKVAEEAEEIHFKELPSAIMPGSEKIRRLVEVLRTDVIRGLGVQLLEQVYDLLEEEDEFDREVRLREHMGEKYTTYSVKARQLKFFEENMNF

SEQ ID NO: 56990 - protein, 781 aa, Homo sapiens
  Payload ID: 11200
  Gene Symbol: NEK4
  Gene Name: NIMA-related kinase 4
  Uniprot ID: P51957
  ENSP ID: ENSP00000373227
MPLAAYCYLRVVGKGSYGEVTLVKHRRDGKQYVIKKLNLRNASSRERRAAEQEAQLLSQLKHPNIVTYKESWEGGDGLLYIVMGFCEGGDLYRKLKEQKGQLLPENQVVEWFVQIAMALQYLHEKHILHRDLKTQNVFLTRTNIIKVGDLGIARVLENHCDMASTLIGTPYYMSPELFSNKPYNYKSDVWALGCCVYEMATLKHAFNAKDMNSLVYRIIEGKLPPMPRDYSPELAELIRTMLSKRPEERPSVRSILRQPYIKRQISFFLEATKIKTSKNNIKNGDSQSKPFATVVSGEAESNHEVIHPQPLSSEGSQTYIMGEGKCLSQEKPRASGLLKSPASLKAHTCKQDLSNTTELATISSVNIDILPAKGRDSVSDGFVQENQPRYLDASNELGGICSISQVEEEMLQDNTKSSAQPENLIPMWSSDIVTGEKNEPVKPLQPLIKEQKPKDQDQVAGECIIEKQGRIHPDLQPHNSGSEPSLSRQRRQKRREQTEHRGEKRQVRRDLFAFQESPPRFLPSHPIVGKVDVTSTQKEAENQRRVVTGSVSSSRSSEMSSSKDRPLSARERRRLKQSQEEMSSSGPSVRKASLSVAGPGKPQEEDQPLPARRLSSDCSVTQERKQIHCLSEDELSSSTSSTDKSDGDYGEGKGQTNEINALVQLMTQTLKLDSKESCEDVPVANPVSEFKLHRKYRDTLILHGKVAEEAEEIHFKELPSAIMPGSEKIRRLVEVLRTDVIRGLGVQLLEQVYDLLEEEDEFDREVSVSLTVSRCLCYRIF

SEQ ID NO: 56991 - protein, 37 aa, Homo sapiens
  Payload ID: 11200
  Gene Symbol: NEK4
  Gene Name: NIMA-related kinase 4
  ENSP ID: ENSP00000417119
MPLAAYCYLRVVGKGSYGEVTLVKHRRDGKQPRAASC

SEQ ID NO: 56992 - protein, 722 aa, Homo sapiens
  Payload ID: 11200
  Gene Symbol: NEK4
  Gene Name: NIMA-related kinase 4
  ENSP ID: ENSP00000419666
MPLAAYCYLRVVGKGSYGEVTLVKHRRDGKQYLHEKHILHRDLKTQNVFLTRTNIIKVGDLGIARVLENHCDMASTLIGTPYYMSPELFSNKPYNYKSDVWALGCCVYEMATLKHAFNAKDMNSLVYRIIEGKLPPMPRDYSPELAELIRTMLSKRPEERPSVRSILRQPYIKRQISFFLEATKIKTSKNNIKNGDSQSKPFATVVSGEAESNHEVIHPQPLSSEGSQTYIMGEGKCLSQEKPRASGLLKSPASLKAHTCKQDLSNTTELATISSVNIDILPAKGRDSVSDGFVQENQPRYLDASNELGGICSISQVEEEMLQDNTKSSAQPENLIPMWSSDIVTGEKNEPVKPLQPLIKEQKPKDQSLALSPKLECSGTILAHSNLRLLGSSDSPASASRVAGITGVCHHAQDQVAGECIIEKQGRIHPDLQPHNSGSEPSLSRQRRQKRREQTEHRGEKRQVRRDLFAFQESPPRFLPSHPIVGKVDVTSTQKEAENQRRVVTGSVSSSRSSEMSSSKDRPLSARERRRLKQSQEEMSSSGPSVRKASLSVAGPGKPQEEDQPLPARRLSSDCSVTQERKQIHCLSEDELSSSTSSTDKSDGDYGEGKGQTNEINALVQLMTQTLKLDSKESCEDVPVANPVSEFKLHRKYRDTLILHGKVAEEAEEIHFKELPSAIMPGSEKIRRLVEVLRTDVIRGLGVQLLEQVYDLLEEEDEFDRE

SEQ ID NO: 56993 - protein, 142 aa, Homo sapiens
  Payload ID: 11200
  Gene Symbol: NEK4
  Gene Name: NIMA-related kinase 4
  ENSP ID: ENSP00000420231
  MOD_RES (1)..(1): Any amino acid
XLQDNTKSSAQPENLIPMWSSDIVTGEKNEPVKPLQPLIKEQKPKDQSLALSPKLECSGTILAHSNLRLLGSSDSPASASRVAGITGVCHHAQMESHSVAQAGVQWCDLSLLQPPPPGFKQFFYLSLLSSWDYRIKLLVNVL

SEQ ID NO: 56994 - protein, 752 aa, Homo sapiens
  Payload ID: 11200
  Gene Symbol: NEK4
  Gene Name: NIMA-related kinase 4
  Uniprot ID: P51957
  ENSP ID: ENSP00000437703
MPLAAYCYLRVVGKGSYGEVTLVKHRRDGKQYLHEKHILHRDLKTQNVFLTRTNIIKVGDLGIARVLENHCDMASTLIGTPYYMSPELFSNKPYNYKSDVWALGCCVYEMATLKHAFNAKDMNSLVYRIIEGKLPPMPRDYSPELAELIRTMLSKRPEERPSVRSILRQPYIKRQISFFLEATKIKTSKNNIKNGDSQSKPFATVVSGEAESNHEVIHPQPLSSEGSQTYIMGEGKCLSQEKPRASGLLKSPASLKAHTCKQDLSNTTELATISSVNIDILPAKGRDSVSDGFVQENQPRYLDASNELGGICSISQVEEEMLQDNTKSSAQPENLIPMWSSDIVTGEKNEPVKPLQPLIKEQKPKDQSLALSPKLECSGTILAHSNLRLLGSSDSPASASRVAGITGVCHHAQDQVAGECIIEKQGRIHPDLQPHNSGSEPSLSRQRRQKRREQTEHRGEKRQVRRDLFAFQESPPRFLPSHPIVGKVDVTSTQKEAENQRRVVTGSVSSSRSSEMSSSKDRPLSARERRRLKQSQEEMSSSGPSVRKASLSVAGPGKPQEEDQPLPARRLSSDCSVTQERKQIHCLSEDELSSSTSSTDKSDGDYGEGKGQTNEINALVQLMTQTLKLDSKESCEDVPVANPVSEFKLHRKYRDTLILHGKVAEEAEEIHFKELPSAIMPGSEKIRRLVEVLRTDVIRGLGVQLLEQVYDLLEEEDEFDREVRLREHMGEKYTTYSVKARQLKFFEENMNF

SEQ ID NO: 56995 - protein, 708 aa, Homo sapiens
  Payload ID: 11201
  Gene Symbol: NEK5
  Gene Name: NIMA-related kinase 5
  Uniprot ID: Q6P3R8
  ENSP ID: ENSP00000347767
MDKYDVIKAIGQGAFGKAYLAKGKSDSKHCVIKEINFEKMPIQEKEASKKEVILLEKMKHPNIVAFFNSFQENGRLFIVMEYCDGGDLMKRINRQRGVLFSEDQILGWFVQISLGLKHIHDRKILHRDIKAQNIFLSKNGMVAKLGDFGIARVLNNSMELARTCIGTPYYLSPEICQNKPYNNKTDIWSLGCVLYELCTLKHPFEGNNLQQLVLKICQAHFAPISPGFSRELHSLISQLFQVSPRDRPSINSILKRPFLENLIPKYLTPEVIQEEFSHMLICRAGAPASRHAGKVVQKCKIQKVRFQGKCPPRSRISVPIKRNAILHRNEWRPPAGAQKARSIKMIERPKIAAVCGHYDYYYAQLDMLRRRAHKPSYHPIPQENTGVEDYGQETRHGPSPSQWPAEYLQRKFEAQQYKLKVEKQLGLRPSSAEPNYNQRQELRSNGEEPRFQELPFRKNEMKEQEYWKQLEEIRQQYHNDMKEIRKKMGREPEENSKISHKTYLVKKSNLPVHQDASEGEAPVQMEFRSCCPGWSAMARSWLTATSASQDIEKDLKQMRLQNTKESKNPEQKYKAKKGVKFEINLDKCISDENILQEEEAMDIPNETLTFEDGMKFKEYECVKEHGDYTDKAFEKLHCPEAGFSTQTVAAVGNRRQWDGGAPQTLLQMMAVADITSTCPTGPDSESVLSVSRQEGKTKDPYSPVLILM

SEQ ID NO: 56996 - protein, 295 aa, Homo sapiens
  Payload ID: 11201
  Gene Symbol: NEK5
  Gene Name: NIMA-related kinase 5
  ENSP ID: ENSP00000431956
MDKYDVIKAIGQGAFGKAYLAKGKSDSKHCVIKEINFEKMPIQEKEASKKEVILLEKMKHPNIVAFFNSFQENGRLFIVMEYCDGGDLMKRINRQRGVLFSEDQILGWFVQISLGLKHIHDRKILHRDIKAQNIFLSKNGMVAKLGDFGIARVLNNSMELARTCIGTPYYLSPEICQNKPYNNKTDIWSLGCVLYELCTLKHPFEGNNLQQLVLKICQAHFAPISPGFSRELHSLISQLFQVSPRDRPSINSILKRPFLENLIPKYLTPENSVTCLYAEQERQLLDMLGRWSRAC

SEQ ID NO: 56997 - protein, 708 aa, Homo sapiens; identical to SEQ ID NO: 56995
  Payload ID: 11201
  Gene Symbol: NEK5
  Gene Name: NIMA-related kinase 5
  Uniprot ID: Q6P3R8
  ENSP ID: ENSP00000477810

SEQ ID NO: 56998 - protein, 313 aa, Homo sapiens
  Payload ID: 11202
  Gene Symbol: NEK6
  Gene Name: NIMA-related kinase 6
  Uniprot ID: Q9HC98
  ENSP ID: ENSP00000319734
MAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIHENGYNFKSDIWSLGCLLYEMAALQSPFYGDKMNLFSLCQKIEQCDYPPLPGEHYSEKLRELVSMCICPDPHQRPDIGYVHQVAKQMHIWMSST

SEQ ID NO: 56999 - protein, 207 aa, Homo sapiens
  Payload ID: 11202
  Gene Symbol: NEK6
  Gene Name: NIMA-related kinase 6
  ENSP ID: ENSP00000362698
MAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSL

SEQ ID NO: 57000 - protein, 347 aa, Homo sapiens
  Payload ID: 11202
  Gene Symbol: NEK6
  Gene Name: NIMA-related kinase 6
  Uniprot ID: Q9HC98
  ENSP ID: ENSP00000362702
MPRREVCWEAAHFRQEEQSLPRPRVRALVRLACRMAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIHENGYNFKSDIWSLGCLLYEMAALQSPFYGDKMNLFSLCQKIEQCDYPPLPGEHYSEKLRELVSMCICPDPHQRPDIGYVHQVAKQMHIWMSST

SEQ ID NO: 57001 - protein, 313 aa, Homo sapiens; identical to SEQ ID NO: 56998
  Payload ID: 11202
  Gene Symbol: NEK6
  Gene Name: NIMA-related kinase 6
  Uniprot ID: Q9HC98
  ENSP ID: ENSP00000362705

SEQ ID NO: 57002 - protein, 347 aa, Homo sapiens; identical to SEQ ID NO: 57000
  Payload ID: 11202
  Gene Symbol: NEK6
  Gene Name: NIMA-related kinase 6
  Uniprot ID: Q9HC98
  ENSP ID: ENSP00000377749

SEQ ID NO: 57003 - protein, 219 aa, Homo sapiens
  Payload ID: 11202
  Gene Symbol: NEK6
  Gene Name: NIMA-related kinase 6
  ENSP ID: ENSP00000389517
MAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERI

SEQ ID NO: 57004 - protein, 194 aa, Homo sapiens
  Payload ID: 11202
  Gene Symbol: NEK6
  Gene Name: NIMA-related kinase 6
  ENSP ID: ENSP00000399847
MPRREVCWEAAHFRQEEQSLPRPRVRALVRLACRMAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAV

SEQ ID NO: 57005 - protein, 222 aa, Homo sapiens
  Payload ID: 11202
  Gene Symbol: NEK6
  Gene Name: NIMA-related kinase 6
  ENSP ID: ENSP00000403087
MAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIHEN

SEQ ID NO: 57006 - protein, 171 aa, Homo sapiens
  Payload ID: 11202
  Gene Symbol: NEK6
  Gene Name: NIMA-related kinase 6
  ENSP ID: ENSP00000403414
MAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHR

SEQ ID NO: 57007 - protein, 200 aa, Homo sapiens
  Payload ID: 11202
  Gene Symbol: NEK6
  Gene Name: NIMA-related kinase 6
  ENSP ID: ENSP00000405215
MAGQPGHMPHGGSSNNLCHTLGPVHPPDPQQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIHENGYNFKSDIWSLGCLLYEMAALQSPFYGDKMNLFSLCQKIEQCDYPP

SEQ ID NO: 57008 - protein, 220 aa, Homo sapiens
  Payload ID: 11202
  Gene Symbol: NEK6
  Gene Name: NIMA-related kinase 6
  ENSP ID: ENSP00000411401
MAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIH

SEQ ID NO: 57009 - protein, 338 aa, Homo sapiens
  Payload ID: 11202
  Gene Symbol: NEK6
  Gene Name: NIMA-related kinase 6
  Uniprot ID: Q9HC98
  ENSP ID: ENSP00000439651
MEATGWDSRCSPGTQVRALVRLACRMAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIHENGYNFKSDIWSLGCLLYEMAALQSPFYGDKMNLFSLCQKIEQCDYPPLPGEHYSEKLRELVSMCICPDPHQRPDIGYVHQVAKQMHIWMSST

SEQ ID NO: 57010 - protein, 313 aa, Homo sapiens; identical to SEQ ID NO: 56998
  Payload ID: 11202
  Gene Symbol: NEK6
  Gene Name: NIMA-related kinase 6
  Uniprot ID: Q9HC98
  ENSP ID: ENSP00000441426

SEQ ID NO: 57011 - protein, 331 aa, Homo sapiens
  Payload ID: 11202
  Gene Symbol: NEK6
  Gene Name: NIMA-related kinase 6
  Uniprot ID: Q9HC98
  ENSP ID: ENSP00000441469
MGRRRPAPFRALVRLACRMAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIHENGYNFKSDIWSLGCLLYEMAALQSPFYGDKMNLFSLCQKIEQCDYPPLPGEHYSEKLRELVSMCICPDPHQRPDIGYVHQVAKQMHIWMSST

SEQ ID NO: 57012 - protein, 313 aa, Homo sapiens; identical to SEQ ID NO: 56998
  Payload ID: 11202
  Gene Symbol: NEK6
  Gene Name: NIMA-related kinase 6
  Uniprot ID: Q9HC98
  ENSP ID: ENSP00000442636

SEQ ID NO: 57013 - protein, 119 aa, Homo sapiens
  Payload ID: 11203
  Gene Symbol: NEK7
  Gene Name: NIMA-related kinase 7
  Uniprot ID: Q8TDX7
  ENSP ID: ENSP00000356353
MDEQSQGMQGPPVPQFQPQKALRPDMGYNTLANFRIEKKIGRGQFSEVYRAACLLDGVPVALKKVQVCLLPVWERRVCALNACYFLEIIKGSESLQYMATLTNLFENLPVSHHGSFAKK

SEQ ID NO: 57014 - protein, 302 aa, Homo sapiens
  Payload ID: 11203
  Gene Symbol: NEK7
  Gene Name: NIMA-related kinase 7
  Uniprot ID: Q8TDX7
  ENSP ID: ENSP00000356355
MDEQSQGMQGPPVPQFQPQKALRPDMGYNTLANFRIEKKIGRGQFSEVYRAACLLDGVPVALKKVQIFDLMDAKARADCIKEIDLLKQLNHPNVIKYYASFIEDNELNIVLELADAGDLSRMIKHFKKQKRLIPERTVWKYFVQLCSALEHMHSRRVMHRDIKPANVFITATGVVKLGDLGLGRFFSSKTTAAHSLVGTPYYMSPERIHENGYNFKSDIWSLGCLLYEMAALQSPFYGDKMNLYSLCKKIEQCDYPPLPSDHYSEELRQLVNMCINPDPEKRPDVTYVYDVAKRMHACTASS

SEQ ID NO: 57015 - protein, 82 aa, Homo sapiens
  Payload ID: 11203
  Gene Symbol: NEK7
  Gene Name: NIMA-related kinase 7
  ENSP ID: ENSP00000375835
MDEQSQGMQGPPVPQFQPQKALRPDMGYNTLANFRIEKKIGRGQFSEVYRAACLLDGVPVALKKVQIFDLMDAKARADCIKE

SEQ ID NO: 57016 - protein, 32 aa, Homo sapiens
  Payload ID: 11203
  Gene Symbol: NEK7
  Gene Name: NIMA-related kinase 7
  ENSP ID: ENSP00000392745
MDEQSQGMQGPPVPQFQPQKALRPDMGYNTLA

SEQ ID NO: 57017 - protein, 62 aa, Homo sapiens
  Payload ID: 11203
  Gene Symbol: NEK7
  Gene Name: NIMA-related kinase 7
  ENSP ID: ENSP00000439095
MDEQSQGMQGPPVPQFQPQKALRPDMGYNTLANFRIEKKIGRGQFSEVYRAACLLDGVPVAL

SEQ ID NO: 57018 - protein, 302 aa, Homo sapiens; identical to SEQ ID NO: 57014
  Payload ID: 11203
  Gene Symbol: NEK7
  Gene Name: NIMA-related kinase 7
  Uniprot ID: Q8TDX7
  ENSP ID: ENSP00000444621

SEQ ID NO: 57019 - protein, 692 aa, Homo sapiens
  Payload ID: 11204
  Gene Symbol: NEK8
  Gene Name: NIMA-related kinase 8
  Uniprot ID: Q86SG6
  ENSP ID: ENSP00000268766
MEKYERIRVVGRGAFGIVHLCLRKADQKLVIIKQIPVEQMTKEERQAAQNECQVLKLLNHPNVIEYYENFLEDKALMIAMEYAPGGTLAEFIQKRCNSLLEEETILHFFVQILLALHHVHTHLILHRDLKTQNILLDKHRMVVKIGDFGISKILSSKSKAYTVVGTPCYISPELCEGKPYNQKSDIWALGCVLYELASLKRAFEAANLPALVLKIMSGTFAPISDRYSPELRQLVLSLLSLEPAQRPPLSHIMAQPLCIRALLNLHTDVGSVRMRRAEKSVAPSNTGSRTTSVRCRGIPRGPVRPAIPPPLSSVYAWGGGLGTPLRLPMLNTEVVQVAAGRTQKAGVTRSGRLILWEAPPLGAGGGSLLPGAVEQPQPQFISRFLEGQSGVTIKHVACGDFFTACLTDRGIIMTFGSGSNGCLGHGSLTDISQPTIVEALLGYEMVQVACGASHVLALSTERELFAWGRGDSGRLGLGTRESHSCPQQVPMPPGQEAQRVVCGIDSSMILTVPGQALACGSNRFNKLGLDHLSLGEEPVPHQQVEEALSFTLLGSAPLDQEPLLSIDLGTAHSAAVTASGDCYTFGSNQHGQLGTNTRRGSRAPCKVQGLEGIKMAMVACGDAFTVAIGAESEVYSWGKGARGRLGRRDEDAGLPRPVQLDETHPYTVTSVSCCHGNTLLAVRSVTDEPVPP

SEQ ID NO: 57020 - protein, 460 aa, Homo sapiens
  Payload ID: 11204
  Gene Symbol: NEK8
  Gene Name: NIMA-related kinase 8
  ENSP ID: ENSP00000465859
MEKYERIRVVGRGAFGIVHLCLRKADQKLVIIKQIPVEQMTKEERQAAQNECQVLKLLNHPNVIEYYENFLEDKALMIAMEYAPGGTLAEFIQKRCNSLLEEETILHFFVQILLALHHVHTHLILHRDLKTQNILLDKHRMVVKIGDFGISKILSSKSKAYTVVGTPCYISPELCEGKPYNQKSDIWALGCVLYELASLKRAFEAANLPALVLKIMSGTFAPISDRYSPELRQLVLSLLSLEPAQRPPLSHIMAQPLCIRALLNLHTDVGSVRMRRPVQGQRAVLGGRVWAPSGSTGGLRQRETWGKSSLPACRNVRRVFVLRPPSVLQGREVRGPQQHREQDHQCPLQRYPPGTCEASHPTTTVVSVCLGWWAGHPPAAANAQHRGGPGGSWAHAESRRHALWASHPVGGPTPRCRRRQSPSWGSGAATAPVHLAFPGGPVGCDHQARGLWGLLHCLPD

SEQ ID NO: 57021 - protein, 261 aa, Homo sapiens
  Payload ID: 11204
  Gene Symbol: NEK8
  Gene Name: NIMA-related kinase 8
  ENSP ID: ENSP00000466476
  MOD_RES (1)..(1): Any amino acid
XEGKPYNQKSDIWALGCVLYELASLKRAFEAANLPALVLKIMSGTFAPISDRYSPELRQLVLSLLSLEPAQRPPLSHIMAQPLCIRALLNLHTDVGSVRMRRPVQGQRAVLGGRVWAPSGSTGGPHLSCRAEKSVAPSNTGSRTTSVRCRGIPRGPVRPAIPPPLSSVYAWGGGLGTPLRLPMLNTEVVQVAAGRTQKAGVTRSGRLILWEAPPLGAGGGSLLPGAVEQPQPQFISRFLEGQSGVTIKHVACGDFFTACLT

SEQ ID NO: 57022 - protein, 167 aa, Homo sapiens
  Payload ID: 11204
  Gene Symbol: NEK8
  Gene Name: NIMA-related kinase 8
  ENSP ID: ENSP00000466896
MTKEERQAAQNECQVLKLLNHPNVIEYYENFLEDKALMIAMEYAPGGTLAEFIQKRCNSLLEEETILHFFVQILLALHHVHTHLILHRDLKTQNILLDKHRMVVKIGDFGISKILSSKSKAYTVVGTPCYISPELCEGKPYNQKSDIWALGCVLYELASLKRAFEAA

SEQ ID NO: 57023 - protein, 165 aa, Homo sapiens
  Payload ID: 11204
  Gene Symbol: NEK8
  Gene Name: NIMA-related kinase 8
  ENSP ID: ENSP00000467335
MTKEERQAAQNECQVLKLLNHPNVIEYYENFLEDKALMIAMEYAPGGTLAEFIQKRCNSLLEEETILHFFVQILLALHHVHTHLILHRDLKTQNILLDKHRMVVKIGDFGISKILSSKSKAYTVVGTPCYISPELCEGKPYNQKSDIWALGCVLYELASLKRAFE

SEQ ID NO: 57024 - protein, 979 aa, Homo sapiens
  Payload ID: 11205
  Gene Symbol: NEK9
  Gene Name: NIMA-related kinase 9
  Uniprot ID: Q8TD19
  ENSP ID: ENSP00000238616
MSVLGEYERHCDSINSDFGSESGGCGDSSPGPSASQGPRAGGGAAEQEELHYIPIRVLGRGAFGEATLYRRTEDDSLVVWKEVDLTRLSEKERRDALNEIVILALLQHDNIIAYYNHFMDNTTLLIELEYCNGGNLYDKILRQKDKLFEEEMVVWYLFQIVSAVSCIHKAGILHRDIKTLNIFLTKANLIKLGDYGLAKKLNSEYSMAETLVGTPYYMSPELCQGVKYNFKSDIWAVGCVIFELLTLKRTFDATNPLNLCVKIVQGIRAMEVDSSQYSLELIQMVHSCLDQDPEQRPTADELLDRPLLRKRRREMEEKVTLLNAPTKRPRSSTVTEAPIAVVTSRTSEVYVWGGGKSTPQKLDVIKSGCSARQVCAGNTHFAVVTVEKELYTWVNMQGGTKLHGQLGHGDKASYRQPKHVEKLQGKAIRQVSCGDDFTVCVTDEGQLYAFGSDYYGCMGVDKVAGPEVLEPMQLNFFLSNPVEQVSCGDNHVVVLTRNKEVYSWGCGEYGRLGLDSEEDYYTPQKVDVPKALIIVAVQCGCDGTFLLTQSGKVLACGLNEFNKLGLNQCMSGIINHEAYHEVPYTTSFTLAKQLSFYKIRTIAPGKTHTAAIDERGRLLTFGCNKCGQLGVGNYKKRLGINLLGGPLGGKQVIRVSCGDEFTIAATDDNHIFAWGNGGNGRLAMTPTERPHGSDICTSWPRPIFGSLHHVPDLSCRGWHTILIVEKVLNSKTIRSNSSGLSIGTVFQSSSPGGGGGGGGGEEEDSQQESETPDPSGGFRGTMEADRGMEGLISPTEAMGNSNGASSSCPGWLRKELENAEFIPMPDSPSPLSAAFSESEKDTLPYEELQGLKVASEAPLEHKPQVEASSPRLNPAVTCAGKGTPLTPPACACSSLQVEVERLQGLVLKCLAEQQKLQQENLQIFTQLQKLNKKLEGGQQVGMHSKGTQTAKEEMEMDPKPDLDSDSWCLLGTDSCRPSL

SEQ ID NO: 57025 - protein, 128 aa, Homo sapiens
  Payload ID: 11205
  Gene Symbol: NEK9
  Gene Name: NIMA-related kinase 9
  ENSP ID: ENSP00000450943
MDNTTLLIELEYCNGGNLYDKILRQKDKLFEEEMVVWYLFQIVSAVSCIHKAGILHRDIKTLNIFLTKANLIKLGDYGLAKKLNSEYSMAETLVGTPYYMSPELCQGVKYNFKSDIWAVGCVIFELLT

SEQ ID NO: 57026 - protein, 104 aa, Homo sapiens
  Payload ID: 11205
  Gene Symbol: NEK9
  Gene Name: NIMA-related kinase 9
  ENSP ID: ENSP00000451604
MSVLGEYERHCDSINSDFGSESGGCGDSSPGPSASQGPRAGGGAAEQEELHYIPIRVLGRGAFGEATLYRRTEEGTCMTKSFVRRTSCLRKRWWCGTYFRLFQQ

SEQ ID NO: 57027 - protein, 73 aa, Homo sapiens
  Payload ID: 11205
  Gene Symbol: NEK9
  Gene Name: NIMA-related kinase 9
  ENSP ID: ENSP00000452537
MDNTTLLIELEYCNGGNLYDKILRQKDKLFEEEMVVWYLFQIVSAVSCIHKAGILHRDIKTLNIFLTKANLIK

SEQ ID NO: 57028 - protein, 38 aa, Homo sapiens
  Payload ID: 11205
  Gene Symbol: NEK9
  Gene Name: NIMA-related kinase 9
  ENSP ID: ENSP00000452544
MDNTTLLIELEYCNGGNLYDKILRQKDKLFEEETPSRL

SEQ ID NO: 57029 - protein, 412 aa, Homo sapiens [sequence omitted]

SEQ ID NO: 57030 - protein, 66 aa, Homo sapiens
  Payload ID: 11206
  Gene Symbol: NOB1
  Gene Name: NIN1/RPN12 binding protein 1 homolog
  ENSP ID: ENSP00000456710
MAPVEHVVADAGAFLRHAALQDIGKNIYTIREVVTEIRDKATRRRLAVLPYELRFKEPLPEYVRLG

SEQ ID NO: 57031 - protein, 66 aa, Homo sapiens; identical to SEQ ID NO: 57030
  Payload ID: 11206
  Gene Symbol: NOB1
  Gene Name: NIN1/RPN12 binding protein 1 homolog
  ENSP ID: ENSP00000457760

SEQ ID NO: 57032 - protein, 2133 aa, Homo sapiens
  Payload ID: 11207
  Gene Symbol: NIN
  Gene Name: ninein (GSK3B interacting protein)
  Uniprot ID: Q8N4C6
  ENSP ID: ENSP00000245441
MDEVEQDQHEARLKELFDSFDTTGTGSLGQEELTDLCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEQFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEGLNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQLCKNTKADAMVKDLYVENAQLLKALEVTEQRQKTAEKKNYLLEEKIASLSNIVRNLTPAPLTSTPPLRS

SEQ ID NO: 57033 - protein, 1377 aa, Homo sapiens
  Payload ID: 11207
  Gene Symbol: NIN
  Gene Name: ninein (GSK3B interacting protein)
  Uniprot ID: Q8N4C6
  ENSP ID: ENSP00000324210
MDEVEQDQHEARLKELFDSFDTTGTGSLGQEELTDLCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQVSLPGHLCSPTSHSSFNSSFTSLYCH

SEQ ID NO: 57034 - protein, 2090 aa, Homo sapiens
  Payload ID: 11207
  Gene Symbol: NIN
  Gene Name: ninein (GSK3B interacting protein)
  Uniprot ID: Q8N4C6
  ENSP ID: ENSP00000371472
MDEVEQDQHEARLKELFDSFDTTGTGSLGQEELTDLCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEQFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEGLNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQVSLPGHLCSPTSHSSFNSSFTSLYCH

SEQ ID NO: 57035 - protein, 1377 aa, Homo sapiens; identical to SEQ ID NO: 57033
  Payload ID: 11207
  Gene Symbol: NIN
  Gene Name: ninein (GSK3B interacting protein)
  Uniprot ID: Q8N4C6
  ENSP ID: ENSP00000371474

SEQ ID NO: 57036 - protein, 1581 aa, Homo sapiens
  Payload ID: 11207
  Gene Symbol: NIN
  Gene Name: ninein (GSK3B interacting protein)
  ENSP ID: ENSP00000374519
  MOD_RES (1)..(1): Any amino acid
XVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEQFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEGLNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQGNQEQLVTVMEERMIEVEQKLKLVKRLLQEKVNQLKEQVSLPGHLCSPTSHSSFNSSFTSLYCH

SEQ ID NO: 57037 - protein, 396 aa, Homo sapiens
  Payload ID: 11207
  Gene Symbol: NIN
  Gene Name: ninein (GSK3B interacting protein)
  ENSP ID: ENSP00000398641
MLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALK

SEQ ID NO: 57038 - protein, 2046 aa, Homo sapiens
  Payload ID: 11207
  Gene Symbol: NIN
  Gene Name: ninein (GSK3B interacting protein)
  ENSP ID: ENSP00000412391
MDEVEQDQHEARLKELFDSFDTTGTGSLGQEELTDLCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEQFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEGLNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQALLPEQRAVHADSYRRIGHL

SEQ ID NO: 57039 - protein, 140 aa, Homo sapiens
  Payload ID: 11207
  Gene Symbol: NIN
  Gene Name: ninein (GSK3B interacting protein)
  ENSP ID: ENSP00000431485
QLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMENSVVGSSREGCSSLPEIVCEDAAPEVHCDA

SEQ ID NO: 57040 - protein, 101 aa, Homo sapiens
  Payload ID: 11207
  Gene Symbol: NIN
  Gene Name: ninein (GSK3B interacting protein)
  ENSP ID: ENSP00000431826
MDEVEQDQHEARLKELFDSFDTTGTGSLGQEELTDLCHMLSLEEVAPVLQQTLLQDNLLGRVHFDQFKEALILILSRTLSNEEHFQEPDCSLEAQPKYVRG

SEQ ID NO: 57041 - protein, 1989 aa, Homo sapiens
  Payload ID: 11207
  Gene Symbol: NIN
  Gene Name: ninein (GSK3B interacting protein)
  ENSP ID: ENSP00000432924
MDEVEQDQHEARLKELFDSFDTTGTGSLGQEELTDLCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTPSASTPYRQLKRHLSMQSFDESGRRTTTSSAMTSTIGFRVFSCLDDGMGHASVERILDTWQEEGIENSQEILKALDFSLDGNINLTELTLALENELLVTKNSIHQAALASFKAEIRHLLERVDQVVREKEKLRSDLDKAEKLKSLMASEVDDHHAAIERRNEYNLRKLDEEYKERIAALKNELRKEREQILQQAGKQRLELEQEIEKAKTEENYIRDRLALSLKENSRLENELLENAEKLAEYENLTNKLQRNLENVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEQFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEGLNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMENSVVGSSREGCSSLPEIVCEDAAPEVHCDA

SEQ ID NO: 57042 - protein, 1537 aa, Homo sapiens
  Payload ID: 11207
  Gene Symbol: NIN
  Gene Name: ninein (GSK3B interacting protein)
  ENSP ID: ENSP00000433717
  MOD_RES (1)..(1): Any amino acid
XVLAEKFGDLDPSSAEFFLQEERLTQMRNEYERQCRVLQDQVDELQSELEEYRAQGRVLRLPLKNSPSEEVEANSGGIEPEHGLGSEECNPLNMSIEAELVIEQMKEQHHRDICCLRLELEDKVRHYEKQLDETVVSCKKAQENMKQRHENETHTLEKQISDLKNEIAELQGQAAVLKEAHHEATCRHEEEKKQLQVKLEEEKTHLQEKLRLQHEMELKARLTQAQASFEREREGLQSSAWTEEKVRGLTQELEQFHQEQLTSLVEKHTLEKEELRKELLEKHQRELQEGREKMETECNRRTSQIEAQFQSDCQKVTERCESALQSLEGRYRQELKDLQEQQREEKSQWEFEKDELTQECAEAQELLKETLKREKTTSLVLTQEREMLEKTYKEHLNSMVVERQQLLQDLEDLRNVSETQQSLLSDQILELKSSHKRELREREEVLCQAGASEQLASQRLERLEMEHDQERQEMMSKLLAMENIHKATCETADRERAEMSTEISRLQSKIKEMQQATSPLSMLQSGCQVIGEEEVEGDGALSLLQQGEQLLEENGDVLLSLQRAHEQAVKENVKMATEISRLQQRLQKLEPGLVMSSCLDEPATEFFGNTAEQTEQFLQQNRTKQVEGVTRRHVLSDLEDDEVRDLGSTGTSSVQRQEVKIEESEASVEGFSELENSEETRTESWELKNQISQLQEQLMMLCADCDRASEKKQDLLFDVSVLKKKLKMLERIPEASPKYKLLYEDVSRENDCLQEELRMMETRYDEALENNKELTAEVFRLQDELKKMEEVTETFLSLEKSYDEVKIENEGLNVLVLRLQGKIEKLQESVVQRCDCCLWEASLENLEIEPDGNILQLNQTLEECVPRVRSVHHVIEECKQENQYLEGNTQLLEKVKAHEIAWLHGTIQTHQERPRVQNQVILEENTTLLGFQDKHFQHQATIAELELEKTKLQELTRKLKERVTILVKQKDVLSHGEKEEELKAMMHDLQITCSEMQQKVELLRYESEKLQQENSILRNEITTLNEEDSISNLKLGTLNGSQEEMWQKTETVKQENAAVQKMVENLKKQISELKIKNQQLDLENTELSQKNSQNQEKLQELNQRLTEMLCQKEKEPGNSALEEREQEKFNLKEELERCKVQSSTLVSSLEAELSEVKIQTHIVQQENHLLKDELEKMKQLHRCPDLSDFQQKISSVLSYNEKLLKEKEALSEELNSCVDKLAKSSLLEHRIATMKQEQKSWEHQSASLKSQLVASQEKVQNLEDTVQNVNLQMSRMKSDLRVTQQEKEALKQEVMSLHKQLQNAGGKSWAPEIATHPSGLHNQQKRLSWDKLDHLMNEEQQLLWQENERLQTMVQNTKAELTHSREKVRQLESNLLPKHQKHLNPSGTMNPTEQEKLSLKRECDQFQKEQSPANRKVSQMNSLEQELETIHLENEGLKKKQVKLDEQLMEMQHLRSTATPSPSPHAWDLQLLQQQACPMVPREQFLQLQRQLLQAERINQHLQEELENRTSETNTPQALLPEQRAVHADSYRRIGHL

SEQ ID NO: 57043 - protein, 2133 aa, Homo sapiens; identical to SEQ ID NO: 57032
  Payload ID: 11207
  Gene Symbol: NIN
  Gene Name: ninein (GSK3B interacting protein)
  Uniprot ID: Q8N4C6
  ENSP ID: ENSP00000436092

SEQ ID NO: 57044 - protein, 116 aa, Homo sapiens
  Payload ID: 11207
  Gene Symbol: NIN
  Gene Name: ninein (GSK3B interacting protein)
  ENSP ID: ENSP00000473530
  MOD_RES (1)..(1): Any amino acid
XDLCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSELLES

SEQ ID NO: 57045 - protein, 1382 aa, Homo sapiens
  Payload ID: 11208
  Gene Symbol: NINL
  Gene Name: ninein-like
  Uniprot ID: Q9Y2I6
  ENSP ID: ENSP00000278886
MDEEENHYVSQLREVYSSCDTTGTGFLDRQELTQLCLKLHLEQQLPVLLQTLLGNDHFARVNFEEFKEGFVAVLSSNAGVRPSDEDSSSLESAASSAIPPKYVNGSKWYGRRSRPELCDAATEARRVPEQQTQASLKSHLWRSASLESVESPKSDEEAESTKEAQNELFEAQGQLQTWDSEDFGSPQKSCSPSFDTPESQIRGVWEELGVGSSGHLSEQELAVVCQSVGLQGLEKEELEDLFNKLDQDGDGKVSLEEFQLGLFSHEPALLLESSTRVKPSKAWSHYQVPEESGCHTTTTSSLVSLCSSLRLFSSIDDGSGFAFPDQVLAMWTQEGIQNGREILQSLDFSVDEKVNLLELTWALDNELMTVDSAVQQAALACYHQELSYQQGQVEQLARERDKARQDLERAEKRNLEFVKEMDDCHSTLEQLTEKKIKHLEQGYRERLSLLRSEVEAERELFWEQAHRQRAALEWDVGRLQAEEAGLREKLTLALKENSRLQKEIVEVVEKLSDSERLALKLQKDLEFVLKDKLEPQSAELLAQEERFAAVLKEYELKCRDLQDRNDELQAELEGLWARLPKNRHSPSWSPDGRRRQLPGLGPAGISFLGNSAPVSIETELMMEQVKEHYQDLRTQLETKVNYYEREIAALKRNFEKERKDMEQARRREVSVLEGQKADLEELHEKSQEVIWGLQEQLQDTARGPEPEQMGLAPCCTQALCGLALRHHSHLQQIRREAEAELSGELSGLGALPARRDLTLELEEPPQGPLPRGSQRSEQLELERALKLQPCASEKRAQMCVSLALEEEELELARGKRVDGPSLEAEMQALPKDGLVAGSGQEGTRGLLPLRPGCGERPLAWLAPGDGRESEEAAGAGPRRRQAQDTEATQSPAPAPAPASHGPSERWSRMQPCGVDGDIVPKEPEPFGASAAGLEQPGARELPLLGTERDASQTQPRMWEPPLRPAASCRGQAERLQAIQEERARSWSRGTQEQASEQQARAEGALEPGCHKHSVEVARRGSLPSHLQLADPQGSWQEQLAAPEEGETKIALEREKDDMETKLLHLEDVVRALEKHVDLRENDRLEFHRLSEENTLLKNDLGRVRQELEAAESTHDAQRKEIEVLKKDKEKACSEMEVLNRQNQNYKDQLSQLNVRVLQLGQEASTHQAQNEEHRVTIQMLTQSLEEVVRSGQQQSDQIQKLRVELECLNQEHQSLQLPWSELTQTLEESQDQVQGAHLRLRQAQAQHLQEVRLVPQDRVAELHRLLSLQGEQARRRLDAQREEHEKQLKATEERVEEAEMILKNMEMLLQEKVDKLKEQFEKNTKSDLLLKELYVENAHLVRALQATEEKQRGAEKQSRLLEEKVRALNKLVSRIAPAALSV

SEQ ID NO: 57046 - protein, 147 aa, Homo sapiens
  Payload ID: 11208
  Gene Symbol: NINL
  Gene Name: ninein-like
  ENSP ID: ENSP00000338621
  MOD_RES (1)..(1): Any amino acid
XTARGPEPEQMGLAPCCTQALCGLALRHHSHLQQIRLEFHRLSEENTLLKNDLGRVRQELEAAESTHDAQRKEIEVLKKDKEKACSEMEVLNRQNQNYKDQLSQLNVRVLQLGQEASTHQAQNEEHRVTIQMLTQSLEEVVRSGQQQ

SEQ ID NO: 57047 - protein, 1033 aa, Homo sapiens
  Payload ID: 11208
  Gene Symbol: NINL
  Gene Name: ninein-like
  Uniprot ID: Q9Y2I6
  ENSP ID: ENSP00000410431
MDEEENHYVSQLREVYSSCDTTGTGFLDRQELTQLCLKLHLEQQLPVLLQTLLGNDHFARVNFEEFKEGFVAVLSSNAGVRPSDEDSSSLESAASSAIPPKYVNGSKWYGRRSRPELCDAATEARRVPEQQTQASLKSHLWRSASLESVESPKSDEEAESTKEAQNELFEAQGQLQTWDSEDFGSPQKSCSPSFDTPESQIRGVWEELGVGSSGHLSEQELAVVCQSVGLQGLEKEELEDLFNKLDQDGDGKVSLEEFQLGLFSHEPALLLESSTRVKPSKAWSHYQVPEESGCHTTTTSSLVSLCSSLRLFSSIDDGSGFAFPDQVLAMWTQEGIQNGREILQSLDFSVDEKVNLLELTWALDNELMTVDSAVQQAALACYHQELSYQQGQVEQLARERDKARQDLERAEKRNLEFVKEMDDCHSTLEQLTEKKIKHLEQGYRERLSLLRSEVEAERELFWEQAHRQRAALEWDVGRLQAEEAGLREKLTLALKENSRLQKEIVEVVEKLSDSERLALKLQKDLEFVLKDKLEPQSAELLAQEERFAAVLKEYELKCRDLQDRNDELQAELEGLWARLPKNRHSPSWSPDGRRRQLPGLGPAGISFLGNSAPVSIETELMMEQVKEHYQDLRTQLETKVNYYEREIAALKRNFEKERKDMEQARRREVSVLEGQKADLEELHEKSQEVIWGLQEQLQDTARGPEPEQMGLAPCCTQALCGLALRHHSHLQQIRLEFHRLSEENTLLKNDLGRVRQELEAAESTHDAQRKEIEVLKKDKEKACSEMEVLNRQNQNYKDQLSQLNVRVLQLGQEASTHQAQNEEHRVTIQMLTQSLEEVVRSGQQQSDQIQKLRVELECLNQEHQSLQLPWSELTQTLEESQDQVQGAHLRLRQAQAQHLQEVRLVPQDRVAELHRLLSLQGEQARRRLDAQREEHEKQLKATEERVEEAEMILKNMEMLLQEKVDKLKEQFEKNTKSDLLLKELYVENAHLVRALQATEEKQRGAEKQSRLLEEKVRALNKLVSRIAPAALSV

SEQ ID NO: 57048 - protein, 152 aa, Homo sapiens
  Payload ID: 11209
  Gene Symbol: NINJ1
  Gene Name: ninjurin 1
  Uniprot ID: Q92982
  ENSP ID: ENSP00000364595
MDSGTEEYELNGGLPPGTPGSPDASPARWGWRHGPINVNHYASKKSAAESMLDIALLMANASQLKAVVEQGPSFAFYVPLVVLISISLVLQIGVGVLLIFLVKYDLNNPAKHAKLDFLNNLATGLVFIIVVVNIFITAFGVQKPLMDMAPQQ

SEQ ID NO: 57049 - protein, 188 aa, Homo sapiens
  Payload ID: 11210
  Gene Symbol: NINJ2
  Gene Name: ninjurin 2
  Uniprot ID: Q9NZG7
  ENSP ID: ENSP00000307552
MAGLSRQLCALSHPKKAAETQTAEPGGAHAVCSRHPVRVKGLEGSEMESARENIDLQPGSSDPRSQPINLNHYATKKSVAESMLDVALFMSNAMRLKAVLEQGPSSHYYTTLVTLISLSLLLQVVIGVLLVVIARLNLNEVEKQWRLNQLNNAATILVFFTVVINVFITAFGAHKTGFLAARASRNPL

SEQ ID NO: 57050 - protein, 135 aa, Homo sapiens
  Payload ID: 11210
  Gene Symbol: NINJ2
  Gene Name: ninjurin 2
  ENSP ID: ENSP00000380435
MMYMPGSSDPRSQPINLNHYATKKSVAESMLDVALFMSNAMRLKAVLEQGPSSHYYTTLVTLISLSLLLQVVIGVLLVVIARLNLNEVEKQWRLNQLNNAATILVFFTVVINVFITAFGAHKTGFLAARASRNPL

SEQ ID NO: 57051 - protein, 90 aa, Homo sapiens
  Payload ID: 11210
  Gene Symbol: NINJ2
  Gene Name: ninjurin 2
  ENSP ID: ENSP00000415158
MLDVALFMSNAMRLKAVLEQGPSSHYYTTLVTLISLSLLLQVVIGVLLVVIGEEPSLQSDLLPRHPWLAERPHVSPGPPCIGTGSFATTR

SEQ ID NO: 57052 - protein, 106 aa, Homo sapiens
  Payload ID: 11210
  Gene Symbol: NINJ2
  Gene Name: ninjurin 2
  ENSP ID: ENSP00000438831
MLDVALFMSNAMRLKAVLEQGPSSHYYTTLVTLISLSLLLQVVIGVLLVVIARLNLNEVEKQWRLNQLNNAATILVFFTVVINVFITAFGAHKTGFLAARASRNPL

SEQ ID NO: 57053 - protein, 180 aa, Homo sapiens
  Payload ID: 11211
  Gene Symbol: NIP7
  Gene Name: NIP7, nucleolar pre-rRNA processing protein
  Uniprot ID: Q9Y221
  ENSP ID: ENSP00000254940
MRPLTEEETRVMFEKIAKYIGENLQLLVDRPDGTYCFRLHNDRVYYVSEKIMKLAANISGDKLVSLGTCFGKFTKTHKFRLHVTALDYLAPYAKYKVWIKPGAEQSFLYGNHVLKSGLGRITENTSQYQGVVVYSMADIPLGFGVAAKSTQDCRKVDPMAIVVFHQADIGEYVRHEETLT

SEQ ID NO: 57054 - protein, 133 aa, Homo sapiens
  Payload ID: 11211
  Gene Symbol: NIP7
  Gene Name: NIP7, nucleolar pre-rRNA processing protein
  Uniprot ID: Q9Y221
  ENSP ID: ENSP00000254941
MRPLTEEETRVMFEKIAKYIGENLQLLVDRPDGTYCFRLHNDRVYYVSEKIMKLAANISGDKLVSLGTCFGKFTKTHKFRLHVTALDYLAPYAKGFGVAAKSTQDCRKVDPMAIVVFHQADIGEYVRHEETLT

SEQ ID NO: 57055 - protein, 110 aa, Homo sapiens
  Payload ID: 11211
  Gene Symbol: NIP7
  Gene Name: NIP7, nucleolar pre-rRNA processing protein
  ENSP ID: ENSP00000463739
MRPLTEEETRVMFEKIAKYIGENLQLLVDRPDGTYCFRLHNDRVYYVSEKIMKLAANISGDKLVSLGTCFGKFTKTHKFRLHVTALDYLAPYAKVCGAVSNSATGDEVKD

SEQ ID NO: 57056 - protein, 70 aa, Homo sapiens
  Payload ID: 11211
  Gene Symbol: NIP7
  Gene Name: NIP7, nucleolar pre-rRNA processing protein
  ENSP ID: ENSP00000464159
THKFRLHVTALDYLAPYAKYKVWIKPGAEQSFLYGNHVLKSGLGRITENTSQYQGVVVYSMADIPLCLFF

SEQ ID NO: 57057 - protein, 79 aa, Homo sapiens
  Payload ID: 11211
  Gene Symbol: NIP7
  Gene Name: NIP7, nucleolar pre-rRNA processing protein
  ENSP ID: ENSP00000464348
  MOD_RES (1)..(1): Any amino acid
XKTHKFRLHVTALDYLAPYAKYKVWIKPGAEQSFLYGNHVLKSGLGRITENTSQYQGVVVYSMADIPLTLGNMCGMKRR

SEQ ID NO: 57058 - protein, 410 aa, Homo sapiens
  Payload ID: 11212
  Gene Symbol: NIPAL1
  Gene Name: NIPA-like domain containing 1
  Uniprot ID: Q6NVV3
  ENSP ID: ENSP00000295461
MGAQVRLPPGEPCREGYVLSLVCPNSSQAWCEITNVSQLLASPVLYTDLNYSINNLSISANVENKYSLYVGLVLAVSSSIFIGSSFILKKKGLLQLASKGFTRAGQGGHSYLKEWLWWVGLLSMGAGEAANFAAYAFAPATLVTPLGALSVLISAILSSYFLNEHLNIHGKIGCILSILGSTVMVIHAPQEEEVTSLHEMEMKLRDPGFISFAVIITVISLVLILIVAPKKGQTNILVYISICSLIGAFSVSSVKGLGIAIKELIEWKPVYKHPLVFVLLAVLVLSVTTQINYLNKALDTFNTSLVTPIYYVFFTSMVVTCSAILFQEWYGMTAGDIIGTLSGFFTIIIGIFLLHAFKNTDITWSELTSTAKKEAVSLNVNENNYVLLENLECSAPGYNDDVTLFSRTDD

SEQ ID NO: 57059 - protein, 92 aa, Homo sapiens
  Payload ID: 11212
  Gene Symbol: NIPAL1
  Gene Name: NIPA-like domain containing 1
  ENSP ID: ENSP00000422276
VSQLLASPVLYTDLNYSINNLSISANVENKYSLYVGLVLAVSSSIFIGSSFILKKKGLLQLASKGFTRAGQGGHSYLKEWLWWVGLLSSSIN

SEQ ID NO: 57060 - protein, 131 aa, Homo sapiens
  Payload ID: 11212
  Gene Symbol: NIPAL1
  Gene Name: NIPA-like domain containing 1
  ENSP ID: ENSP00000425795
MGAQVRLPPGEPCREGYVLSLVCPNSSQAWCEITNVSQLLASPVLYTDLNYSINNLSISANVENKYSLYVGLVLAVSSSIFIGSSFILKKKGLLQLASKGFTRAGQGGHSYLKEWLWWVGLLSMQYYLPTF

SEQ ID NO: 57061 - protein, 368 aa, Homo sapiens
  Payload ID: 11213
  Gene Symbol: NIPAL2
  Gene Name: NIPA-like domain containing 2
  Uniprot ID: Q9H841
  ENSP ID: ENSP00000339256
MAAVAPAGPGDSASAALDELSLNFTYGAPGAGNGSLSGDWYRRNQIHLFGVLLAILGNLVISISLNIQKYSHLQLAQQEHPRPYFKSVLWWGGVLLMAVGETGNFAAYGFAPITLIAPLGCVSVTGSAIISVTFLKDNLRASDLLGTTLAFAGTYLLVNFAPNITQAISARTVQYYLVGWQFLIYVILEILIFCILLYFYKRKGMKHMVILLTLVAILASLTVISVKAVSGMITFSVMDKMQLTYPIFYIMFIIMIASCVFQVKFLNQATKLYNTTTVVPVNHIFFTISAIIAGIIFYQEFLGAPFLTVFIYLFGCFLSFLGVFLVTRNREKEHLQQSYIDFGNIPDTTPERKAWRETNVGQNTTRFT

SEQ ID NO: 57062 - protein, 383 aa, Homo sapiens
  Payload ID: 11213
  Gene Symbol: NIPAL2
  Gene Name: NIPA-like domain containing 2
  Uniprot ID: Q9H841
  ENSP ID: ENSP00000407087
MAAVAPAGPGDSASAALDELSLNFTYGAPGAGNGSLSGDWYRRNQIHLFGVLLAILGNLVISISLNIQKYSHLQLAQQEHPRPYFKSVLWWGGVLLMAVGETGNFAAYGFAPITLIAPLGCVSVTGSAIISVTFLKDNLRASDLLGTTLAFAGTYLLVNFAPNITQAISARTVQYYLVGWQFLIYVILEILIFCILLYFYKRKGMKHMVILLTLVAILASLTVISVKAVSGMITFSVMDKMQLTYPIFYIMFIIMIASCVFQVKFLNQATKLYNTTTVVPVNHIFFTISAIIAGIIFYQEFLGAPFLTVFIYLFGCFLSFLGVFLVTRNREKEHLQQSYIDFGNIPGKQMLDKIQPDSHSLSYGTLPDGSDSTKSQSGEKKEV

SEQ ID NO: 57063 - protein, 324 aa, Homo sapiens
  Payload ID: 11214
  Gene Symbol: NIPAL3
  Gene Name: NIPA-like domain containing 3
  Uniprot ID: Q6P499
  ENSP ID: ENSP00000003912
MLLGELGVFASYAFAPLSLIVPLSAVSVIASAIIGIIFIKEKWKPKDFLRRYVLSFVGCGLAVVGTYLLVTFAPNSHEKMTGENVTRHLVSWPFLLYMLVEIILFCLLLYFYKEKNANNIVVILLLVALLGSMTVVTVKAVAGMLVLSIQGNLQLDYPIFYVMFVCMVATAVYQAAFLSQASQMYDSSLIASVGYILSTTIAITAGAIFYLDFIGEDVLHICMFALGCLIAFLGVFLITRNRKKPIPFEPYISMDAMPGMQNMHDKGMTVQPELKASFSYGALENNDNISEIYAPATLPVMQEEHGSRSASGVPYRVLEHTKKE

SEQ ID NO: 57064 - protein, 368 aa, Homo sapiens
  Payload ID: 11214
  Gene Symbol: NIPAL3
  Gene Name: NIPA-like domain containing 3
  ENSP ID: ENSP00000343549
MDGSHSAALKLQQLPPTSSSSAVSEASFSYKENLIGALLAIFGHLVVSIALNLQKYCHIRLAGSKDPRAYFKTKTWWLGLFLMLLGELGVFASYAFAPLSLIVPLSAVSVIASAIIGIIFIKEKWKPKDFLRRYVLSFVGCGLAVVGTYLLVTFAPNSHEKMTGENVTRHLVSWPFLLYMLVEIILFCLLLYFYKEKNANNIVVILLLVALLGSMTVVTVKAVAGMLVLSIQGNLQLDYPIFYVMFVCMVATAVYQAAFLSQASQMYDSSLIASVGYILSTTIAITAGAIFYLDFIGEDVLHICMFALGCLIAFLGVFLITRNRKKPIPFEPYISMDAMPDSYLHNRQLLFKRYSNSRNLPHHNLESL

SEQ ID NO: 57065 - protein, 226 aa, Homo sapiens
  Payload ID: 11214
  Gene Symbol: NIPAL3
  Gene Name: NIPA-like domain containing 3
  Uniprot ID: Q6P499
  ENSP ID: ENSP00000350722
MDGSHSAALKLQQLPPTSSSSAVSEASFSYKENLIGALLAIFGHLVVSIALNLQKYCHIRLAGSKDPRAYFKTKTWWLGLFLMLLGELGVFASYAFAPLSLIVPLSAVSVIASAIIGIIFIKEKWKPKDFLRRYVLSFVGCGLAVVGTYLLVTFAPNSHEKMTGENVTRHLVSWPFLLYMLVEIILFCLLLYFYKEKNANNIVVILLLVALLVLLCHPGWSAVVQS

SEQ ID NO: 57066 - protein, 406 aa, Homo sapiens
  Payload ID: 11214
  Gene Symbol: NIPAL3
  Gene Name: NIPA-like domain containing 3
  Uniprot ID: Q6P499
  ENSP ID: ENSP00000363520
MDGSHSAALKLQQLPPTSSSSAVSEASFSYKENLIGALLAIFGHLVVSIALNLQKYCHIRLAGSKDPRAYFKTKTWWLGLFLMLLGELGVFASYAFAPLSLIVPLSAVSVIASAIIGIIFIKEKWKPKDFLRRYVLSFVGCGLAVVGTYLLVTFAPNSHEKMTGENVTRHLVSWPFLLYMLVEIILFCLLLYFYKEKNANNIVVILLLVALLGSMTVVTVKAVAGMLVLSIQGNLQLDYPIFYVMFVCMVATAVYQAAFLSQASQMYDSSLIASVGYILSTTIAITAGAIFYLDFIGEDVLHICMFALGCLIAFLGVFLITRNRKKPIPFEPYISMDAMPGMQNMHDKGMTVQPELKASFSYGALENNDNISEIYAPATLPVMQEEHGSRSASGVPYRVLEHTKKE

SEQ ID NO: 57067 - protein, 134 aa, Homo sapiens
  Payload ID: 11214
  Gene Symbol: NIPAL3
  Gene Name: NIPA-like domain containing 3
  ENSP ID: ENSP00000392170
  MOD_RES (1)..(1): Any amino acid
XVAGMLVLSIQGNLQLDYPIFYVMFVCMVATAVYQAAFSKTDSSPANENNSPYLRESHEALMRMSLGKCPVFESSLTDVRLLFDCQCGLHSVHNHCYHSRCNILPGLHRGGRAAHLHVCTGVPHCILGRLLNHA

SEQ ID NO: 57068 - protein, 466 aa, Homo sapiens
  Payload ID: 11215
  Gene Symbol: NIPAL4
  Gene Name: NIPA-like domain containing 4
  Uniprot ID: Q0D2K0
  ENSP ID: ENSP00000311687
MPGDSSPGTLPLWDASLSPPLGPDPGGFSRASHAGDKSRPPAPELGSPGAVRPRVGSCAPGPMELRVSNTSCENGSLLHLYCSSQEVLCQIVNDLSPEVPSNATFHSWQERIRQNYGFYIGLGLAFLSSFLIGSSVILKKKGLLRLVATGATRAVDGGFGYLKDAMWWAGFLTMAAGEVANFGAYAFAPATVVTPLGALSVLISAILSSYFLRESLNLLGKLGCVICVAGSTVMVIHAPEEEKVTTIMEMASKMKDTGFIVFAVLLLVSCLILIFVIAPRYGQRNILIYIIICSVIGAFSVAAVKGLGITIKNFFQGLPVVRHPLPYILSLILALSLSTQVNFLNRALDIFNTSLVFPIYYVFFTTVVVTSSIILFKEWYSMSAVDIAGTLSGFVTIILGVFMLHAFKDLDISCASLPHMHKNPPPSPAPEPTVIRLEDKNVLVDNIELASTSSPEEKPKVFIIHS

SEQ ID NO: 57069 - protein, 447 aa, Homo sapiens
  Payload ID: 11215
  Gene Symbol: NIPAL4
  Gene Name: NIPA-like domain containing 4
  Uniprot ID: Q0D2K0
  ENSP ID: ENSP00000406456
MPGDSSPGTLPLWDASLSPPLGPDPGGFSRASHAGDKSRPPAPELGSPGAVRPRVGSCAPGPMELRVSNTSCENGSLLHLYCSSQEVLCQIVNDLSPEVPSNATFHSWQERIRQNYGFYIGLGLAFLSSFLIGSSVILKKKGLLRLVATGATRAVAAGEVANFGAYAFAPATVVTPLGALSVLISAILSSYFLRESLNLLGKLGCVICVAGSTVMVIHAPEEEKVTTIMEMASKMKDTGFIVFAVLLLVSCLILIFVIAPRYGQRNILIYIIICSVIGAFSVAAVKGLGITIKNFFQGLPVVRHPLPYILSLILALSLSTQVNFLNRALDIFNTSLVFPIYYVFFTTVVVTSSIILFKEWYSMSAVDIAGTLSGFVTIILGVFMLHAFKDLDISCASLPHMHKNPPPSPAPEPTVIRLEDKNVLVDNIELASTSSPEEKPKVFIIHS

SEQ ID NO: 57070 - protein, 132 aa, Homo sapiens
  Payload ID: 11215
  Gene Symbol: NIPAL4
  Gene Name: NIPA-like domain containing 4
  ENSP ID: ENSP00000430810
PAPELGSPGAVRPRVGSCAPGPMELRVSNTSCENAGMAERSQGRKVPCSTSTAPPKKSCARLSMTSALRCPAMPPFTAGRKESGRTMASTSAWAWHSCLASSSAAASSSRRKASCDSWPREPLELWMEASAT

SEQ ID NO: 57071 - protein, 2804 aa, Homo sapiens
  Payload ID: 11216
  Gene Symbol: NIPBL
  Gene Name: Nipped-B homolog (Drosophila)
  Uniprot ID: Q6KC79
  ENSP ID: ENSP00000282516
MNGDMPHVPITTLAGIASLTDLLNQLPLPSPLPATTTKSLLFNARIAEEVNCLLACRDDNLVSQLVHSLNQVSTDHIELKDNLGSDDPEGDIPVLLQAVLARSPNVFREKSMQNRYVQSGMMMSQYKLSQNSMHSSPASSNYQQTTISHSPSSRFVPPQTSSGNRFMPQQNSPVPSPYAPQSPAGYMPYSHPSSYTTHPQMQQASVSSPIVAGGLRNIHDNKVSGPLSGNSANHHADNPRHGSSEDYLHMVHRLSSDDGDSSTMRNAASFPLRSPQPVCSPAGSEGTPKGSRPPLILQSQSLPCSSPRDVPPDILLDSPERKQKKQKKMKLGKDEKEQSEKAAMYDIISSPSKDSTKLTLRLSRVRSSDMDQQEDMISGVENSNVSENDIPFNVQYPGQTSKTPITPQDINRPLNAAQCLSQQEQTAFLPANQVPVLQQNTSVAAKQPQTSVVQNQQQISQQGPIYDEVELDALAEIERIERESAIERERFSKEVQDKDKPLKKRKQDSYPQEAGGATGGNRPASQETGSTGNGSRPALMVSIDLHQAGRVDSQASITQDSDSIKKPEEIKQCNDAPVSVLQEDIVGSLKSTPENHPETPKKKSDPELSKSEMKQSESRLAESKPNENRLVETKSSENKLETKVETQTEELKQNESRTTECKQNESTIVEPKQNENRLSDTKPNDNKQNNGRSETTKSRPETPKQKGESRPETPKQKSDGHPETPKQKGDGRPETPKQKGESRPETPKQKNEGRPETPKHRHDNRRDSGKPSTEKKPEVSKHKQDTKSDSPRLKSERAEALKQRPDGRSVSESLRRDHDNKQKSDDRGESERHRGDQSRVRRPETLRSSSRNEHGIKSDSSKTDKLERKHRHESGDSRERPSSGEQKSRPDSPRVKQGDSNKSRSDKLGFKSPTSKDDKRTEGNKSKVDTNKAHPDNKAEFPSYLLGGRSGALKNFVIPKIKRDKDGNVTQETKKMEMKGEPKDKVEKIGLVEDLNKGAKPVVVLQKLSLDDVQKLIKDREDKSRSSLKPIKNKPSKSNKGSIDQSVLKELPPELLAEIESTMPLCERVKMNKRKRSTVNEKPKYAEISSDEDNDSDEAFESSRKRHKKDDDKAWEYEERDRRSSGDHRRSGHSHEGRRSSGGGRYRNRSPSDSDMEDYSPPPSLSEVARKMKKKEKQKKRKAYEPKLTPEEMMDSSTFKRFTASIENILDNLEDMDFTAFGDDDEIPQELLLGKHQLNELGSESAKIKAMGIMDKLSTDKTVKVLNILEKNIQDGSKLSTLLNHNNDTEEEERLWRDLIMERVTKSADACLTTINIMTSPNMPKAVYIEDVIERVIQYTKFHLQNTLYPQYDPVYRLDPHGGGLLSSKAKRAKCSTHKQRVIVMLYNKVCDIVSSLSELLEIQLLTDTTILQVSSMGITPFFVENVSELQLCAIKLVTAVFSRYEKHRQLILEEIFTSLARLPTSKRSLRNFRLNSSDMDGEPMYIQMVTALVLQLIQCVVHLPSSEKDSNAEEDSNKKIDQDVVITNSYETAMRTAQNFLSIFLKKCGSKQGEEDYRPLFENFVQDLLSTVNKPEWPAAELLLSLLGRLLVHQFSNKSTEMALRVASLDYLGTVAARLRKDAVTSKMDQGSIERILKQVSGGEDEIQQLQKALLDYLDENTETDPSLVFSRKFYIAQWFRDTTLETEKAMKSQKDEESSEGTHHAKEIETTGQIMHRAENRKKFLRSIIKTTPSQFSTLKMNSDTVDYDDACLIVRYLASMRPFAQSFDIYLTQILRVLGENAIAVRTKAMKCLSEVVAVDPSILARLDMQRGVHGRLMDNSTSVREAAVELLGRFVLCRPQLAEQYYDMLIERILDTGISVRKRVIKILRDICIEQPTFPKITEMCVKMIRRVNDEEGIKKLVNETFQKLWFTPTPHNDKEAMTRKILNITDVVAACRDTGYDWFEQLLQNLLKSEEDSSYKPVKKACTQLVDNLVEHILKYEESLADSDNKGVNSGRLVACITTLFLFSKIRPQLMVKHAMTMQPYLTTKCSTQNDFMVICNVAKILELVVPLMEHPSETFLATIEEDLMKLIIKYGMTVVQHCVSCLGAVVNKVTQNFKFVWACFNRYYGAISKLKSQHQEDPNNTSLLTNKPALLRSLFTVGALCRHFDFDLEDFKGNSKVNIKDKVLELLMYFTKHSDEEVQTKAIIGLGFAFIQHPSLMFEQEVKNLYNNILSDKNSSVNLKIQVLKNLQTYLQEEDTRMQQADRDWKKVAKQEDLKEMGDVSSGMSSSIMQLYLKQVLEAFFHTQSSVRHFALNVIALTLNQGLIHPVQCVPYLIAMGTDPEPAMRNKADQQLVEIDKKYAGFIHMKAVAGMKMSYQVQQAINTCLKDPVRGFRQDESSSALCSHLYSMIRGNRQHRRAFLISLLNLFDDTAKTDVTMLLYIADNLACFPYQTQEEPLFIMHHIDITLSVSGSNLLQSFKESMVKDKRKERKSSPSKENESSDSEEEVSRPRKSRKRVDSDSDSDSEDDINSVMKCLPENSAPLIEFANVSQGILLLLMLKQHLKNLCGFSDSKIQKYSPSESAKVYDKAINRKTGVHFHPKQTLDFLRSDMANSKITEEVKRSIVKQYLDFKLLMEHLDPDEEEEEGEVSASTNARNKAITSLLGGGSPKNNTAAETEDDESDGEDRGGGTSGSLRRSKRNSDSTELAAQMNESVDVMDVIAICCPKYKDRPQIARVVQKTSSGFSVQWMAGSYSGSWTEAKRRDGRKLVPWVDTIKESDIIYKKIALTSANKLTNKVVQTLRSLYAAKDGTSS

SEQ ID NO: 57072 - protein, 2697 aa, Homo sapiens
  Payload ID: 11216
  Gene Symbol: NIPBL
  Gene Name: Nipped-B homolog (Drosophila)
  Uniprot ID: Q6KC79
  ENSP ID: ENSP00000406266
MNGDMPHVPITTLAGIASLTDLLNQLPLPSPLPATTTKSLLFNARIAEEVNCLLACRDDNLVSQLVHSLNQVSTDHIELKDNLGSDDPEGDIPVLLQAVLARSPNVFREKSMQNRYVQSGMMMSQYKLSQNSMHSSPASSNYQQTTISHSPSSRFVPPQTSSGNRFMPQQNSPVPSPYAPQSPAGYMPYSHPSSYTTHPQMQQASVSSPIVAGGLRNIHDNKVSGPLSGNSANHHADNPRHGSSEDYLHMVHRLSSDDGDSSTMRNAASFPLRSPQPVCSPAGSEGTPKGSRPPLILQSQSLPCSSPRDVPPDILLDSPERKQKKQKKMKLGKDEKEQSEKAAMYDIISSPSKDSTKLTLRLSRVRSSDMDQQEDMISGVENSNVSENDIPFNVQYPGQTSKTPITPQDINRPLNAAQCLSQQEQTAFLPANQVPVLQQNTSVAAKQPQTSVVQNQQQISQQGPIYDEVELDALAEIERIERESAIERERFSKEVQDKDKPLKKRKQDSYPQEAGGATGGNRPASQETGSTGNGSRPALMVSIDLHQAGRVDSQASITQDSDSIKKPEEIKQCNDAPVSVLQEDIVGSLKSTPENHPETPKKKSDPELSKSEMKQSESRLAESKPNENRLVETKSSENKLETKVETQTEELKQNESRTTECKQNESTIVEPKQNENRLSDTKPNDNKQNNGRSETTKSRPETPKQKGESRPETPKQKSDGHPETPKQKGDGRPETPKQKGESRPETPKQKNEGRPETPKHRHDNRRDSGKPSTEKKPEVSKHKQDTKSDSPRLKSERAEALKQRPDGRSVSESLRRDHDNKQKSDDRGESERHRGDQSRVRRPETLRSSSRNEHGIKSDSSKTDKLERKHRHESGDSRERPSSGEQKSRPDSPRVKQGDSNKSRSDKLGFKSPTSKDDKRTEGNKSKVDTNKAHPDNKAEFPSYLLGGRSGALKNFVIPKIKRDKDGNVTQETKKMEMKGEPKDKVEKIGLVEDLNKGAKPVVVLQKLSLDDVQKLIKDREDKSRSSLKPIKNKPSKSNKGSIDQSVLKELPPELLAEIESTMPLCERVKMNKRKRSTVNEKPKYAEISSDEDNDSDEAFESSRKRHKKDDDKAWEYEERDRRSSGDHRRSGHSHEGRRSSGGGRYRNRSPSDSDMEDYSPPPSLSEVARKMKKKEKQKKRKAYEPKLTPEEMMDSSTFKRFTASIENILDNLEDMDFTAFGDDDEIPQELLLGKHQLNELGSESAKIKAMGIMDKLSTDKTVKVLNILEKNIQDGSKLSTLLNHNNDTEEEERLWRDLIMERVTKSADACLTTINIMTSPNMPKAVYIEDVIERVIQYTKFHLQNTLYPQYDPVYRLDPHGGGLLSSKAKRAKCSTHKQRVIVMLYNKVCDIVSSLSELLEIQLLTDTTILQVSSMGITPFFVENVSELQLCAIKLVTAVFSRYEKHRQLILEEIFTSLARLPTSKRSLRNFRLNSSDMDGEPMYIQMVTALVLQLIQCVVHLPSSEKDSNAEEDSNKKIDQDVVITNSYETAMRTAQNFLSIFLKKCGSKQGEEDYRPLFENFVQDLLSTVNKPEWPAAELLLSLLGRLLVHQFSNKSTEMALRVASLDYLGTVAARLRKDAVTSKMDQGSIERILKQVSGGEDEIQQLQKALLDYLDENTETDPSLVFSRKFYIAQWFRDTTLETEKAMKSQKDEESSEGTHHAKEIETTGQIMHRAENRKKFLRSIIKTTPSQFSTLKMNSDTVDYDDACLIVRYLASMRPFAQSFDIYLTQILRVLGENAIAVRTKAMKCLSEVVAVDPSILARLDMQRGVHGRLMDNSTSVREAAVELLGRFVLCRPQLAEQYYDMLIERILDTGISVRKRVIKILRDICIEQPTFPKITEMCVKMIRRVNDEEGIKKLVNETFQKLWFTPTPHNDKEAMTRKILNITDVVAACRDTGYDWFEQLLQNLLKSEEDSSYKPVKKACTQLVDNLVEHILKYEESLADSDNKGVNSGRLVACITTLFLFSKIRPQLMVKHAMTMQPYLTTKCSTQNDFMVICNVAKILELVVPLMEHPSETFLATIEEDLMKLIIKYGMTVVQHCVSCLGAVVNKVTQNFKFVWACFNRYYGAISKLKSQHQEDPNNTSLLTNKPALLRSLFTVGALCRHFDFDLEDFKGNSKVNIKDKVLELLMYFTKHSDEEVQTKAIIGLGFAFIQHPSLMFEQEVKNLYNNILSDKNSSVNLKIQVLKNLQTYLQEEDTRMQQADRDWKKVAKQEDLKEMGDVSSGMSSSIMQLYLKQVLEAFFHTQSSVRHFALNVIALTLNQGLIHPVQCVPYLIAMGTDPEPAMRNKADQQLVEIDKKYAGFIHMKAVAGMKMSYQVQQAINTCLKDPVRGFRQDESSSALCSHLYSMIRGNRQHRRAFLISLLNLFDDTAKTDVTMLLYIADNLACFPYQTQEEPLFIMHHIDITLSVSGSNLLQSFKESMVKDKRKERKSSPSKENESSDSEEEVSRPRKSRKRVDSDSDSDSEDDINSVMKCLPENSAPLIEFANVSQGILLLLMLKQHLKNLCGFSDSKIQKYSPSESAKVYDKAINRKTGVHFHPKQTLDFLRSDMANSKITEEVKRSIVKQYLDFKLLMEHLDPDEEEEEGEVSASTNARNKAITSLLGGGSPKNNTAAETEDDESDGEDRGGGTSGVRRRRSQRISQRIT

SEQ ID NO: 57073 - protein, 150 aa, Homo sapiens
  Payload ID: 11216
  Gene Symbol: NIPBL
  Gene Name: Nipped-B homolog (Drosophila)
  ENSP ID: ENSP00000421504
DKRKERKSSPSKENESSDSEEEVSRPRKSRKRVDSDSDSDSEDDINSVMKCLPENSAPLIEFANVSQGILLLLMLKQHLKNLCGFSDSSNFSWNIWTLMKKKKKGRFQLAQMLGTKQLPHCLEEAALKIIQQQRQKMMKVMGRIEEEALQ

SEQ ID NO: 57074 - protein, 104 aa, Homo sapiens
  Payload ID: 11216
  Gene Symbol: NIPBL
  Gene Name: Nipped-B homolog (Drosophila)
  ENSP ID: ENSP00000480694
MNESVDVMDVIAICCPKYKDRPQIARVVQKTSSGFSVQWMAGSYSGSWTEAKRRDGRKLVPWVDTIKESDIIYKKIALTSANKLTNKVVQTLRSLYAAKDGTSS

SEQ ID NO: 57075 - protein, 284 aa, Homo sapiens
  Payload ID: 11217
  Gene Symbol: NIPSNAP1
  Gene Name: nipsnap homolog 1 (C. elegans)
  Uniprot ID: Q9BPW8
  ENSP ID: ENSP00000216121
MAPRLCSISVTARRLLGGPGPRAGDVASAAAARFYSKDNEGSWFRSLFVHKVDPRKDAHSTLLSKKETSNLYKIQFHNVKPEYLDAYNSLTEAVLPKLHLDEDYPCSLVGNWNTWYGEQDQAVHLWRFSGGYPALMDCMNKLKNNKEYLEFRRERSQMLLSRRNQLLLEFSFWNEPQPRMGPNIYELRTYKLKPGTMIEWGNNWARAIKYRQENQEAVGGFFSQIGELYVVHHLWAYKDLQSREETRNAAWRKRGWDENVYYTVPLVRHMESRIMIPLKISPLQ

SEQ ID NO: 57076 - protein, 75 aa, Homo sapiens
  Payload ID: 11217
  Gene Symbol: NIPSNAP1
  Gene Name: nipsnap homolog 1 (C. elegans)
  ENSP ID: ENSP00000403448
MDCMNKLKNNKEYLEFRRERSQMLLSRRNQLLLEFSFWNEPQPRMGPNIYELRTYKLKPGTMIEWGNNWARAIKY

SEQ ID NO: 57077 - protein, 128 aa, Homo sapiens
  Payload ID: 11217
  Gene Symbol: NIPSNAP1
  Gene Name: nipsnap homolog 1 (C. elegans)
  ENSP ID: ENSP00000404227
MAPRLCSISVTARRLLGGPGPRAGDVASAAAARFYSKDNEGSWFRSLFVHKVDPRKDAHSTLLSKKETSNLYKIQFHNVKPEYLDAYNSLTEAVLPKLHLDEDYPCSLVGNWNTWYGEQDQAGHSWFW

SEQ ID NO: 57078 - protein, 221 aa, Homo sapiens
  Payload ID: 11217
  Gene Symbol: NIPSNAP1
  Gene Name: nipsnap homolog 1 (C. elegans)
  ENSP ID: ENSP00000407851
  MOD_RES (1)..(1): Any amino acid
XRLCSISVTARRLLGGPGPRAGDVASAAAARLPPSEGSGLCMVKEYLPKNFYSKDNEGSWFRSLFVHKVDPRKDAHSTLLSKKETSNLYKIQFHNVKPEYLDAYNSLTEAVLPKLHLDEDYPCSLVGNWNTWYGEQDQAVHLWRFSGGYPALMDCMNKLKNNKEYLEFRRERSQMLLSRRNQLLLEFSFWNEPQPRMGPNIYELRTYKLKPGTMIEWGNNW

SEQ ID NO: 57079 - protein, 247 aa, Homo sapiens
  Payload ID: 11218
  Gene Symbol: NIPSNAP3A
  Gene Name: nipsnap homolog 3A (C. elegans)
  Uniprot ID: Q9UFN0
  ENSP ID: ENSP00000363899
MLVLRSALTRALASRTLAPQMCSSFATGPRQYDGIFYEFRSYYLKPSKMNEFLENFEKNAHLRTAHSELVGYWSVEFGGRMNTVFHIWKYDNFAHRTEVRKALAKDKEWQEQFLIPNLALIDKQESEITYLVPWCKLEKPPKEGVYELATFQMKPGGPALWGDAFKRAVHAHVNLGYTKLVGVFHTEYGALNRVHVLWWNESADSRAAGRHKSHEDPRVVAAVRESVNYLVSQQNMLLIPTSFSPLK

SEQ ID NO: 57080 - protein, 247 aa, Homo sapiens
  Payload ID: 11219
  Gene Symbol: NIPSNAP3B
  Gene Name: nipsnap homolog 3B (C. elegans)
  Uniprot ID: Q9BS92
  ENSP ID: ENSP00000363894
MLVLRSGLTKALASRTLAPQVCSSFATGPRQYDGTFYEFRTYYLKPSNMNAFMENLKKNIHLRTSYSELVGFWSVEFGGRTNKVFHIWKYDNFAHRAEVRKALANCKEWQEQSIIPNLARIDKQETEITYLIPWSKLEKPPKEGVYELAVFQMKPGGPALWGDAFERAINAHVNLGYTKVVGVFHTEYGELNRVHVLWWNESADSRAAGRHKSHEDPRVVAAVRESVNYLVSQQNMLLIPASFSPLK

SEQ ID NO: 57081 - protein, 197 aa, Homo sapiens
  Payload ID: 11219
  Gene Symbol: NIPSNAP3B
  Gene Name: nipsnap homolog 3B (C. elegans)
  ENSP ID: ENSP00000435209
MLVLRSGLTKALASRTLAPQVCSSFATGPRQYDGTFYEFRTYYLKPSNMNAFMENLKKNIHLRTSYSELVGFWSVEFGGRTNKVFHIWKYDNFAHRAEVRKALANCKEWQEQSIIPNLARIDKQETEITYLIPWSKLEKPPKEVHVLWWNESADSRAAGRHKSHEDPRVVAAVRESVNYLVSQQNMLLIPASFSPLK

SEQ ID NO: 57082 - protein, 1504 aa, Homo sapiens
  Payload ID: 11220
  Gene Symbol: NISCH
  Gene Name: nischarin
  Uniprot ID: Q9Y2I1
  ENSP ID: ENSP00000339958
MATARTFGPEREAEPAKEARVVGSELVDTYTVYIIQVTDGSHEWTVKHRYSDFHDLHEKLVAERKIDKNLLPPKKIIGKNSRSLVEKREKDLEVYLQKLLAAFPGVTPRVLAHFLHFHFYEINGITAALAEELFEKGEQLLGAGEVFAIGPLQLYAVTEQLQQGKPTCASGDAKTDLGHILDFTCRLKYLKVSGTEGPFGTSNIQEQLLPFDLSIFKSLHQVEISHCDAKHIRGLVASKPTLATLSVRFSATSMKEVLVPEASEFDEWEPEGTTLEGPVTAVIPTWQALTTLDLSHNSVSEIDESVKLIPKIEFLDLSHNGLLVVDNLQHLYNLVHLDLSYNKLSSLEGLHTKLGNIKTLNLAGNLLESLSGLHKLYSLVNLDLRDNRIEQMEEVRSIGSLPCLEHVSLLNNPLSIIPDYRTKVLAQFGERASEVCLDDTVTTEKELDTVEVLKAIQKAKEVKSKLSNPEKKGGEDSRLSAAPCIRPSSSPPTVAPASASLPQPILSNQGIMFVQEEALASSLSSTDSLTPEHQPIAQGCSDSLESIPAGQAASDDLRDVPGAVGGASPEHAEPEVQVVPGSGQIIFLPFTCIGYTATNQDFIQRLSTLIRQAIERQLPAWIEAANQREEGQGEQGEEEDEEEEEEEDVAENRYFEMGPPDVEEEEGGGQGEEEEEEEEDEEAEEERLALEWALGADEDFLLEHIRILKVLWCFLIHVQGSIRQFAACLVLTDFGIAVFEIPHQESRGSSQHILSSLRFVFCFPHGDLTEFGFLMPELCLVLKVRHSENTLFIISDAANLHEFHADLRSCFAPQHMAMLCSPILYGSHTSLQEFLRQLLTFYKVAGGCQERSQGCFPVYLVYSDKRMVQTAAGDYSGNIEWASCTLCSAVRRSCCAPSEAVKSAAIPYWLLLTPQHLNVIKADFNPMPNRGTHNCRNRNSFKLSRVPLSTVLLDPTRSCTQPRGAFADGHVLELLVGYRFVTAIFVLPHEKFHFLRVYNQLRASLQDLKTVVIAKTPGTGGSPQGSFADGQPAERRASNDQRPQEVPAEALAPAPAEVPAPAPAAASASGPAKTPAPAEASTSALVPEETPVEAPAPPPAEAPAQYPSEHLIQATSEENQIPSHLPACPSLRHVASLRGSAIIELFHSSIAEVENEELRHLMWSSVVFYQTPGLEVTACVLLSTKAVYFVLHDGLRRYFSEPLQDFWHQKNTDYNNSPFHISQCFVLKLSDLQSVNVGLFDQHFRLTGSTPMQVVTCLTRDSYLTHCFLQHLMVVLSSLERTPSPEPVDKDFYSEFGNKTTGKMENYELIHSSRVKFTYPSEEEIGDLTFTVAQKMAEPEKAPALSILLYVQAFQVGMPPPGCCRGPLRPKTLLLTSSEIFLLDEDCVHYPLPEFAKEPPQRDRYRLDDGRRVRDLDRVLMGYQTYPQALTLVFDDVQGHDLMGSVTLDHFGEVPGGPARASQGREVQWQVFVPSAESREKLISLLARQWEALCGRELPVELTG

SEQ ID NO: 57083 - protein, 515 aa, Homo sapiens
  Payload ID: 11220
  Gene Symbol: NISCH
  Gene Name: nischarin
  Uniprot ID: Q9Y2I1
  ENSP ID: ENSP00000392484
MATARTFGPEREAEPAKEARVVGSELVDTYTVYIIQVTDGSHEWTVKHRYSDFHDLHEKLVAERKIDKNLLPPKKIIGKNSRSLVEKREKDLEVYLQKLLAAFPGVTPRVLAHFLHFHFYEINGITAALAEELFEKGEQLLGAGEVFAIGPLQLYAVTEQLQQGKPTCASGDAKTDLGHILDFTCRLKYLKVSGTEGPFGTSNIQEQLLPFDLSIFKSLHQVEISHCDAKHIRGLVASKPTLATLSVRFSATSMKEVLVPEASEFDEWEPEGTTLEGPVTAVIPTWQALTTLDLSHNSVSEIDESVKLIPKIEFLDLSHNGLLVVDNLQHLYNLVHLDLSYNKLSSLEGLHTKLGNIKTLNLAGNLLESLSGLHKLYSLVNLDLRDNRIEQMEEVRSIGSLPCLEHVSLLNNPLSIIPDYRTKVLAQFGERASEVCLDDTVTTEKELDTVEVLKAIQKAKEVKSKLSNPEKKGGEDSRLSAAPCIRPSSSPPTVAPASASLPQPILSNQGILGDE

SEQ ID NO: 57084 - protein, 583 aa, Homo sapiens
  Payload ID: 11220
  Gene Symbol: NISCH
  Gene Name: nischarin
  ENSP ID: ENSP00000417812
MATARTFGPEREAEPAKEARVVGSELVDTYTVYIIQVTDGSHEWTVKHRYSDFHDLHEKLVAERKIDKNLLPPKKIIGKNSRSLVEKREKDLEVYLQKLLAAFPGVTPRVLAHFLHFHFYEINGITAALAEELFEKGEQLLGAGEVFAIGPLQLYAVTEQLQQGKPTCASGDAKTDLGHILDFTCRLKYLKVSGTEGPFGTSNIQEQLLPFDLSIFKSLHQVEISHCDAKHIRGLVASKPTLATLSVRFSATSMKEVLVPEASEFDEWEPEGTTLEGPVTAVIPTWQALTTLDLSHNSVSEIDESVKLIPKIEFLDLSHNGLLVVDNLQHLYNLVHLDLSYNKLSSLEGLHTKLGNIKTLNLAGNLLESLSGLHKLYSLVNLDLRDNRIEQMEEVRSIGSLPCLEHVSLLNNPLSIIPDYRTKVLAQFGERASEVCLDDTVTTEKELDTVEVLKAIQKAKEVKSKLSNPEKKGGEDSRLSAAPCIRPSSSPPTVAPASASLPQPILSNQGNRVCILLLVEPHSPAWAPWLGWGWGRGASTCFQQGQTQGGQCLLQAGPRGGTHGRGAWPDASCCLLGEDSQLL

SEQ ID NO: 57085 - protein, 1504 aa, Homo sapiens; identical to SEQ ID NO: 57082
  Payload ID: 11220
  Gene Symbol: NISCH
  Gene Name: nischarin
  Uniprot ID: Q9Y2I1
  ENSP ID: ENSP00000418232

SEQ ID NO: 57086 - protein, 698 aa, Homo sapiens
  Payload ID: 11221
  Gene Symbol: NOA1
  Gene Name: nitric oxide associated 1
  Uniprot ID: Q8NC60
  ENSP ID: ENSP00000264230
MLPARLPFRLLSLFLRGSAPTAARHGLREPLLERRCAAASSFQHSSSLGRELPYDPVDTEGFGEGGDMQERFLFPEYILDPEPQPTREKQLQELQQQQEEEERQRQQRREERRQQNLRARSREHPVVGHPDPALPPSGVNCSGCGAELHCQDAGVPGYLPREKFLRTAEADGGLARTVCQRCWLLSHHRRALRLQVSREQYLELVSAALRRPGPSLVLYMVDLLDLPDALLPDLPALVGPKQLIVLGNKVDLLPQDAPGYRQRLRERLWEDCARAGLLLAPGHQGPQRPVKDEPQDGENPNPPNWSRTVVRDVRLISAKTGYGVEELISALQRSWRYRGDVYLVGATNAGKSTLFNTLLESDYCTAKGSEAIDRATISPWPGTTLNLLKFPICNPTPYRMFKRHQRLKKDSTQAEEDLSEQEQNQLNVLKKHGYVVGRVGRTFLYSEEQKDNIPFEFDADSLAFDMENDPVMGTHKSTKQVELTAQDVKDAHWFYDTPGITKENCILNLLTEKEVNIVLPTQSIVPRTFVLKPGMVLFLGAIGRIDFLQGNQSAWFTVVASNILPVHITSLDRADALYQKHAGHTLLQIPMGGKERMAGFPPLVAEDIMLKEGLGASEAVADIKFSSAGWVSVTPNFKDRLHLRGYTPEGTVLTVRPPLLPYIVNIKGQRIKKSVAYKTKKPPSLMYNVRKKKGKINV

SEQ ID NO: 57087 - protein, 1434 aa, Homo sapiens
  Payload ID: 11222
  Gene Symbol: NOS1
  Gene Name: nitric oxide synthase 1 (neuronal)
  Uniprot ID: P29475
  ENSP ID: ENSP00000320758
MEDHMFGVQQIQPNVISVRLFKRKVGGLGFLVKERVSKPPVIISDLIRGGAAEQSGLIQAGDIILAVNGRPLVDLSYDSALEVLRGIASETHVVLILRGPEGFTTHLETTFTGDGTPKTIRVTQPLGPPTKAVDLSHQPPAGKEQPLAVDGASGPGNGPQHAYDDGQEAGSLPHANGLAPRPPGQDPAKKATRVSLQGRGENNELLKEIEPVLSLLTSGSRGVKGGAPAKAEMKDMGIQVDRDLDGKSHKPLPLGVENDRVFNDLWGKGNVPVVLNNPYSEKEQPPTSGKQSPTKNGSPSKCPRFLKVKNWETEVVLTDTLHLKSTLETGCTEYICMGSIMHPSQHARRPEDVRTKGQLFPLAKEFIDQYYSSIKRFGSKAHMERLEEVNKEIDTTSTYQLKDTELIYGAKHAWRNASRCVGRIQWSKLQVFDARDCTTAHGMFNYICNHVKYATNKGNLRSAITIFPQRTDGKHDFRVWNSQLIRYAGYKQPDGSTLGDPANVQFTEICIQQGWKPPRGRFDVLPLLLQANGNDPELFQIPPELVLEVPIRHPKFEWFKDLGLKWYGLPAVSNMLLEIGGLEFSACPFSGWYMGTEIGVRDYCDNSRYNILEEVAKKMNLDMRKTSSLWKDQALVEINIAVLYSFQSDKVTIVDHHSATESFIKHMENEYRCRGGCPADWVWIVPPMSGSITPVFHQEMLNYRLTPSFEYQPDPWNTHVWKGTNGTPTKRRAIGFKKLAEAVKFSAKLMGQAMAKRVKATILYATETGKSQAYAKTLCEIFKHAFDAKVMSMEEYDIVHLEHETLVLVVTSTFGNGDPPENGEKFGCALMEMRHPNSVQEERKSYKVRFNSVSSYSDSQKSSGDGPDLRDNFESAGPLANVRFSVFGLGSRAYPHFCAFGHAVDTLLEELGGERILKMREGDELCGQEEAFRTWAKKVFKAACDVFCVGDDVNIEKANNSLISNDRSWKRNKFRLTFVAEAPELTQGLSNVHKKRVSAARLLSRQNLQSPKSSRSTIFVRLHTNGSQELQYQPGDHLGVFPGNHEDLVNALIERLEDAPPVNQMVKVELLEERNTALGVISNWTDELRLPPCTIFQAFKYYLDITTPPTPLQLQQFASLATSEKEKQRLLVLSKGLQEYEEWKWGKNPTIVEVLEEFPSIQMPATLLLTQLSLLQPRYYSISSSPDMYPDEVHLTVAIVSYRTRDGEGPIHHGVCSSWLNRIQADELVPCFVRGAPSFHLPRNPQVPCILVGPGTGIAPFRSFWQQRQFDIQHKGMNPCPMVLVFGCRQSKIDHIYREETLQAKNKGVFRELYTAYSREPDKPKKYVQDILQEQLAESVYRALKEQGGHIYVCGDVTMAADVLKAIQRIMTQQGKLSAEDAGVFISRMRDDNRYHEDIFGVTLRTYEVTNRLRSESIAFIEESKKDTDEVFSS

SEQ ID NO: 57088 - protein, 1468 aa, Homo sapiens
  Payload ID: 11222
  Gene Symbol: NOS1
  Gene Name: nitric oxide synthase 1 (neuronal)
  Uniprot ID: P29475
  ENSP ID: ENSP00000337459
MEDHMFGVQQIQPNVISVRLFKRKVGGLGFLVKERVSKPPVIISDLIRGGAAEQSGLIQAGDIILAVNGRPLVDLSYDSALEVLRGIASETHVVLILRGPEGFTTHLETTFTGDGTPKTIRVTQPLGPPTKAVDLSHQPPAGKEQPLAVDGASGPGNGPQHAYDDGQEAGSLPHANGLAPRPPGQDPAKKATRVSLQGRGENNELLKEIEPVLSLLTSGSRGVKGGAPAKAEMKDMGIQVDRDLDGKSHKPLPLGVENDRVFNDLWGKGNVPVVLNNPYSEKEQPPTSGKQSPTKNGSPSKCPRFLKVKNWETEVVLTDTLHLKSTLETGCTEYICMGSIMHPSQHARRPEDVRTKGQLFPLAKEFIDQYYSSIKRFGSKAHMERLEEVNKEIDTTSTYQLKDTELIYGAKHAWRNASRCVGRIQWSKLQVFDARDCTTAHGMFNYICNHVKYATNKGNLRSAITIFPQRTDGKHDFRVWNSQLIRYAGYKQPDGSTLGDPANVQFTEICIQQGWKPPRGRFDVLPLLLQANGNDPELFQIPPELVLEVPIRHPKFEWFKDLGLKWYGLPAVSNMLLEIGGLEFSACPFSGWYMGTEIGVRDYCDNSRYNILEEVAKKMNLDMRKTSSLWKDQALVEINIAVLYSFQSDKVTIVDHHSATESFIKHMENEYRCRGGCPADWVWIVPPMSGSITPVFHQEMLNYRLTPSFEYQPDPWNTHVWKGTNGTPTKRRAIGFKKLAEAVKFSAKLMGQAMAKRVKATILYATETGKSQAYAKTLCEIFKHAFDAKVMSMEEYDIVHLEHETLVLVVTSTFGNGDPPENGEKFGCALMEMRHPNSVQEERKYPEPLRFFPRKGPPLPNGDTEVHGLAAARDSQHRSYKVRFNSVSSYSDSQKSSGDGPDLRDNFESAGPLANVRFSVFGLGSRAYPHFCAFGHAVDTLLEELGGERILKMREGDELCGQEEAFRTWAKKVFKAACDVFCVGDDVNIEKANNSLISNDRSWKRNKFRLTFVAEAPELTQGLSNVHKKRVSAARLLSRQNLQSPKSSRSTIFVRLHTNGSQELQYQPGDHLGVFPGNHEDLVNALIERLEDAPPVNQMVKVELLEERNTALGVISNWTDELRLPPCTIFQAFKYYLDITTPPTPLQLQQFASLATSEKEKQRLLVLSKGLQEYEEWKWGKNPTIVEVLEEFPSIQMPATLLLTQLSLLQPRYYSISSSPDMYPDEVHLTVAIVSYRTRDGEGPIHHGVCSSWLNRIQADELVPCFVRGAPSFHLPRNPQVPCILVGPGTGIAPFRSFWQQRQFDIQHKGMNPCPMVLVFGCRQSKIDHIYREETLQAKNKGVFRELYTAYSREPDKPKKYVQDILQEQLAESVYRALKEQGGHIYVCGDVTMAADVLKAIQRIMTQQGKLSAEDAGVFISRMRDDNRYHEDIFGVTLRTYEVTNRLRSESIAFIEESKKDTDEVFSS

SEQ ID NO: 57089 - protein, 1433 aa, Homo sapiens [sequence omitted]

SEQ ID NO: 57090 - protein, 1468 aa, Homo sapiens; identical to SEQ ID NO: 57088
  Payload ID: 11222
  Gene Symbol: NOS1
  Gene Name: nitric oxide synthase 1 (neuronal)
  Uniprot ID: P29475
  ENSP ID: ENSP00000477999

SEQ ID NO: 57091 - protein, 506 aa, Homo sapiens
  Payload ID: 11223
  Gene Symbol: NOS1AP
  Gene Name: nitric oxide synthase 1 (neuronal) adaptor protein
  Uniprot ID: O75052
  ENSP ID: ENSP00000355133
MPSKTKYNLVDDGHDLRIPLHNEDAFQHGICFEAKYVGSLDVPRPNSRVEIVAAMRRIRYEFKAKNIKKKKVSIMVSVDGVKVILKKKKKLLLLQKKEWTWDESKMLVMQDPIYRIFYVSHDSQDLKIFSYIARDGASNIFRCNVFKSKKKSQAMRIVRTVGQAFEVCHKLSLQHTQQNADGQEDGESERNSNSSGDPGRQLTGAERASTATAEETDIDAVEVPLPGNDVLEFSRGVTDLDAVGKEGGSHTGSKVSHPQEPMLTASPRMLLPSSSSKPPGLGTETPLSTHHQMQLLQQLLQQQQQQTQVAVAQVHLLKDQLAAEAAARLEAQARVHQLLLQNKDMLQHISLLVKQVQELELKLSGQNAMGSQDSLLEITFRSGALPVLCDPTTPKPEDLHSPPLGAGLADFAHPAGSPLGRRDCLVKLECFRFLPPEDTPPPAQGEALLGGLELIKFRESGIASEYESNTDESEERDSWSQEELPRLLNVLQRQELGDGLDDEIAV

SEQ ID NO: 57092 - protein, 349 aa, Homo sapiens
  Payload ID: 11223
  Gene Symbol: NOS1AP
  Gene Name: nitric oxide synthase 1 (neuronal) adaptor protein
  ENSP ID: ENSP00000396713
MPSKTKYNLVDDGHDLRIPLHNEDAFQHGICFEAKYVGSLDVPRPNSRVEIVAAMRRIRYEFKAKNIKKKKVSIMVSVDGVKVILKKKKKKKEWTWDESKMLVMQDPIYRIFYVSHDSQDLKIFSYIARDGASNIFRCNVFKSKKKSQAMRIVRTVGQAFEVCHKLSLQHTQQNADGQEDGESERNSNSSGDPGRQLTGAERASTATAEETDIDAVEVPLPGNDVLEFSRGVTDLDAVGKEGGSHTGSKVSHPQEPMLTASPRMLLPSSSSKPPGLGTETPLSTHHQMQLLQQLLQQQQQQTQVAVAQCVVGQIALVLSTAISMCLLLPNFSLALPSLLMEELESRYTC

SEQ ID NO: 57093 - protein, 501 aa, Homo sapiens
  Payload ID: 11223
  Gene Symbol: NOS1AP
  Gene Name: nitric oxide synthase 1 (neuronal) adaptor protein
  Uniprot ID: O75052
  ENSP ID: ENSP00000431586
MPSKTKYNLVDDGHDLRIPLHNEDAFQHGICFEAKYVGSLDVPRPNSRVEIVAAMRRIRYEFKAKNIKKKKVSIMVSVDGVKVILKKKKKKKEWTWDESKMLVMQDPIYRIFYVSHDSQDLKIFSYIARDGASNIFRCNVFKSKKKSQAMRIVRTVGQAFEVCHKLSLQHTQQNADGQEDGESERNSNSSGDPGRQLTGAERASTATAEETDIDAVEVPLPGNDVLEFSRGVTDLDAVGKEGGSHTGSKVSHPQEPMLTASPRMLLPSSSSKPPGLGTETPLSTHHQMQLLQQLLQQQQQQTQVAVAQVHLLKDQLAAEAAARLEAQARVHQLLLQNKDMLQHISLLVKQVQELELKLSGQNAMGSQDSLLEITFRSGALPVLCDPTTPKPEDLHSPPLGAGLADFAHPAGSPLGRRDCLVKLECFRFLPPEDTPPPAQGEALLGGLELIKFRESGIASEYESNTDESEERDSWSQEELPRLLNVLQRQELGDGLDDEIAV

SEQ ID NO: 57094 - protein, 211 aa, Homo sapiens
  Payload ID: 11223
  Gene Symbol: NOS1AP
  Gene Name: nitric oxide synthase 1 (neuronal) adaptor protein
  Uniprot ID: O75052
  ENSP ID: ENSP00000434988
MSLSSLCPVFSAAASSLQVHLLKDQLAAEAAARLEAQARVHQLLLQNKDMLQHISLLVKQVQELELKLSGQNAMGSQDSLLEITFRSGALPVLCDPTTPKPEDLHSPPLGAGLADFAHPAGSPLGRRDCLVKLECFRFLPPEDTPPPAQGEALLGGLELIKFRESGIASEYESNTDESEERDSWSQEELPRLLNVLQRQELGDGLDDEIAV

SEQ ID NO: 57095 - protein, 81 aa, Homo sapiens
  Payload ID: 11223
  Gene Symbol: NOS1AP
  Gene Name: nitric oxide synthase 1 (neuronal) adaptor protein
  ENSP ID: ENSP00000435711
MLQHISLLVKQVQELELKLSGQNAMGSQDSLLEITFRSGALPVLCDPTTPKPEDLHSPPLGAGLADFAHPAGSPLGRRDCL

SEQ ID NO: 57096 - protein, 1153 aa, Homo sapiens
  Payload ID: 11224
  Gene Symbol: NOS2
  Gene Name: nitric oxide synthase 2, inducible
  Uniprot ID: P35228
  ENSP ID: ENSP00000327251
MACPWKFLFKTKFHQYAMNGEKDINNNVEKAPCATSSPVTQDDLQYHNLSKQQNESPQPLVETGKKSPESLVKLDATPLSSPRHVRIKNWGSGMTFQDTLHHKAKGILTCRSKSCLGSIMTPKSLTRGPRDKPTPPDELLPQAIEFVNQYYGSFKEAKIEEHLARVEAVTKEIETTGTYQLTGDELIFATKQAWRNAPRCIGRIQWSNLQVFDARSCSTAREMFEHICRHVRYSTNNGNIRSAITVFPQRSDGKHDFRVWNAQLIRYAGYQMPDGSIRGDPANVEFTQLCIDLGWKPKYGRFDVVPLVLQANGRDPELFEIPPDLVLEVAMEHPKYEWFRELELKWYALPAVANMLLEVGGLEFPGCPFNGWYMGTEIGVRDFCDVQRYNILEEVGRRMGLETHKLASLWKDQAVVEINIAVLHSFQKQNVTIMDHHSAAESFMKYMQNEYRSRGGCPADWIWLVPPMSGSITPVFHQEMLNYVLSPFYYYQVEAWKTHVWQDEKRRPKRREIPLKVLVKAVLFACMLMRKTMASRVRVTILFATETGKSEALAWDLGALFSCAFNPKVVCMDKYRLSCLEEERLLLVVTSTFGNGDCPGNGEKLKKSLFMLKELNNKFRYAVFGLGSSMYPRFCAFAHDIDQKLSHLGASQLTPMGEGDELSGQEDAFRSWAVQTFKAACETFDVRGKQHIQIPKLYTSNVTWDPHHYRLVQDSQPLDLSKALSSMHAKNVFTMRLKSRQNLQSPTSSRATILVELSCEDGQGLNYLPGEHLGVCPGNQPALVQGILERVVDGPTPHQTVRLEALDESGSYWVSDKRLPPCSLSQALTYFLDITTPPTQLLLQKLAQVATEEPERQRLEALCQPSEYSKWKFTNSPTFLEVLEEFPSLRVSAGFLLSQLPILKPRFYSISSSRDHTPTEIHLTVAVVTYHTRDGQGPLHHGVCSTWLNSLKPQDPVPCFVRNASGFHLPEDPSHPCILIGPGTGIAPFRSFWQQRLHDSQHKGVRGGRMTLVFGCRRPDEDHIYQEEMLEMAQKGVLHAVHTAYSRLPGKPKVYVQDILRQQLASEVLRVLHKEPGHLYVCGDVRMARDVAHTLKQLVAAKLKLNEEQVEDYFFQLKSQKRYHEDIFGAVFPYEAKKDRVAVQPSSLEMSAL

SEQ ID NO: 57097 - protein, 1114 aa, Homo sapiens
  Payload ID: 11224
  Gene Symbol: NOS2
  Gene Name: nitric oxide synthase 2, inducible
  Uniprot ID: P35228
  ENSP ID: ENSP00000482291
MACPWKFLFKTKFHQYAMNGEKDINNNVEKAPCATSSPVTQDDLQYHNLSKQQNESPQPLVETGKKSPESLVKLDATPLSSPRHVRIKNWGSGMTFQDTLHHKAKGILTCRSKSCLGSIMTPKSLTRGPRDKPTPPDELLPQAIEFVNQYYGSFKEAKIEEHLARVEAVTKEIETTGTYQLTGDELIFATKQAWRNAPRCIGRIQWSNLQVFDARSCSTAREMFEHICRHVRYSTNNGNIRSAITVFPQRSDGKHDFRVWNAQLCIDLGWKPNGRDPELFEIPPDLVLEVAMEHPKYEWFRELELKWYALPAVANMLLEVGGLEFPGCPFNGWYMGTEIGVRDFCDVQRYNILEEVGRRMGLETHKLASLWKDQAVVEINIAVLHSFQKQNVTIMDHHSAAESFMKYMQNEYRSRGGCPADWIWLVPPMSGSITPVFHQEMLNYVLSPFYYYQVEAWKTHVWQDEKRRPKRREIPLKVLVKAVLFACMLMRKTMASRVRVTILFATETGKSEALAWDLGALFSCAFNPKVVCMDKYRLSCLEEERLLLVVTSTFGNGDCPGNGEKLKKSLFMLKELNNKFRYAVFGLGSSMYPRFCAFAHDIDQKLSHLGASQLTPMGEGDELSGQEDAFRSWAVQTFKAACETFDVRGKQHIQIPKLYTSNVTWDPHHYRLVQDSQPLDLSKALSSMHAKNVFTMRLKSRQNLQSPTSSRATILVELSCEDGQGLNYLPGEHLGVCPGNQPALVQGILERVVDGPTPHQTVRLEALDESGSYWVSDKRLPPCSLSQALTYFLDITTPPTQLLLQKLAQVATEEPERQRLEALCQPSEYSKWKFTNSPTFLEVLEEFPSLRVSAGFLLSQLPILKPRFYSISSSRDHTPTEIHLTVAVVTYHTRDGQGPLHHGVCSTWLNSLKPQDPVPCFVRNASGFHLPEDPSHPCILIGPGTGIAPFRSFWQQRLHDSQHKGVRGGRMTLVFGCRRPDEDHIYQEEMLEMAQKGVLHAVHTAYSRLPGKPKVYVQDILRQQLASEVLRVLHKEPGHLYVCGDVRMARDVAHTLKQLVAAKLKLNEEQVEDYFFQLKSQKRYHEDIFGAVFPYEAKKDRVAVQPSSLEMSAL

SEQ ID NO: 57098 - protein, 1203 aa, Homo sapiens
  Payload ID: 11225
  Gene Symbol: NOS3
  Gene Name: nitric oxide synthase 3 (endothelial cell)
  Uniprot ID: P29474
  ENSP ID: ENSP00000297494
MGNLKSVAQEPGPPCGLGLGLGLGLCGKQGPATPAPEPSRAPASLLPPAPEHSPPSSPLTQPPEGPKFPRVKNWEVGSITYDTLSAQAQQDGPCTPRRCLGSLVFPRKLQGRPSPGPPAPEQLLSQARDFINQYYSSIKRSGSQAHEQRLQEVEAEVAATGTYQLRESELVFGAKQAWRNAPRCVGRIQWGKLQVFDARDCRSAQEMFTYICNHIKYATNRGNLRSAITVFPQRCPGRGDFRIWNSQLVRYAGYRQQDGSVRGDPANVEITELCIQHGWTPGNGRFDVLPLLLQAPDDPPELFLLPPELVLEVPLEHPTLEWFAALGLRWYALPAVSNMLLEIGGLEFPAAPFSGWYMSTEIGTRNLCDPHRYNILEDVAVCMDLDTRTTSSLWKDKAAVEINVAVLHSYQLAKVTIVDHHAATASFMKHLENEQKARGGCPADWAWIVPPISGSLTPVFHQEMVNYFLSPAFRYQPDPWKGSAAKGTGITRKKTFKEVANAVKISASLMGTVMAKRVKATILYGSETGRAQSYAQQLGRLFRKAFDPRVLCMDEYDVVSLEHETLVLVVTSTFGNGDPPENGESFAAALMEMSGPYNSSPRPEQHKSYKIRFNSISCSDPLVSSWRRKRKESSNTDSAGALGTLRFCVFGLGSRAYPHFCAFARAVDTRLEELGGERLLQLGQGDELCGQEEAFRGWAQAAFQAACETFCVGEDAKAAARDIFSPKRSWKRQRYRLSAQAEGLQLLPGLIHVHRRKMFQATIRSVENLQSSKSTRATILVRLDTGGQEGLQYQPGDHIGVCPPNRPGLVEALLSRVEDPPAPTEPVAVEQLEKGSPGGPPPGWVRDPRLPPCTLRQALTFFLDITSPPSPQLLRLLSTLAEEPREQQELEALSQDPRRYEEWKWFRCPTLLEVLEQFPSVALPAPLLLTQLPLLQPRYYSVSSAPSTHPGEIHLTVAVLAYRTQDGLGPLHYGVCSTWLSQLKPGDPVPCFIRGAPSFRLPPDPSLPCILVGPGTGIAPFRGFWQERLHDIESKGLQPTPMTLVFGCRCSQLDHLYRDEVQNAQQRGVFGRVLTAFSREPDNPKTYVQDILRTELAAEVHRVLCLERGHMFVCGDVTMATNVLQTVQRILATEGDMELDEAGDVIGVLRDQQRYHEDIFGLTLRTQEVTSRIRTQSFSLQERQLRGAVPWAFDPPGSDTNSP

SEQ ID NO: 57099 - protein, 997 aa, Homo sapiens
  Payload ID: 11225
  Gene Symbol: NOS3
  Gene Name: nitric oxide synthase 3 (endothelial cell)
  ENSP ID: ENSP00000417143
MFTYICNHIKYATNRGNLRSAITVFPQRCPGRGDFRIWNSQLVRYAGYRQQDGSVRGDPANVEITELCIQHGWTPGNGRFDVLPLLLQAPDDPPELFLLPPELVLEVPLEHPTLEWFAALGLRWYALPAVSNMLLEIGGLEFPAAPFSGWYMSTEIGTRNLCDPHRYNILEDVAVCMDLDTRTTSSLWKDKAAVEINVAVLHSYQLAKVTIVDHHAATASFMKHLENEQKARGGCPADWAWIVPPISGSLTPVFHQEMVNYFLSPAFRYQPDPWKGSAAKGTGITRKKTFKEVANAVKISASLMGTVMAKRVKATILYGSETGRAQSYAQQLGRLFRKAFDPRVLCMDEYDVVSLEHETLVLVVTSTFGNGDPPENGESFAAALMEMSGPYNSSPRPEQHKSYKIRFNSISCSDPLVSSWRRKRKESSNTDSAGALGTLRFCVFGLGSRAYPHFCAFARAVDTRLEELGGERLLQLGQGDELCGQEEAFRGWAQAAFQAACETFCVGEDAKAAARDIFSPKRSWKRQRYRLSAQAEGLQLLPGLIHVHRRKMFQATIRSVENLQSSKSTRATILVRLDTGGQEGLQYQPGDHIGVCPPNRPGLVEALLSRVEDPPAPTEPVAVEQLEKGSPGGPPPGWVRDPRLPPCTLRQALTFFLDITSPPSPQLLRLLSTLAEEPREQQELEALSQDPRRYEEWKWFRCPTLLEVLEQFPSVALPAPLLLTQLPLLQPRYYSVSSAPSTHPGEIHLTVAVLAYRTQDGLGPLHYGVCSTWLSQLKPGDPVPCFIRGAPSFRLPPDPSLPCILVGPGTGIAPFRGFWQERLHDIESKGLQPTPMTLVFGCRCSQLDHLYRDEVQNAQQRGVFGRVLTAFSREPDNPKTYVQDILRTELAAEVHRVLCLERGHMFVCGDVTMATNVLQTVQRILATEGDMELDEAGDVIGVLRDQQRYHEDIFGLTLRTQEVTSRIRTQSFSLQERQLRGAVPWAFDPPGSDTNSP

SEQ ID NO: 57100 - protein, 306 aa, Homo sapiens
  Payload ID: 11225
  Gene Symbol: NOS3
  Gene Name: nitric oxide synthase 3 (endothelial cell)
  ENSP ID: ENSP00000418245
  MOD_RES (1)..(1): Any amino acid
XETFCVGEDAKAAARDIFSPKRSWKRQRYRLSAQAEGLQLLPGLIHVHRRKMFQATIRSVENLQSSKSTRATILVRLDTGGQEGLQYQPGDHIGVCPPNRPGLVEALLSRVEDPPAPTEPVAVEQLEKGSPGGPPPGWVRDPRLPPCTLRQALTFFLDITSPPSPQLLRLLSTLAEEPREQQELEALSQDPRRYEEWKWFRCPTLLEVLEQFPSVALPAPLLLTQLPLLQPRYYSVSSAPSTHPGEIHLTVAVLAYRTQDGLGPLHYGVCSTWLSQLKPGDPVPCFIRGLGITGVSHRARTEGEGF

SEQ ID NO: 57101 - protein, 629 aa, Homo sapiens
  Payload ID: 11225
  Gene Symbol: NOS3
  Gene Name: nitric oxide synthase 3 (endothelial cell)
  Uniprot ID: P29474
  ENSP ID: ENSP00000420215
MGNLKSVAQEPGPPCGLGLGLGLGLCGKQGPATPAPEPSRAPASLLPPAPEHSPPSSPLTQPPEGPKFPRVKNWEVGSITYDTLSAQAQQDGPCTPRRCLGSLVFPRKLQGRPSPGPPAPEQLLSQARDFINQYYSSIKRSGSQAHEQRLQEVEAEVAATGTYQLRESELVFGAKQAWRNAPRCVGRIQWGKLQVFDARDCRSAQEMFTYICNHIKYATNRGNLRSAITVFPQRCPGRGDFRIWNSQLVRYAGYRQQDGSVRGDPANVEITELCIQHGWTPGNGRFDVLPLLLQAPDDPPELFLLPPELVLEVPLEHPTLEWFAALGLRWYALPAVSNMLLEIGGLEFPAAPFSGWYMSTEIGTRNLCDPHRYNILEDVAVCMDLDTRTTSSLWKDKAAVEINVAVLHSYQLAKVTIVDHHAATASFMKHLENEQKARGGCPADWAWIVPPISGSLTPVFHQEMVNYFLSPAFRYQPDPWKGSAAKGTGITRKKTFKEVANAVKISASLMGTVMAKRVKATILYGSETGRAQSYAQQLGRLFRKAFDPRVLCMDEYDVVSLEHETLVLVVTSTFGNGDPPENGEGLTLWPRLECSSTITAHCSLNLLDSSNPPTSTSQVVGTTGACHDA

SEQ ID NO: 57102 - protein, 614 aa, Homo sapiens
  Payload ID: 11225
  Gene Symbol: NOS3
  Gene Name: nitric oxide synthase 3 (endothelial cell)
  ENSP ID: ENSP00000420551
MGNLKSVAQEPGPPCGLGLGLGLGLCGKQGPATPAPEPSRAPASLLPPAPEHSPPSSPLTQPPEGPKFPRVKNWEVGSITYDTLSAQAQQDGPCTPRRCLGSLVFPRKLQGRPSPGPPAPEQLLSQARDFINQYYSSIKRSGSQAHEQRLQEVEAEVAATGTYQLRESELVFGAKQAWRNAPRCVGRIQWGKLQVFDARDCRSAQEMFTYICNHIKYATNRGNLRSAITVFPQRCPGRGDFRIWNSQLVRYAGYRQQDGSVRGDPANVEITELCIQHGWTPGNGRFDVLPLLLQAPDDPPELFLLPPELVLEVPLEHPTLEWFAALGLRWYALPAVSNMLLEIGGLEFPAAPFSGWYMSTEIGTRNLCDPHRYNILEDVAVCMDLDTRTTSSLWKDKAAVEINVAVLHSYQLAKVTIVDHHAATASFMKHLENEQKARGGCPADWAWIVPPISGSLTPVFHQEMVNYFLSPAFRYQPDPWKGSAAKGTGITRKKTFKEVANAVKISASLMGTVMAKRVKATILYGSETGRAQSYAQQLGRLFRKAFDPRVLCMDEYDVVSLEHETLVLVVTSTFGNGDPPENGERWGFAMLPRLVSNSWVQAIHLPRPPKVLRL

SEQ ID NO: 57103 - protein, 304 aa, Homo sapiens
  Payload ID: 11226
  Gene Symbol: NOSIP
  Gene Name: nitric oxide synthase interacting protein
  ENSP ID: ENSP00000343497
MTRHGKNCTAGAVYTYHEKKKDTAASGYGTQNIRLSRDAVKDFDCCCLSLQPCHDPVVTPDGYLYEREAILEYILHQKKEIARQMKAYEKQRGTRREEQKELQRAASQDHVRGFLEKESAIVSRPLNPFTAKALSGTSPGDSDDVQPGPSVGPPSKDKDKVLPSFWIPSLTPEAKATKLEKPSRTVTCPMSGKPLRMSDLTPVHFTPLDSSVDRVGLITRSERYVCAVTRDSLSNATPCAVLRPSGAVVTLECVEKLIRKDMVDPVTGDKLTDRDIIVLQRGGTGFAGSGVKLQAEKSRPVMQA

SEQ ID NO: 57104 - protein, 96 aa, Homo sapiens
  Payload ID: 11226
  Gene Symbol: NOSIP
  Gene Name: nitric oxide synthase interacting protein
  ENSP ID: ENSP00000468974
MTRHGKNCTAGAVYTYHEKKKDTAASGYGTQNIRLSRDAVKDFDCCCLSLQPCHDPVVTPDGYLYEREAILEYILHQKKEIARQMKAYEKQRGTRR

SEQ ID NO: 57105 - protein, 301 aa, Homo sapiens
  Payload ID: 11226
  Gene Symbol: NOSIP
  Gene Name: nitric oxide synthase interacting protein
  Uniprot ID: Q9Y314
  ENSP ID: ENSP00000470034
MTRHGKNCTAGAVYTYHEKKKDTAASGYGTQNIRLSRDAVKDFDCCCLSLQPCHDPVVTPDGYLYEREAILEYILHQKKEIARQMKAYEKQRGTRREEQKELQRAASQDHVRGFLEKESAIVSRPLNPFTAKALSGTSPDDVQPGPSVGPPSKDKDKVLPSFWIPSLTPEAKATKLEKPSRTVTCPMSGKPLRMSDLTPVHFTPLDSSVDRVGLITRSERYVCAVTRDSLSNATPCAVLRPSGAVVTLECVEKLIRKDMVDPVTGDKLTDRDIIVLQRGGTGFAGSGVKLQAEKSRPVMQA

SEQ ID NO: 57106 - protein, 232 aa, Homo sapiens
  Payload ID: 11226
  Gene Symbol: NOSIP
  Gene Name: nitric oxide synthase interacting protein
  ENSP ID: ENSP00000470450
  MOD_RES (1)..(1): Any amino acid
XDTAASGYGTQNIRLSRDAVKDFDCCCLSLQPCHDPVVTPDGYLYEREAILEYILHQKKEIARQMKAYEKQRGTRREEQKELQRAASQDHVRGFLEKESAIVSRPLNPFTAKALSGTSPDDVQPGPSVGPPSKDKDKVLPSFWIPSLTPEAKATKLEKPWGCGHPRMRGEADSEGHGGPCDWRQTHRPRHHRAAAGRYRLRGLRSEAASGEITAGDAGLSVCGRPNKPAWVR

SEQ ID NO: 57107 - protein, 63 aa, Homo sapiens
  Payload ID: 11226
  Gene Symbol: NOSIP
  Gene Name: nitric oxide synthase interacting protein
  ENSP ID: ENSP00000471291
MTRHGKNCTAGAVYTYHEKKKDTAASGYGTQNIRLSRDAVKDFDCCCLSLQPCHDPVVTWLPV

SEQ ID NO: 57108 - protein, 176 aa, Homo sapiens
  Payload ID: 11226
  Gene Symbol: NOSIP
  Gene Name: nitric oxide synthase interacting protein
  ENSP ID: ENSP00000471929
MTRHGKNCTAGAVYTYHEKKKDTAASGYGTQNIRLSRDAVKDFDCCCLSLQPCHDPVVTPDGYLYEREAILEYILHQKKEIARQMKAYEKQRGTRREEQKELQRAASQDHVRGFLEKESAIVSRPLNPFTAKALSGTSPDDVQPGPSVGPPNSSVDRVGLITRSERYVCAVTRDSL

SEQ ID NO: 57109 - protein, 63 aa, Homo sapiens; identical to SEQ ID NO: 57107
  Payload ID: 11226
  Gene Symbol: NOSIP
  Gene Name: nitric oxide synthase interacting protein
  ENSP ID: ENSP00000472103

SEQ ID NO: 57110 - protein, 241 aa, Homo sapiens
  Payload ID: 11226
  Gene Symbol: NOSIP
  Gene Name: nitric oxide synthase interacting protein
  ENSP ID: ENSP00000473109
MTRHGKNCTAGAVYTYHEKKKDTAASGYGTQNIRLSRDAVKDFDCCCLSLQPCHDPVVTPDGYLYEREAILEYILHQKKEIARQMKAYEKQRGTRREEQKELQRAASQDHVRGFLEKESAIVSRPLNPFTAKALSGTSPDDVQPGPSVGPPSKDKDKVLPSFWIPSLTPEAKATKLEKPSRTVTCPMSGKPLRMSDLTPVHFTPLDSSVDRVGLITRSERYVCAVTRDSLSNATPCAVLRP

SEQ ID NO: 57111 - protein, 506 aa, Homo sapiens
  Payload ID: 11227
  Gene Symbol: NOSTRIN
  Gene Name: nitric oxide synthase trafficking
  Uniprot ID: Q8IVI9
  ENSP ID: ENSP00000318921
MRDPLTDCPYNKVYKNLKEFSQNGENFCKQVTSVLQQRANLEISYAKGLQKLASKLSKALQNTRKSCVSSAWAWASEGMKSTADLHQKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKEDENYYQKNMAGYSTRLKWENTLENCYQSILELEKERIQLLCNNLNQYSQHISLFGQTLTTCHTQIHCAISKIDIEKDIQAVMEETAILSTENKSEFLLTDYFEEDPNSAMDKERRKSLLKPKLLRLQRDIEKASKDKEGLERMLKTYSSTSSFSDAKSQKDTAALMDENNLKLDLLEANSYKLSSMLAELEQRPQPSHPCSNSIFRWREKEHTHSYVKISRPFLMKRLENIVSKASSGGQSNPGSSTPAPGAAQLSSRLCKALYSFQARQDDELNLEKGDIVIIHEKKEGGWWFGSLNGKKGHFPAAYVEELPSNAGNTATKA

SEQ ID NO: 57112 - protein, 428 aa, Homo sapiens
  Payload ID: 11227
  Gene Symbol: NOSTRIN
  Gene Name: nitric oxide synthase trafficking
  Uniprot ID: Q8IVI9
  ENSP ID: ENSP00000380390
MKSTADLHQKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKEDENYYQKNMAGYSTRLKWENTLENCYQSILELEKERIQLLCNNLNQYSQHISLFGQTLTTCHTQIHCAISKIDIEKDIQAVMEETAILSTENKSEFLLTDYFEEDPNSAMDKERRKSLLKPKLLRLQRDIEKASKDKEGLERMLKTYSSTSSFSDAKSQKDTAALMDENNLKLDLLEANSYKLSSMLAELEQRPQPSHPCSNSIFRWREKEHTHSYVKISRPFLMKRLENIVSKASSGGQSNPGSSTPAPGAAQLSSRLCKALYSFQARQDDELNLEKGDIVIIHEKKEGGWWFGSLNGKKGHFPAAYVEELPSNAGNTATKA

SEQ ID NO: 57113 - protein, 478 aa, Homo sapiens
  Payload ID: 11227
  Gene Symbol: NOSTRIN
  Gene Name: nitric oxide synthase trafficking
  Uniprot ID: Q8IVI9
  ENSP ID: ENSP00000380392
MRDPLTDCPYNKVYKNLKEFSQNGENFCKQVTSVLQQSCVSSAWAWASEGMKSTADLHQKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKEDENYYQKNMAGYSTRLKWENTLENCYQSILELEKERIQLLCNNLNQYSQHISLFGQTLTTCHTQIHCAISKIDIEKDIQAVMEETAILSTENKSEFLLTDYFEEDPNSAMDKERRKSLLKPKLLRLQRDIEKASKDKEGLERMLKTYSSTSSFSDAKSQKDTAALMDENNLKLDLLEANSYKLSSMLAELEQRPQPSHPCSNSIFRWREKEHTHSYVKISRPFLMKRLENIVSKASSGGQSNPGSSTPAPGAAQLSSRLCKALYSFQARQDDELNLEKGDIVIIHEKKEGGWWFGSLNGKKGHFPAAYVEELPSNAGNTATKA

SEQ ID NO: 57114 - protein, 20 aa, Homo sapiens
  Payload ID: 11227
  Gene Symbol: NOSTRIN
  Gene Name: nitric oxide synthase trafficking
  ENSP ID: ENSP00000388597
  MOD_RES (1)..(1): Any amino acid
XQRDIEKASKDKEEVRHVRL

SEQ ID NO: 57115 - protein, 165 aa, Homo sapiens
  Payload ID: 11227
  Gene Symbol: NOSTRIN
  Gene Name: nitric oxide synthase trafficking
  ENSP ID: ENSP00000390383
MKSTADLHQKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKEDENYYQKNMAGYSTRLKWENTLENCYQSILELEKERIQLLCNNLNQYSQHISLFGQTLTT

SEQ ID NO: 57116 - protein, 563 aa, Homo sapiens
  Payload ID: 11227
  Gene Symbol: NOSTRIN
  Gene Name: nitric oxide synthase trafficking
  Uniprot ID: Q8IVI9
  ENSP ID: ENSP00000394051
MRDPLTDCPYNKVYKNLKEFSQNGENFCKQVTSVLQQRANLEISYAKGLQKLASKLSKALQNTRKSCVSSAWAWASEGMKSTADLHQKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKEDENYYQKNMAGYSTRLKWENTLENCYQVTHSICLYAFWVKRAWGKCVSDLRYQDTFLPGNLPPLWFGYDIVKRLIMRLCSVCLQSILELEKERIQLLCNNLNQYSQHISLFGQTLTTCHTQIHCAISKIDIEKDIQAVMEETAILSTENKSEFLLTDYFEEDPNSAMDKERRKSLLKPKLLRLQRDIEKASKDKEGLERMLKTYSSTSSFSDAKSQKDTAALMDENNLKLDLLEANSYKLSSMLAELEQRPQPSHPCSNSIFRWREKEHTHSYVKISRPFLMKRLENIVSKASSGGQSNPGSSTPAPGAAQLSSRLCKALYSFQARQDDELNLEKGDIVIIHEKKEGGWWFGSLNGKKGHFPAAYVEELPSNAGNTATKA

SEQ ID NO: 57117 - protein, 563 aa, Homo sapiens; identical to SEQ ID NO: 57116
  Payload ID: 11227
  Gene Symbol: NOSTRIN
  Gene Name: nitric oxide synthase trafficking
  Uniprot ID: Q8IVI9
  ENSP ID: ENSP00000402140

SEQ ID NO: 57118 - protein, 428 aa, Homo sapiens; identical to SEQ ID NO: 57112
  Payload ID: 11227
  Gene Symbol: NOSTRIN
  Gene Name: nitric oxide synthase trafficking
  Uniprot ID: Q8IVI9
  ENSP ID: ENSP00000404413

SEQ ID NO: 57119 - protein, 97 aa, Homo sapiens
  Payload ID: 11227
  Gene Symbol: NOSTRIN
  Gene Name: nitric oxide synthase trafficking
  ENSP ID: ENSP00000415337
MRDPLTDCPYNKVYKNLKEFSQNGENFCKQVTSVLQQRDGVLILLLRLECSGAIIACCSLRLLCSRTPLASASQVARTAGQTWKLAMPKDFRNWQAS

SEQ ID NO: 57120 - protein, 20 aa, Homo sapiens
  Payload ID: 11227
  Gene Symbol: NOSTRIN
  Gene Name: nitric oxide synthase trafficking
  ENSP ID: ENSP00000478446
  MOD_RES (1)..(1): Any amino acid
XQRDIEKASKDKEEVRHVRL

SEQ ID NO: 57121 - protein, 392 aa, Homo sapiens
  Payload ID: 11227
  Gene Symbol: NOSTRIN
  Gene Name: nitric oxide synthase trafficking
  ENSP ID: ENSP00000478690
LDNEVEKTANLVISNWNQQIKAKKKLMVSTKKHEALFQLVESSKQSMTEKEKRKLLNKLTKSTEKLEKEDENYYQKNMAGYSTRLKWENTLENCYQSILELEKERIQLLCNNLNQYSQHISLFGQTLTTCHTQIHCAISKIDIEKDIQAVMEETAILSTENKSEFLLTDYFEEDPNSAMDKERRKSLLKPKLLRLQRDIEKASKDKEGLERMLKTYSSTSSFSDAKSQKDTAALMDENNLKLDLLEANSYKLSSMLAELEQRPQPSHPCSNSIFRWREKEHTHSYVKISRPFLMKRLENIVSKASSGGQSNPGSSTPAPGAAQLSSRLCKALYSFQARQDDELNLEKGDIVIIHEKKEEGWWFGSLNGKKGHFPAAYVEELPSNAGNTATKA

SEQ ID NO: 57122 - protein, 392 aa, Homo sapiens; identical to SEQ ID NO: 57121
  Payload ID: 11227
  Gene Symbol: NOSTRIN
  Gene Name: nitric oxide synthase trafficking
  ENSP ID: ENSP00000480854

SEQ ID NO: 57123 - protein, 392 aa, Homo sapiens; identical to SEQ ID NO: 57121
  Payload ID: 11227
  Gene Symbol: NOSTRIN
  Gene Name: nitric oxide synthase trafficking
  ENSP ID: ENSP00000481062

SEQ ID NO: 57124 - protein, 129 aa, Homo sapiens
  Payload ID: 11227
  Gene Symbol: NOSTRIN
  Gene Name: nitric oxide synthase trafficking
  ENSP ID: ENSP00000481671
LDNEVEKTANLVISNWNQQIKAKKKLMVSTKKHEALFQLVESSKQSMTEKEKRKLLNKLTKSTEKLEKEDENYYQKNMAGYSTRLKWENTLENCYQSILELEKERIQLLCNNLNQYSQHISLFGQTLTT

SEQ ID NO: 57125 - protein, 392 aa, Homo sapiens; identical to SEQ ID NO: 57121
  Payload ID: 11227
  Gene Symbol: NOSTRIN
  Gene Name: nitric oxide synthase trafficking
  ENSP ID: ENSP00000483177

SEQ ID NO: 57126 - protein, 392 aa, Homo sapiens; identical to SEQ ID NO: 57121
  Payload ID: 11227
  Gene Symbol: NOSTRIN
  Gene Name: nitric oxide synthase trafficking
  ENSP ID: ENSP00000484358

SEQ ID NO: 57127 - protein, 449 aa, Homo sapiens
  Payload ID: 11227
  Gene Symbol: NOSTRIN
  Gene Name: nitric oxide synthase trafficking
  ENSP ID: ENSP00000484418
LDNEVEKTANLVISNWNQQIKAKKKLMVSTKKHEALFQLVESSKQSMTEKEKRKLLNKLTKSTEKLEKEDENYYQKNMAGYSTRLKWENTLENCYQVTHSICLYAFWVKRAWGKCVSDLRYQDIFLPGNLPPLWFGYDIVKRLIMRLCSVCLQSILELEKERIQLLCNNLNQYSQHISLFGQTLTTCHTQIHCAISKIDIEKDIQAVMEETAILSTENKSEFLLTDYFEEDPNSAMDKERRKSLLKPKLLRLQRDIEKASKDKEGLERMLKTYSSTSSFSDAKSQKDTAALMDENNLKLDLLEANSYKLSSMLAELEQRPQPSHPCSNSIFRWREKEHTHSYVKISRPFLMKRLENIVSKASSGGQSNPGSSTPAPGAAQLSSRLCKALYSFQARQDDELNLEKGDIVIIHEKKEEGWWFGSLNGKKGHFPAAYVEELPSNAGNTATKA

SEQ ID NO: 57128 - protein, 478 aa, Homo sapiens; identical to SEQ ID NO: 57113
  Payload ID: 11227
  Gene Symbol: NOSTRIN
  Gene Name: nitric oxide synthase trafficking
  Uniprot ID: Q8IVI9
  ENSP ID: ENSP00000485819

SEQ ID NO: 57129 - protein, 312 aa, Homo sapiens
  Payload ID: 11228
  Gene Symbol: NIT1
  Gene Name: nitrilase 1
  Uniprot ID: Q86X76
  ENSP ID: ENSP00000356986
MTFGLRKRLSEERGFSLMPRAMAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSKGAVVATYRKTHLCDVEIPGQGPMCESNSTMPGPSLESPVSTPAGKIGLAVCYDMRFPELSLALAQAGAEILTYPSAFGSITGPAHWEVLLRARAIETQCYVVAAAQCGRHHEKRASYGHSMVVDPWGTVVARCSEGPGLCLARIDLNYLRQLRRHLPVFQHRRPDLYGNLGHPLS

SEQ ID NO: 57130 - protein, 243 aa, Homo sapiens
  Payload ID: 11228
  Gene Symbol: NIT1
  Gene Name: nitrilase 1
  Uniprot ID: Q86X76
  ENSP ID: ENSP00000356987
MLGFITRPPHRFLSLLCPGLRIPQLSVLCAQPRPRAMAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSKGAVVATYRKTHLCDVEIPGQGPMCESNSTMPGPSLESPVSTPAGKIGLAVCYDMRFPELSLALAQAGAEILTYPSAFGSITGPAHWEPVSS

SEQ ID NO: 57131 - protein, 327 aa, Homo sapiens
  Payload ID: 11228
  Gene Symbol: NIT1
  Gene Name: nitrilase 1
  Uniprot ID: Q86X76
  ENSP ID: ENSP00000356988
MLGFITRPPHRFLSLLCPGLRIPQLSVLCAQPRPRAMAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSKGAVVATYRKTHLCDVEIPGQGPMCESNSTMPGPSLESPVSTPAGKIGLAVCYDMRFPELSLALAQAGAEILTYPSAFGSITGPAHWEVLLRARAIETQCYVVAAAQCGRHHEKRASYGHSMVVDPWGTVVARCSEGPGLCLARIDLNYLRQLRRHLPVFQHRRPDLYGNLGHPLS

SEQ ID NO: 57132 - protein, 291 aa, Homo sapiens
  Payload ID: 11228
  Gene Symbol: NIT1
  Gene Name: nitrilase 1
  Uniprot ID: Q86X76
  ENSP ID: ENSP00000376028
MAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSKGAVVATYRKTHLCDVEIPGQGPMCESNSTMPGPSLESPVSTPAGKIGLAVCYDMRFPELSLALAQAGAEILTYPSAFGSITGPAHWEVLLRARAIETQCYVVAAAQCGRHHEKRASYGHSMVVDPWGTVVARCSEGPGLCLARIDLNYLRQLRRHLPVFQHRRPDLYGNLGHPLS

SEQ ID NO: 57133 - protein, 276 aa, Homo sapiens
  Payload ID: 11229
  Gene Symbol: NIT2
  Gene Name: nitrilase family, member 2
  Uniprot ID: Q9NQR4
  ENSP ID: ENSP00000377696
MTSFRLALIQLQISSIKSDNVTRACSFIREAATQGAKIVSLPECFNSPYGAKYFPEYAEKIPGESTQKLSEVAKECSIYLIGGSIPEEDAGKLYNTCAVFGPDGTLLAKYRKIHLFDIDVPGKITFQESKTLSPGDSFSTFDTPYCRVGLGICYDMRFAELAQIYAQRGCQLLVYPGAFNLTTGPAHWELLQRSRAVDNQVYVATASPARDDKASYVAWGHSTVVNPWGEVLAKAGTEEAIVYSDIDLKKLAEIRQQIPVFRQKRSDLYAVEMKKP

SEQ ID NO: 57134 - protein, 92 aa, Homo sapiens
  Payload ID: 11229
  Gene Symbol: NIT2
  Gene Name: nitrilase family, member 2
  ENSP ID: ENSP00000419157
MTSFRLALIQLQISSIKSDNVTRACSFIREAATQGAKIVSLPECFNSPYGAKYFPEYAEKIPGESTQKLSEVAKECSIYLIGGNFLPTRLYP

SEQ ID NO: 57135 - protein, 265 aa, Homo sapiens
  Payload ID: 11229
  Gene Symbol: NIT2
  Gene Name: nitrilase family, member 2
  ENSP ID: ENSP00000419189
  MOD_RES (1)..(1): Any amino acid
XPRAAARVRAAGEALERRRRWLGRLSPSAPRPRRARPSLRRASAWVRDRVAGRPGALPGFQASGVAGEAQKAPGHPAAPAPAASCLTEADGRVFLHAFRLALIQLQISSIKSDNVTRACSFIREAATQGAKIVSLPECFNSPYGAKYFPEYAEKIPGESTQKLSEVAKECSIYLIGGSIPEEDAGKLYNTCAVFGPDGTLLAKYRKIHLFDIDVPGKITFQESKTLSPGDSFSTFDTPYCRVGLGICYDMRFAELAQIYAQRGEA

SEQ ID NO: 57136 - protein, 44 aa, Homo sapiens
  Payload ID: 11229
  Gene Symbol: NIT2
  Gene Name: nitrilase family, member 2
  ENSP ID: ENSP00000419239
MTCKWRGRALQLEFGPRGRLWSGAGGGSAGSAPPPRVPAVRGLP

SEQ ID NO: 57137 - protein, 411 aa, Homo sapiens
  Payload ID: 11230
  Gene Symbol: NKX1-1
  Gene Name: NK1 homeobox 1
  Uniprot ID: Q15270
  ENSP ID: ENSP00000407978
MDGRAELPAFPRAGAPPLAASDTVPAAPEGAGAARPAAPLRPTSFSVLDILDPNKFNSRRRRCVLLGPVAPAACAPCASAPCAPAPAASGRPPRAEELERRALAGAGGVGAAGAEPPNAGDPFKAGEAETNDTNGYSSGGGGHSPSADSGDEVPDDEDDDEDEAPETEAARGAEEARGGGGGLGARGSGCQGAAETDASPGATVDEAAAPGPRENSPVAQGPPGGAAAPGGAGTTPQGTATAAKPKRKRTGSDSKSGKPRRARTAFTYEQLVALENKFKATRYLSVCERLNLALSLSLTETQVKIWFQNRRTKWKKQNPGADTSAPTGGGGGPGPGAGPGTGLPGGLSPLSPSPPMGAPLGMHGPAGYPAHGPGGLVCAAQLPFLSSPAVLSPFVLGSQTYGAPAFYAPHL

SEQ ID NO: 57138 - protein, 310 aa, Homo sapiens
  Payload ID: 11231
  Gene Symbol: NKX1-2
  Gene Name: NK1 homeobox 2
  Uniprot ID: Q9UD57
  ENSP ID: ENSP00000451945
MLAWQDGGAKAAPSHHKISFSVLDILDPQKFTRAALPAVRPAPREARKSLAEVEAGKDASSRDPVRQLETPDAAGPGAGQASPLEGSEAEEEEDAEDPRRPRLRERAARLLPGLARSPDAPAGALASGEPCEDGGGGPVRSPPGSPGSPRPRRRRLEPNCAKPRRARTAFTYEQLVALENKFRATRYLSVCERLNLALSLSLTETQVKIWFQNRRTKWKKQNPGADGAAQVGGGAPQPGAAGGGGGGGSGGSPGPPGTGALHFQTFPSYSAANVLFPSAASFPLTAAAPGSPFAPFLGPSYLTPFYAPRL

SEQ ID NO: 57139 - protein, 401 aa, Homo sapiens
  Payload ID: 11232
  Gene Symbol: NKX2-1
  Gene Name: NK2 homeobox 1
  Uniprot ID: P43699
  ENSP ID: ENSP00000346879
MWSGGSGKARGWEAAAGGRSSPGRLSRRRIMSMSPKHTTPFSVSDILSPLEESYKKVGMEGGGLGAPLAAYRQGQAAPPTAAMQQHAVGHHGAVTAAYHMTAAGVPQLSHSAVGGYCNGNLGNMSELPPYQDTMRNSASGPGWYGANPDPRFPAISRFMGPASGMNMSGMGGLGSLGDVSKNMAPLPSAPRRKRRVLFSQAQVYELERRFKQQKYLSAPEREHLASMIHLTPTQVKIWFQNHRYKMKRQAKDKAAQQQLQQDSGGGGGGGGTGCPQQQQAQQQSPRRVAVPVLVKDGKPCQAGAPAPGAASLQGHAQQQAQHQAQAAQAAAAAISVGSGGAGLGAHPGHQPGSAGQSPDLAHHAASPAALQGQVSSLSHLNSSGSDYGTMSCSTLLYGRTW

SEQ ID NO: 57140 - protein, 371 aa, Homo sapiens
  Payload ID: 11232
  Gene Symbol: NKX2-1
  Gene Name: NK2 homeobox 1
  Uniprot ID: P43699
  ENSP ID: ENSP00000428341
MSMSPKHTTPFSVSDILSPLEESYKKVGMEGGGLGAPLAAYRQGQAAPPTAAMQQHAVGHHGAVTAAYHMTAAGVPQLSHSAVGGYCNGNLGNMSELPPYQDTMRNSASGPGWYGANPDPRFPAISRFMGPASGMNMSGMGGLGSLGDVSKNMAPLPSAPRRKRRVLFSQAQVYELERRFKQQKYLSAPEREHLASMIHLTPTQVKIWFQNHRYKMKRQAKDKAAQQQLQQDSGGGGGGGGTGCPQQQQAQQQSPRRVAVPVLVKDGKPCQAGAPAPGAASLQGHAQQQAQHQAQAAQAAAAAISVGSGGAGLGAHPGHQPGSAGQSPDLAHHAASPAALQGQVSSLSHLNSSGSDYGTMSCSTLLYGRTW

SEQ ID NO: 57141 - protein, 371 aa, Homo sapiens; identical to SEQ ID NO: 57140
  Payload ID: 11232
  Gene Symbol: NKX2-1
  Gene Name: NK2 homeobox 1
  Uniprot ID: P43699
  ENSP ID: ENSP00000429519

SEQ ID NO: 57142 - protein, 371 aa, Homo sapiens; identical to SEQ ID NO: 57140
  Payload ID: 11232
  Gene Symbol: NKX2-1
  Gene Name: NK2 homeobox 1
  Uniprot ID: P43699
  ENSP ID: ENSP00000429607

SEQ ID NO: 57143 - protein, 34 aa, Homo sapiens
  Payload ID: 11232
  Gene Symbol: NKX2-1
  Gene Name: NK2 homeobox 1
  ENSP ID: ENSP00000449302
MWSGGSGKARGWEAAAGGRSSPGRLSAYAPPLVA

SEQ ID NO: 57144 - protein, 273 aa, Homo sapiens
  Payload ID: 11233
  Gene Symbol: NKX2-2
  Gene Name: NK2 homeobox 2
  Uniprot ID: O95096
  ENSP ID: ENSP00000366347
MSLTNTKTGFSVKDILDLPDTNDEEGSVAEGPEEENEGPEPAKRAGPLGQGALDAVQSLPLKNPFYDSSDNPYTRWLASTEGLQYSLHGLAAGAPPQDSSSKSPEPSADESPDNDKETPGGGGDAGKKRKRRVLFSKAQTYELERRFRQQRYLSAPEREHLASLIRLTPTQVKIWFQNHRYKMKRARAEKGMEVTPLPSPRRVAVPVLVRDGKPCHALKAQDLAAATFQAGIPFSAYSAQSLQHMQYNAQYSSASTPQYPTAHPLVQAQQWTW

SEQ ID NO: 57145 - protein, 364 aa, Homo sapiens
  Payload ID: 11234
  Gene Symbol: NKX2-3
  Gene Name: NK2 homeobox 3
  Uniprot ID: Q8TAU0
  ENSP ID: ENSP00000342828
MMLPSPVTSTPFSVKDILNLEQQHQHFHGAHLQADLEHHFHSAPCMLAAAEGTQFSDGGEEDEEDEGEKLSYLNSLAAADGHGDSGLCPQGYVHTVLRDSCSEPKEHEEEPEVVRDRSQKSCQLKKSLETAGDCKAAEESERPKPRSRRKPRVLFSQAQVFELERRFKQQRYLSAPEREHLASSLKLTSTQVKIWFQNRRYKCKRQRQDKSLELGAHAPPPPPRRVAVPVLVRDGKPCVTPSAQAYGAPYSVGASAYSYNSFPAYGYGNSAAAAAAAAAAAAAAAAYSSSYGCAYPAGGGGGGGGTSAATTAMQPACSAAGGGPFVNVSNLGGFGSGGSAQPLHQGTAAGAACAQGTLQGIRAW

SEQ ID NO: 57146 - protein, 296 aa, Homo sapiens
  Payload ID: 11234
  Gene Symbol: NKX2-3
  Gene Name: NK2 homeobox 3
  ENSP ID: ENSP00000479692
MMLPSPVTSTPFSVKDILNLEQQHQHFHGAHLQADLEHHFHSAPCMLAAAEGTQFSDGGEEDEEDEGEKLSYLNSLAAADGHGDSGLCPQGYVHTVLRDSCSEPKEHEEEPEVVRDRSQKSCQLKKSLETAGDCKAAEESERPKPRSRRKPRVLFSQAQVFELERRFKQQRYLSAPEREHLASSLKLTSTQVKIWFQNRRYKCKRQRQDKSLELGAHAPPPPPRRVAVPVLVRDGKPCVTPSAQAYGAPYSVGASAYSYNSFPAYGYGNSAAAAAGPPRRPLPCSPPAARPEAAPL

SEQ ID NO: 57147 - protein, 354 aa, Homo sapiens
  Payload ID: 11235
  Gene Symbol: NKX2-4
  Gene Name: NK2 homeobox 4
  Uniprot ID: Q9H2Z4
  ENSP ID: ENSP00000345147
MSLSPKHTTPFSVSDILSPIEETYKKFSGAMDGAPPGLGAPLGAAAAYRAPPPGPSSQAATVAGMQPSHAMAGHNAAAAAAAAAAAAAAAATYHMPPGVSQFPHGAMGSYCNGGLGNMGELPAYTDGMRGGAATGWYGANPDPRYSSISRFMGPSAGVNVAGMGSLTGIADAAKSLGPLHAAAAAAAPRRKRRVLFSQAQVYELERRFKQQKYLSAPEREHLASMIHLTPTQVKIWFQNHRYKMKRQAKDKAAQQLQQEGGLGPPPPPPPSPRRVAVPVLVKDGKPCQNGASTPTPGQAGPQPPAPTPAPELEELSPSPPALHGPGGGLAALDAAAGEYSGGVLGANLLYGRTW

SEQ ID NO: 57148 - protein, 324 aa, Homo sapiens
  Payload ID: 11236
  Gene Symbol: NKX2-5
  Gene Name: NK2 homeobox 5
  Uniprot ID: P52952
  ENSP ID: ENSP00000327758
MFPSPALTPTPFSVKDILNLEQQQRSLAAAGELSARLEATLAPSSCMLAAFKPEAYAGPEAAAPGLPELRAELGRAPSPAKCASAFPAAPAFYPRAYSDPDPAKDPRAEKKELCALQKAVELEKTEADNAERPRARRRRKPRVLFSQAQVYELERRFKQQRYLSAPERDQLASVLKLTSTQVKIWFQNRRYKCKRQRQDQTLELVGLPPPPPPPARRIAVPVLVRDGKPCLGDSAPYAPAYGVGLNPYGYNAYPAYPGYGGAACSPGYSCTAAYPAGPSPAQPATAAANNNFVNFGVGDLNAVQSPGIPQSNSGVSTLHGIRAW

SEQ ID NO: 57149 - protein, 112 aa, Homo sapiens
  Payload ID: 11236
  Gene Symbol: NKX2-5
  Gene Name: NK2 homeobox 5
  Uniprot ID: P52952
  ENSP ID: ENSP00000395378
MFPSPALTPTPFSVKDILNLEQQQRSLAAAGELSARLEATLAPSSCMLAAFKPEAYAGPEAAAPGLPELRAELGRAPSPAKCASAFPAAPAFYPRAYSDPDPAKDPRAEKKA

SEQ ID NO: 57150 - protein, 151 aa, Homo sapiens
  Payload ID: 11236
  Gene Symbol: NKX2-5
  Gene Name: NK2 homeobox 5
  Uniprot ID: P52952
  ENSP ID: ENSP00000427906
MFPSPALTPTPFSVKDILNLEQQQRSLAAAGELSARLEATLAPSSCMLAAFKPEAYAGPEAAAPGLPELRAELGRAPSPAKCASAFPAAPAFYPRAYSDPDPAKDPRAEKKGCELPRGQRPPVLFSSALSQPDFLQMLSETCRWLPVHLAE

SEQ ID NO: 57151 - protein, 142 aa, Homo sapiens
  Payload ID: 11236
  Gene Symbol: NKX2-5
  Gene Name: NK2 homeobox 5
  ENSP ID: ENSP00000429905
MFPSPALTPTPFSVKDILNLEQQQRSLAAAGELSARLEATLAPSSCMLAAFKPEAYAGPEAAAPGLPELRAELGRAPSPAKCASAFPAAPAFYPRAYSDPDPAKDPRAEKKAQLAGAARAERFPRGKVRKCCATAGTREWTR

SEQ ID NO: 57152 - protein, 301 aa, Homo sapiens
  Payload ID: 11237
  Gene Symbol: NKX2-6
  Gene Name: NK2 homeobox 6
  Uniprot ID: A6NCS4
  ENSP ID: ENSP00000320089
MLLSPVTSTPFSVKDILRLERERSCPAASPHPRVRKSPENFQYLRMDAEPRGSEVHNAGGGGGDRKLDGSEPPGGPCEAVLEMDAERMGEPQPGLNAASPLGGGTRVPERGVGNSGDSVRGGRSEQPKARQRRKPRVLFSQAQVLALERRFKQQRYLSAPEREHLASALQLTSTQVKIWFQNRRYKCKRQRQDKSLELAGHPLTPRRVAVPVLVRDGKPCLGPGPGAPAFPSPYSAAVSPYSCYGGYSGAPYGAGYGTCYAGAPSGPAPHTPLASAGFGHGGQNATPQGHLAATLQGVRAW

SEQ ID NO: 57153 - protein, 239 aa, Homo sapiens
  Payload ID: 11238
  Gene Symbol: NKX2-8
  Gene Name: NK2 homeobox 8
  Uniprot ID: O15522
  ENSP ID: ENSP00000258829
MATSGRLSFTVRSLLDLPEQDAQHLPRREPEPRAPQPDPCAAWLDSERGHYPSSDESSLETSPPDSSQRPSARPASPGSDAEKRKKRRVLFSKAQTLELERRFRQQRYLSAPEREQLASLLRLTPTQVKIWFQNHRYKLKRARAPGAAESPDLAASAELHAAPGLLRRVVVPVLVRDGQPCGGGGGGEVGTAAAQEKCGAPPAAACPLPGYPAFGPGSALGLFPAYQHLASPALVSWNW

SEQ ID NO: 57154 - protein, 234 aa, Homo sapiens
  Payload ID: 11239
  Gene Symbol: NKX3-1
  Gene Name: NK3 homeobox 1
  Uniprot ID: Q99801
  ENSP ID: ENSP00000370253
MLRVPEPRPGEAKAEGAAPPTPSKPLTSFLIQDILRDGAQRQGGRTSSQRQRDPEPEPEPEPEGGRSRAGAQNDQLSTGPRAAPEEAETLAETEPERHLGSYLLDSENTSGALPRLPQTPKQPQKRSRAAFSHTQVIELERKFSHQKYLSAPERAHLAKNLKLTETQVKIWFQNRRYKTKRKQLSSELGDLEKHSSLPALKEEAFSRASLVSVYNSYPYYPYLYCVGSWSPAFW

SEQ ID NO: 57155 - protein, 159 aa, Homo sapiens
  Payload ID: 11239
  Gene Symbol: NKX3-1
  Gene Name: NK3 homeobox 1
  Uniprot ID: Q99801
  ENSP ID: ENSP00000429729
MLRVPEPRPGEAETLAETEPERHLGSYLLDSENTSGALPRLPQTPKQPQKRSRAAFSHTQVIELERKFSHQKYLSAPERAHLAKNLKLTETQVKIWFQNRRYKTKRKQLSSELGDLEKHSSLPALKEEAFSRASLVSVYNSYPYYPYLYCVGSWSPAFW

SEQ ID NO: 57156 - protein, 333 aa, Homo sapiens
  Payload ID: 11240
  Gene Symbol: NKX3-2
  Gene Name: NK3 homeobox 2
  Uniprot ID: P78367
  ENSP ID: ENSP00000371875
MAVRGANTLTSFSIQAILNKKEERGGLAAPEGRPAPGGTAASVAAAPAVCCWRLFGERDAGALGGAEDSLLASPAGTRTAAGRTAESPEGWDSDSALSEENESRRRCADARGASGAGLAGGSLSLGQPVCELAASKDLEEEAAGRSDSEMSASVSGDRSPRTEDDGVGPRGAHVSALCSGAGGGGGSGPAGVAEEEEEPAAPKPRKKRSRAAFSHAQVFELERRFNHQRYLSGPERADLAASLKLTETQVKIWFQNRRYKTKRRQMAADLLASAPAAKKVAVKVLVRDDQRQYLPGEVLRPPSLLPLQPSYYYPYYCLPGWALSTCAAAAGTQ

SEQ ID NO: 57157 - protein, 367 aa, Homo sapiens
  Payload ID: 11241
  Gene Symbol: NKX6-1
  Gene Name: NK6 homeobox 1
  Uniprot ID: P78426
  ENSP ID: ENSP00000295886
MLAVGAMEGTRQSAFLLSSPPLAALHSMAEMKTPLYPAAYPPLPAGPPSSSSSSSSSSSPSPPLGTHNPGGLKPPATGGLSSLGSPPQQLSAATPHGINDILSRPSMPVASGAALPSASPSGSSSSSSSSASASSASAAAAAAAAAAAAASSPAGLLAGLPRFSSLSPPPPPPGLYFSPSAAAVAAVGRYPKPLAELPGRTPIFWPGVMQSPPWRDARLACTPHQGSILLDKDGKRKHTRPTFSGQQIFALEKTFEQTKYLAGPERARLAYSLGMTESQVKVWFQNRRTKWRKKHAAEMATAKKKQDSETERLKGASENEEEDDDYNKPLDPNSDDEKITQLLKKHKSSSGGGGGLLLHASEPESSS

SEQ ID NO: 57158 - protein, 93 aa, Homo sapiens
  Payload ID: 11241
  Gene Symbol: NKX6-1
  Gene Name: NK6 homeobox 1
  ENSP ID: ENSP00000449761
MTESQVKVWFQNRRTKWRKKHAAEMATAKKKQDSETERLKGASENEEEDDDYNKPLDPNSDDEKITQLLKKHKSSSGGGGGLLLHASEPESSS

SEQ ID NO: 57159 - protein, 277 aa, Homo sapiens
  Payload ID: 11242
  Gene Symbol: NKX6-2
  Gene Name: NK6 homeobox 2
  Uniprot ID: Q9C056
  ENSP ID: ENSP00000357581
MDTNRPGAFVLSSAPLAALHNMAEMKTSLFPYALQGPAGFKAPALGGLGAQLPLGTPHGISDILGRPVGAAGGGLLGGLPRLNGLASSAGVYFGPAAAVARGYPKPLAELPGRPPIFWPGVVQGAPWRDPRLAGPAPAGGVLDKDGKKKHSRPTFSGQQIFALEKTFEQTKYLAGPERARLAYSLGMTESQVKVWFQNRRTKWRKRHAVEMASAKKKQDSDAEKLKVGGSDAEDDDEYNRPLDPNSDDEKITRLLKKHKPSNLALVSPCGGGAGDAL

SEQ ID NO: 57160 - protein, 265 aa, Homo sapiens
  Payload ID: 11243
  Gene Symbol: NKX6-3
  Gene Name: NK6 homeobox 3
  Uniprot ID: A6NJ46
  ENSP ID: ENSP00000428361
MESNLQGTFLLNNTPLAQFPEMKAPVCQYSVQNSFYKLSPPGLGPQLAAGTPHGITDILSRPVAAPNNSLLSGYPHVAGFGGLSSQGVYYSPQVGNFSKAGNEYPTRTRNCWADTGQDWRGGRQCSNTPDPLSDSIHKKKHTRPTFTGHQIFALEKTFEQTKYLAGPERARLAYSLGMTESQVKVWFQNRRTKWRKKSALEPSSSTPRAPGGAGAGAGGDRAPSENEDDEYNKPLDPDSDDEKIRLLLRKHRAAFSVLSLGAHSV

SEQ ID NO: 57161 - protein, 135 aa, Homo sapiens
  Payload ID: 11243
  Gene Symbol: NKX6-3
  Gene Name: NK6 homeobox 3
  Uniprot ID: A6NJ46
  ENSP ID: ENSP00000429553
MQQGQLAPGSRLCSGPWGLPELQPAAPSSSAAQLPWGESWGEEADTPACLSASGVWFQNRRTKWRKKSALEPSSSTPRAPGGAGAGAGGDRAPSENEDDEYNKPLDPDSDDEKIRLLLRKHRAAFSVLSLGAHSV

SEQ ID NO: 57162 - protein, 975 aa, Homo sapiens
  Payload ID: 11244
  Gene Symbol: NLRX1
  Gene Name: NLR family member X1
  Uniprot ID: Q86UT6
  ENSP ID: ENSP00000292199
MRWGHHLPRASWGSGFRRALQRPDDRIPFLIHWSWPLQGERPFGPPRAFIRHHGSSVDSAPPPGRHGRLFPSASATEAIQRHRRNLAEWFSRLPREERQFGPTFALDTVHVDPVIRESTPDELLRPPAELALEHQPPQAGLPPLALSQLFNPDACGRRVQTVVLYGTVGTGKSTLVRKMVLDWCYGRLPAFELLIPFSCEDLSSLGPAPASLCQLVAQRYTPLKEVLPLMAAAGSHLLFVLHGLEHLNLDFRLAGTGLCSDPEEPQEPAAIIVNLLRKYMLPQASILVTTRPSAIGRIPSKYVGRYGEICGFSDTNLQKLYFQLRLNQPYCGYAVGGSGVSATPAQRDHLVQMLSRNLEGHHQIAAACFLPSYCWLVCATLHFLHAPTPAGQTLTSIYTSFLRLNFSGETLDSTDPSNLSLMAYAARTMGKLAYEGVSSRKTYFSEEDVCGCLEAGIRTEEEFQLLHIFRRDALRFFLAPCVEPGRAGTFVFTVPAMQEYLAALYIVLGLRKTTLQKVGKEVAELVGRVGEDVSLVLGIMAKLLPLRALPLLFNLIKVVPRVFGRMVGKSREAVAQAMVLEMFREEDYYNDDVLDQMGASILGVEGPRRHPDEPPEDEVFELFPMFMGGLLSAHNRAVLAQLGCPIKNLDALENAQAIKKKLGKLGRQVLPPSELLDHLFFHYEFQNQRFSAEVLSSLRQLNLAGVRMTPVKCTVVAAVLGSGRHALDEVNLASCQLDPAGLRTLLPVFLRARKLGLQLNSLGPEACKDLRDLLLHDQCQITTLRLSNNPLTAAGVAVLMEGLAGNTSVTHLSLLHTGLGDEGLELLAAQLDRNRQLQELNVAYNGAGDTAALALARAAREHPSLELLHLYFNELSSEGRQVLRDLGGAAEGGARVVVSLTEGTAVSEYWSVILSEVQRNLNSWDRARVQRHLELLLRDLEDSRGATLNPWRKAQLLRVEGEVRALLEQLGSSGS

SEQ ID NO: 57163 - protein, 975 aa, Homo sapiens; identical to SEQ ID NO: 57162
  Payload ID: 11244
  Gene Symbol: NLRX1
  Gene Name: NLR family member X1
  Uniprot ID: Q86UT6
  ENSP ID: ENSP00000386851

SEQ ID NO: 57164 - protein, 975 aa, Homo sapiens; identical to SEQ ID NO: 57162
  Payload ID: 11244
  Gene Symbol: NLRX1
  Gene Name: NLR family member X1
  Uniprot ID: Q86UT6
  ENSP ID: ENSP00000386858

SEQ ID NO: 57165 - protein, 975 aa, Homo sapiens; identical to SEQ ID NO: 57162
  Payload ID: 11244
  Gene Symbol: NLRX1
  Gene Name: NLR family member X1
  Uniprot ID: Q86UT6
  ENSP ID: ENSP00000387334

SEQ ID NO: 57166 - protein, 151 aa, Homo sapiens
  Payload ID: 11244
  Gene Symbol: NLRX1
  Gene Name: NLR family member X1
  ENSP ID: ENSP00000400268
MRWGHHLPRASWGSGFRRALQRPDDRIPFLIHWSWPLQGERPFGPPRAFIRHHGSSVDSAPPPGRHGRLFPSASATEAIQRHRRNLAEWFSRLPREERQFGPTFALDTVHVDPVIRESTPDELLRPPAELALEHQPPQAGLPPLALSQLFN

SEQ ID NO: 57167 - protein, 127 aa, Homo sapiens
  Payload ID: 11244
  Gene Symbol: NLRX1
  Gene Name: NLR family member X1
  ENSP ID: ENSP00000402381
MRWGHHLPRASWGSGFRRALQRPDDRIPFLIHWSWPLQGERPFGPPRAFIRHHGSSVDSAPPPGRHGRLFPSASATEAIQRHRRNLAEWFSRLPREERQFGPTFALDTVHVDPVIRESTPDELLRPP

SEQ ID NO: 57168 - protein, 137 aa, Homo sapiens
  Payload ID: 11244
  Gene Symbol: NLRX1
  Gene Name: NLR family member X1
  ENSP ID: ENSP00000402801
MRWGHHLPRASWGSGFRRALQRPDDRIPFLIHWSWPLQGERPFGPPRAFIRHHGSSVDSAPPPGRHGRLFPSASATEAIQRHRRNLAEWFSRLPREERQFGPTFALDTVHVDPVIRESTPDELLRPPAELALEHQPP

SEQ ID NO: 57169 - protein, 921 aa, Homo sapiens
  Payload ID: 11244
  Gene Symbol: NLRX1
  Gene Name: NLR family member X1
  Uniprot ID: Q86UT6
  ENSP ID: ENSP00000433442
MRWGHHLPRASWGSGFRRALQRPDDRIPFLIHWSWPLQGERPFGPPRAFIRHHGSSVDSAPPPGRHGRLFPSASATEAIQRHRRNLAEWFSRLPREERQFGPTFALDTVHVDPVIRESTPDELLRPPAELALEHQPPQAGLPPLALSQLFNPDACGRRVQTVVLYGTVGTGKSTLVRKMVLDWCYGRLPAFELLIPFSCEDLSSLGPAPASLCQLVAQRYTPLKEVLPLMAAAGSHLLFVLHGLEHLNLDFRLAGTGLCSDPEEPQEPAAIIVNLLRKYMLPQASILVTTRPSAIGRIPSKYVGRYGEICGFSDTNLQKLYFQLRLNQPYCGYAVGGSGVSATPAQRDHLVQMLSRNLEGHHQIAAACFLPSYCWLVCATLHFLHAPTPAGQTLTSIYTSFLRLNFSGETLDSTDPSNLSLMAYAARTMGKLAYEGVSSRKTYFSEEDVCGCLEAGIRTEEEFQLLHIFRRDALRFFLAPCVEPGRAGTFVFTVPAMQEYLAALYIVLGLRKTTLQKVGKEVAELVGRVGEDVSLVLGIMAKLLPLRALPLLFNLIKVVPRVFGRMVGKSREAVAQAMVLEMFREEDYYNDDVLDQMGASILGVEGPRRHPDEPPEDEVFELFPMFMGGLLSAHNRAVLAQLGCPIKNLDALENAQAIKKKLGKLGRQVLPPSELLDHLFFHYEFQNQRFSAEVLSSLRQLNLAGVRMTPVKCTVVAAVLGSGRHALDEVNLASCQLDPAGLRTLLPVFLRARKLGLQLNSLGPEACKDLRDLLLHDQCQITTLRLSNNPLTAAGVAVLMEGLAGNTSVTHLSLLHTGLGDEGLELLAAQLDRNRQLQELNVAYNGAGDTAALALARAAREHPSLELLQGVAIQMCWKLPLLPYAHLWTPRMPSHWCFLLILMPPLPQWYDGLVAPRGRCT

SEQ ID NO: 57170 - protein, 1241 aa, Homo sapiens
  Payload ID: 11245
  Gene Symbol: NAIP
  Gene Name: NLR family, apoptosis inhibitory protein
  Uniprot ID: Q13075
  ENSP ID: ENSP00000424913
MPLHIGDFVWDSKVHSLQSSLNIFSLLPTKGRTEHLFFSHILSFHWPAFSSIRLELWINLRCEFLRSKKSSEEITQYIQSYKGFVDITGEHFVNSWVQRELPMASAYCNDSIFAYEELRLDSFKDWPRESAVGVAALAKAGLFYTGIKDIVQCFSCGGCLEKWQEGDDPLDDHTRCFPNCPFLQNMKSSAEVTPDLQSRGELCELLETTSESNLEDSIAVGPIVPEMAQGEAQWFQEAKNLNEQLRAAYTSASFRHMSLLDISSDLATDHLLGCDLSIASKHISKPVQEPLVLPEVFGNLNSVMCVEGEAGSGKTVLLKKIAFLWASGCCPLLNRFQLVFYLSLSSTRPDEGLASIICDQLLEKEGSVTEMCVRNIIQQLKNQVLFLLDDYKEICSIPQVIGKLIQKNHLSRTCLLIAVRTNRARDIRRYLETILEIKAFPFYNTVCILRKLFSHNMTRLRKFMVYFGKNQSLQKIQKTPLFVAAICAHWFQYPFDPSFDDVAVFKSYMERLSLRNKATAEILKATVSSCGELALKGFFSCCFEFNDDDLAEAGVDEDEDLTMCLMSKFTAQRLRPFYRFLSPAFQEFLAGMRLIELLDSDRQEHQDLGLYHLKQINSPMMTVSAYNNFLNYVSSLPSTKAGPKIVSHLLHLVDNKESLENISENDDYLKHQPEISLQMQLLRGLWQICPQAYFSMVSEHLLVLALKTAYQSNTVAACSPFVLQFLQGRTLTLGALNLQYFFDHPESLSLLRSIHFPIRGNKTSPRAHFSVLETCFDKSQVPTIDQDYASAFEPMNEWERNLAEKEDNVKSYMDMQRRASPDLSTGYWKLSPKQYKIPCLEVDVNDIDVVGQDMLEILMTVFSASQRIELHLNHSRGFIESIRPALELSKASVTKCSISKLELSAAEQELLLTLPSLESLEVSGTIQSQDQIFPNLDKFLCLKELSVDLEGNINVFSVIPEEFPNFHHMEKLLIQISAEYDPSKLVKLIQNSPNLHVFHLKCNFFSDFGSLMTMLVSCKKLTEIKFSDSFFQAVPFVASLPNFISLKILNLEGQQFPDEETSEKFAYILGSLSNLEELILPTGDGIYRVAKLIIQQCQQLHCLRVLSFFKTLNDDSVVEIAKVAISGGFQKLENLKLSINHKITEEGYRNFFQALDNMPNLQELDISRHFTECIKAQATTVKSLSQCVLRLPRLIRLNMLSWLLDADDIALLNVMKERHPQSKYLTILQKWILPFSPIIQK

SEQ ID NO: 57171 - protein, 193 aa, Homo sapiens
  Payload ID: 11245
  Gene Symbol: NAIP
  Gene Name: NLR family, apoptosis inhibitory protein
  ENSP ID: ENSP00000428226
  MOD_RES (1)..(1): Any amino acid
XISLKILNLEGQQFPDEETSEKFAYILGSLSNLEELILPTGDGIYRVAKLIIQQCQQLHCLRVLSFFKTLNDDSVVEIDGVLLCHPGWSAVVGFWLTATSTSQVQADSPASASRVAGITAKVAISGGFQKLENLKLSINHKITEEGYRNFFQALDNMPNLQELDISRHFTECIKAQATTVKSLSQCVLRLPRL

SEQ ID NO: 57172 - protein, 1241 aa, Homo sapiens; identical to SEQ ID NO: 57170
  Payload ID: 11245
  Gene Symbol: NAIP
  Gene Name: NLR family, apoptosis inhibitory protein
  Uniprot ID: Q13075
  ENSP ID: ENSP00000428363

SEQ ID NO: 57173 - protein, 1403 aa, Homo sapiens
  Payload ID: 11245
  Gene Symbol: NAIP
  Gene Name: NLR family, apoptosis inhibitory protein
  Uniprot ID: Q13075
  ENSP ID: ENSP00000428657
MATQQKASDERISQFDHNLLPELSALLGLDAVQLAKELEEEEQKERAKMQKGYNSQMRSEAKRLKTFVTYEPYSSWIPQEMAAAGFYFTGVKSGIQCFCCSLILFGAGLTRLPIEDHKRFHPDCGFLLNKDVGNIAKYDIRVKNLKSRLRGGKMRYQEEEARLASFRNWPFYVQGISPCVLSEAGFVFTGKQDTVQCFSCGGCLGNWEEGDDPWKEHAKWFPKCEFLRSKKSSEEITQYIQSYKGFVDITGEHFVNSWVQRELPMASAYCNDSIFAYEELRLDSFKDWPRESAVGVAALAKAGLFYTGIKDIVQCFSCGGCLEKWQEGDDPLDDHTRCFPNCPFLQNMKSSAEVTPDLQSRGELCELLETTSESNLEDSIAVGPIVPEMAQGEAQWFQEAKNLNEQLRAAYTSASFRHMSLLDISSDLATDHLLGCDLSIASKHISKPVQEPLVLPEVFGNLNSVMCVEGEAGSGKTVLLKKIAFLWASGCCPLLNRFQLVFYLSLSSTRPDEGLASIICDQLLEKEGSVTEMCVRNIIQQLKNQVLFLLDDYKEICSIPQVIGKLIQKNHLSRTCLLIAVRTNRARDIRRYLETILEIKAFPFYNTVCILRKLFSHNMTRLRKFMVYFGKNQSLQKIQKTPLFVAAICAHWFQYPFDPSFDDVAVFKSYMERLSLRNKATAEILKATVSSCGELALKGFFSCCFEFNDDDLAEAGVDEDEDLTMCLMSKFTAQRLRPFYRFLSPAFQEFLAGMRLIELLDSDRQEHQDLGLYHLKQINSPMMTVSAYNNFLNYVSSLPSTKAGPKIVSHLLHLVDNKESLENISENDDYLKHQPEISLQMQLLRGLWQICPQAYFSMVSEHLLVLALKTAYQSNTVAACSPFVLQFLQGRTLTLGALNLQYFFDHPESLSLLRSIHFPIRGNKTSPRAHFSVLETCFDKSQVPTIDQDYASAFEPMNEWERNLAEKEDNVKSYMDMQRRASPDLSTGYWKLSPKQYKIPCLEVDVNDIDVVGQDMLEILMTVFSASQRIELHLNHSRGFIESIRPALELSKASVTKCSISKLELSAAEQELLLTLPSLESLEVSGTIQSQDQIFPNLDKFLCLKELSVDLEGNINVFSVIPEEFPNFHHMEKLLIQISAEYDPSKLVKLIQNSPNLHVFHLKCNFFSDFGSLMTMLVSCKKLTEIKFSDSFFQAVPFVASLPNFISLKILNLEGQQFPDEETSEKFAYILGSLSNLEELILPTGDGIYRVAKLIIQQCQQLHCLRVLSFFKTLNDDSVVEIAKVAISGGFQKLENLKLSINHKITEEGYRNFFQALDNMPNLQELDISRHFTECIKAQATTVKSLSQCVLRLPRLIRLNMLSWLLDADDIALLNVMKERHPQSKYLTILQKWILPFSPIIQK

SEQ ID NO: 57174 - protein, 198 aa, Homo sapiens
  Payload ID: 11245
  Gene Symbol: NAIP
  Gene Name: NLR family, apoptosis inhibitory protein
  ENSP ID: ENSP00000429154
MATQQKASDERISQFDHNLLPELSALLGLDAVQLAKELEEEEQKERAKMQKGYNSQMRSEAKRLKTFVTYEPYSSWIPQEMAAAGFYFTGVKSGIQCFCCSLILFGAGLTRLPIEDHKRFHPDCGFLLNKDVGNIAKYDIRVKNLKSRLRGGKMRYQEEEARLASFRNWPFYVQGISPCVLSEAGFVFTAEFMEAQRL

SEQ ID NO: 57175 - protein, 1347 aa, Homo sapiens
  Payload ID: 11245
  Gene Symbol: NAIP
  Gene Name: NLR family, apoptosis inhibitory protein
  ENSP ID: ENSP00000429545
MATQQKASDERISQFDHNLLPELSALLGLDAVQLAKELEEEEQKERAKMQKGYNSQMRSEAKRLKTFVTYEPYSSWIPQEMAAAGFYFTGVKSGIQCFCCSLILFGAGLTRLPIEDHKRFHPDCGFLLNKDVGNIAKYDIRVKNLKSRLRGGKMRYQEEEARLASFRNWPFYVQGISPCVLSEAGFVFTGKQDTVQCFSCGGCLGNWEEGDDPWKEHAKWFPKCEFLRSKKSSEEITQYIQSYKGFVDITGEHFVNSWVQRELPMASAYCNDSIFAYEELRLDSFKDWPRESAVGVAALAKAGLFYTGIKDIVQCFSCGGCLEKWQEGDDPLDDHTRCFPNCPFLQNMKSSAEVTPDLQSRGELCELLETTSESNLEDSIAVGPIVPEMAQGEAQWFQEAKNLNEQLRAAYTSASFRHMSLLDISSDLATDHLLGCDLSIASKHISKPVQEPLVLPEVFGNLNSVMCVEGEAGSGKTVLLKKIAFLWASGCCPLLNRFQLVFYLSLSSTRPDEGLASIICDQLLEKEGSVTEMCVRNIIQQLKNQVLFLLDDYKEICSIPQVIGKLIQKNHLSRTCLLIAVRTNRARDIRRYLETILEIKAFPFYNTVCILRKLFSHNMTRLRKFMVYFGKNQSLQKIQKTPLFVAAICAHWFQYPFDPSFDDVAVFKSYMERLSLRNKATAEILKATVSSCGELALKGFFSCCFEFNDDDLAEAGVDEDEDLTMCLMSKFTAQRLRPFYRFLSPAFQEFLAGMRLIELLDSDRQEHQDLGLYHLKQINSPMMTVSAYNNFLNYVSSLPSTKAGPKIVSHLLHLVDNKESLENISENDDYLKHQPEISLQMQLLRGLWQICPQAYFSMVSEHLLVLALKTAYQSNTVAACSPFVLQFLQGRTLTLGALNLQYFFDHPESLSLLRSIHFPIRGNKTSPRAHFSVLETCFDKSQVPTIDQDYASAFEPMNEWERNLAEKEDNVKSYMDMQRRASPDLSTGYWKLSPKQYKIPCLEVDVNDIDVVGQDMLEILMTVFSASQRIELHLNHSRGFIESIRPALELSKASVTKCSISKLELSAAEQELLLTLPSLESLEVSGTIQSQVKLIQNSPNLHVFHLKCNFFSDFGSLMTMLVSCKKLTEIKFSDSFFQAVPFVASLPNFISLKILNLEGQQFPDEETSEKFAYILGSLSNLEELILPTGDGIYRVAKLIIQQCQQLHCLRVLSFFKTLNDDSVVEIAKVAISGGFQKLENLKLSINHKITEEGYRNFFQALDNMPNLQELDISRHFTECIKAQATTVKSLSQCVLRLPRLIRLNMLSWLLDADDIALLNVMKERHPQSKYLTILQKWILPFSPIIQK

SEQ ID NO: 57176 - protein, 4 aa, Homo sapiens
  Payload ID: 11245
  Gene Symbol: NAIP
  Gene Name: NLR family, apoptosis inhibitory protein
  ENSP ID: ENSP00000429591
AQRL

SEQ ID NO: 57177 - protein, 1403 aa, Homo sapiens; identical to SEQ ID NO: 57173
  Payload ID: 11245
  Gene Symbol: NAIP
  Gene Name: NLR family, apoptosis inhibitory protein
  Uniprot ID: Q13075
  ENSP ID: ENSP00000443944

SEQ ID NO: 57178 - protein, 1241 aa, Homo sapiens
  Payload ID: 11245
  Gene Symbol: NAIP
  Gene Name: NLR family, apoptosis inhibitory protein
  ENSP ID: ENSP00000477938
MPLHIGDFVWDSKVHSLQSSLNIFSLLPTKGRTEHLFFSHILSFHWPAFSSIRLELWINLRCEFLRSKKSSEEITQYIQSYKGFVDITGEHFVNSWVQRELPMASAYCNDSIFAYEELRLDSFKDWPRESAVGVAALAKAGLFYTGIKDIVQCFSCGGCLEKWQEGDDPLDDHTRCFPNCPFLQNMKSSAEVTPDLQSRGELCELLETTSESNLEDSIAVGPIVPEMAQGEAQWFQEAKNLNEQLRAAYTSASFRHMSLLDISSDLATDHLLGCDLSIASKHISKPVQEPLVLPEVFGNLNSVMCVEGEAGSGKTVLLKKIAFLWASGCCPLLNRFQLVFYLSLSSTRPDEGLASIICDQLLEKEGSVTEMCMRNIIQQLKNQVLFLLDDYKEICSIPQVIGKLIQKNHLSRTCLLIAVRTNRARDIRRYLETILEIKAFPFYNTVCILRKLFSHNMTRLRKFMVYFGKNQSLQKIQKTPLFVAAICAHWFQYPFDPSFDDVAVFKSYMERLSLRNKATAEILKATVSSCGELALKGFFSCCFEFNDDDLAEAGVDEDEDLTMCLMSKFTAQRLRPFYRFLSPAFQEFLAGMRLIELLDSDRQEHQDLGLYHLKQINSPMMTVSAYNNFLNYVSSLPSTKAGPKIVSHLLHLVDNKESLENISENDDYLKHQPEISLQMQLLRGLWQICPQAYFSMVSEHLLVLALKTAYQSNTVAACSPFVLQFLQGRTLTLGALNLQYFFDHPESLSLLRSIHFPIRGNKTSPRAHFSVLETCFDKSQVPTIDQDYASAFEPMNEWERNLAEKEDNVKSYMDMQRRASPDLSTGYWKLSPKQYKIPCLEVDVNDIDVVGQDMLEILMTVFSASQRIELHLNHSRGFIESIRPALELSKASVTKCSISKLELSAAEQELLLTLPSLESLEVSGTIQSQDQIFPNLDKFLCLKELSVDLEGNINVFSVIPEEFPNFHHMEKLLIQISAEYDPSKLVKLIQNSPNLHVFHLKCNFFSDFGSLMTMLVSCKKLTEIKFSDSFFQAVPFVASLPNFISLKILNLEGQQFPDEETSEKFAYILGSLSNLEELILPTGDGIYRVAKLIIQQCQQLHCLRVLSFFKTLNDDSVVEIAKVAISGGFQKLENLKLSINHKITEEGYRNFFQALDNMPNLQELDISRHFTECIKAQATTVKSLSQCVLRLPRLIRLNMLSWLLDADDIALLNVMKERHPQSKYLTILQKWILPFSPIIQK

SEQ ID NO: 57179 - protein, 1347 aa, Homo sapiens
  Payload ID: 11245
  Gene Symbol: NAIP
  Gene Name: NLR family, apoptosis inhibitory protein
  ENSP ID: ENSP00000479075
MATQQKASDERISQFDHNLLPELSALLGLDAVQLAKELEEEEQKERAKMQKGYNSQMRSEAKRLKTFVTYEPYSSWIPQEMAAAGFYFTGVKSGIQCFCCSLILFGAGLTRLPIEDHKRFHPDCGFLLNKDVGNIAKYDIRVKNLKSRLRGGKMRYQEEEARLASFRNWPFYVQGISPCVLSEAGFVFTGKQDTVQCFSCGGCLGNWEEGDDPWKEHAKWFPKCEFLRSKKSSEEITQYIQSYKGFVDITGEHFVNSWVQRELPMASAYCNDSIFAYEELRLDSFKDWPRESAVGVAALAKAGLFYTGIKDIVQCFSCGGCLEKWQEGDDPLDDHTRCFPNCPFLQNMKSSAEVTPDLQSRGELCELLETTSESNLEDSIAVGPIVPEMAQGEAQWFQEAKNLNEQLRAAYTSASFRHMSLLDISSDLATDHLLGCDLSIASKHISKPVQEPLVLPEVFGNLNSVMCVEGEAGSGKTVLLKKIAFLWASGCCPLLNRFQLVFYLSLSSTRPDEGLASIICDQLLEKEGSVTEMCMRNIIQQLKNQVLFLLDDYKEICSIPQVIGKLIQKNHLSRTCLLIAVRTNRARDIRRYLETILEIKAFPFYNTVCILRKLFSHNMTRLRKFMVYFGKNQSLQKIQKTPLFVAAICAHWFQYPFDPSFDDVAVFKSYMERLSLRNKATAEILKATVSSCGELALKGFFSCCFEFNDDDLAEAGVDEDEDLTMCLMSKFTAQRLRPFYRFLSPAFQEFLAGMRLIELLDSDRQEHQDLGLYHLKQINSPMMTVSAYNNFLNYVSSLPSTKAGPKIVSHLLHLVDNKESLENISENDDYLKHQPEISLQMQLLRGLWQICPQAYFSMVSEHLLVLALKTAYQSNTVAACSPFVLQFLQGRTLTLGALNLQYFFDHPESLSLLRSIHFPIRGNKTSPRAHFSVLETCFDKSQVPTIDQDYASAFEPMNEWERNLAEKEDNVKSYMDMQRRASPDLSTGYWKLSPKQYKIPCLEVDVNDIDVVGQDMLEILMTVFSASQRIELHLNHSRGFIESIRPALELSKASVTKCSISKLELSAAEQELLLTLPSLESLEVSGTIQSQVKLIQNSPNLHVFHLKCNFFSDFGSLMTMLVSCKKLTEIKFSDSFFQAVPFVASLPNFISLKILNLEGQQFPDEETSEKFAYILGSLSNLEELILPTGDGIYRVAKLIIQQCQQLHCLRVLSFFKTLNDDSVVEIAKVAISGGFQKLENLKLSINHKITEEGYRNFFQALDNMPNLQELDISRHFTECIKAQATTVKSLSQCVLRLPRLIRLNMLSWLLDADDIALLNVMKERHPQSKYLTILQKWILPFSPIIQK

SEQ ID NO: 57180 - protein, 193 aa, Homo sapiens; identical to SEQ ID NO: 57171
  Payload ID: 11245
  Gene Symbol: NAIP
  Gene Name: NLR family, apoptosis inhibitory protein
  ENSP ID: ENSP00000479321
  MOD_RES (1)..(1): Any amino acid

SEQ ID NO: 57181 - protein, 1241 aa, Homo sapiens; identical to SEQ ID NO: 57178
  Payload ID: 11245
  Gene Symbol: NAIP
  Gene Name: NLR family, apoptosis inhibitory protein
  ENSP ID: ENSP00000481094

SEQ ID NO: 57182 - protein, 1347 aa, Homo sapiens; identical to SEQ ID NO: 57179
  Payload ID: 11245
  Gene Symbol: NAIP
  Gene Name: NLR family, apoptosis inhibitory protein
  ENSP ID: ENSP00000483012

SEQ ID NO: 57183 - protein, 1160 aa, Homo sapiens
  Payload ID: 11245
  Gene Symbol: NAIP
  Gene Name: NLR family, apoptosis inhibitory protein
  Uniprot ID: Q13075
  ENSP ID: ENSP00000484107
MPLHIGDFVWDSKVHSLQSSLNIFSLLPTKGRTEHLFFSHILSFHWPAFSSIRLELWINLRCEFLRSKKSSEEITQYIQSYKGFVDITGEHFVNSWVQRELPMASAYCNDSIFAYEELRLDSFKDWPRESAVGVAALAKAGLFYTGIKDIVQCFSCGGCLEKWQEGDDPLDDHTRCFPNCPFLQNMKSSAEVTPDLQSRGELCELLETTSESNLEDSIAVGPIVPEMAQGEAQWFQEAKNLNEQLRAAYTSASFRHMSLLDISSDLATDHLLGCDLSIASKHISKPVQEPLVLPEVFGNLNSVMCVEGEAGSGKTVLLKKIAFLWASGCCPLLNRFQLVFYLSLSSTRPDEGLASIICDQLLEKEGSVTEMCMRNIIQQLKNQVLFLLDDYKEICSIPQVIGKLIQKNHLSRTCLLIAVRTNRARDIRRYLETILEIKAFPFYNTVCILRKLFSHNMTRLRKFMVYFGKNQSLQKIQKTPLFVAAICAHWFQYPFDPSFDDVAVFKSYMERLSLRNKATAEILKATVSSCGELALKGFFSCCFEFNDDDLAEAGVDEDEDLTMCLMSKFTAQRLRPFYRFLSPAFQEFLAGMRLIELLDSDRQEHQDLGLYHLKQINSPMMTVSAYNNFLNYVSSLPSTKAGPKIVSHLLHLVDNKESLENISENDDYLKHQPEISLQMQLLRGLWQICPQAYFSMVSEHLLVLALKTAYQSNTVAACSPFVLQFLQGRTLTLGALNLQYFFDHPESLSLLRSIHFPIRGNKTSPRAHFSVLETCFDKSQVPTIDQDYASAFEPMNEWERNLAEKEDNVKSYMDMQRRASPDLSTGYWKLSPKQYKIPCLEVDVNDIDVVGQDMLEILMTVFSASQRIELHLNHSRGFIESIRPALELSKASVTKCSISKLELSAAEQELLLTLPSLESLEVSGTIQSQDQIFPNLDKFLCLKELSVDLEGNINVFSVIPEEFPNFHHMEKLLIQISAEYDPSKLVKLIQNSPNLHVFHLKCNFFSDFGSLMTMLVSCKKLTEIKFSDSFFQAVPFVASLPNFISLKILNLEGQQFPDEETSEKFAYILGSLSNLEELILPTGDGIYRVAKLIIQQCQQLHCLRVLSFFKTLNDDSVVEIAKVAISGGFQKLENLKLSINHKITEEGYRNFFQALDNMPN

SEQ ID NO: 57184 - protein, 1403 aa, Homo sapiens
  Payload ID: 11245
  Gene Symbol: NAIP
  Gene Name: NLR family, apoptosis inhibitory protein
  Uniprot ID: Q13075
  ENSP ID: ENSP00000484731
MATQQKASDERISQFDHNLLPELSALLGLDAVQLAKELEEEEQKERAKMQKGYNSQMRSEAKRLKTFVTYEPYSSWIPQEMAAAGFYFTGVKSGIQCFCCSLILFGAGLTRLPIEDHKRFHPDCGFLLNKDVGNIAKYDIRVKNLKSRLRGGKMRYQEEEARLASFRNWPFYVQGISPCVLSEAGFVFTGKQDTVQCFSCGGCLGNWEEGDDPWKEHAKWFPKCEFLRSKKSSEEITQYIQSYKGFVDITGEHFVNSWVQRELPMASAYCNDSIFAYEELRLDSFKDWPRESAVGVAALAKAGLFYTGIKDIVQCFSCGGCLEKWQEGDDPLDDHTRCFPNCPFLQNMKSSAEVTPDLQSRGELCELLETTSESNLEDSIAVGPIVPEMAQGEAQWFQEAKNLNEQLRAAYTSASFRHMSLLDISSDLATDHLLGCDLSIASKHISKPVQEPLVLPEVFGNLNSVMCVEGEAGSGKTVLLKKIAFLWASGCCPLLNRFQLVFYLSLSSTRPDEGLASIICDQLLEKEGSVTEMCMRNIIQQLKNQVLFLLDDYKEICSIPQVIGKLIQKNHLSRTCLLIAVRTNRARDIRRYLETILEIKAFPFYNTVCILRKLFSHNMTRLRKFMVYFGKNQSLQKIQKTPLFVAAICAHWFQYPFDPSFDDVAVFKSYMERLSLRNKATAEILKATVSSCGELALKGFFSCCFEFNDDDLAEAGVDEDEDLTMCLMSKFTAQRLRPFYRFLSPAFQEFLAGMRLIELLDSDRQEHQDLGLYHLKQINSPMMTVSAYNNFLNYVSSLPSTKAGPKIVSHLLHLVDNKESLENISENDDYLKHQPEISLQMQLLRGLWQICPQAYFSMVSEHLLVLALKTAYQSNTVAACSPFVLQFLQGRTLTLGALNLQYFFDHPESLSLLRSIHFPIRGNKTSPRAHFSVLETCFDKSQVPTIDQDYASAFEPMNEWERNLAEKEDNVKSYMDMQRRASPDLSTGYWKLSPKQYKIPCLEVDVNDIDVVGQDMLEILMTVFSASQRIELHLNHSRGFIESIRPALELSKASVTKCSISKLELSAAEQELLLTLPSLESLEVSGTIQSQDQIFPNLDKFLCLKELSVDLEGNINVFSVIPEEFPNFHHMEKLLIQISAEYDPSKLVKLIQNSPNLHVFHLKCNFFSDFGSLMTMLVSCKKLTEIKFSDSFFQAVPFVASLPNFISLKILNLEGQQFPDEETSEKFAYILGSLSNLEELILPTGDGIYRVAKLIIQQCQQLHCLRVLSFFKTLNDDSVVEIAKVAISGGFQKLENLKLSINHKITEEGYRNFFQALDNMPNLQELDISRHFTECIKAQATTVKSLSQCVLRLPRLIRLNMLSWLLDADDIALLNVMKERHPQSKYLTILQKWILPFSPIIQK

SEQ ID NO: 57185 - protein, 1403 aa, Homo sapiens; identical to SEQ ID NO: 57184
  Payload ID: 11245
  Gene Symbol: NAIP
  Gene Name: NLR family, apoptosis inhibitory protein
  ENSP ID: ENSP00000484845

SEQ ID NO: 57186 - protein, 4 aa, Homo sapiens
  Payload ID: 11245
  Gene Symbol: NAIP
  Gene Name: NLR family, apoptosis inhibitory protein
  ENSP ID: ENSP00000485362
AQRL

SEQ ID NO: 57187 - protein, 198 aa, Homo sapiens; identical to SEQ ID NO: 57174
  Payload ID: 11245
  Gene Symbol: NAIP
  Gene Name: NLR family, apoptosis inhibitory protein
  ENSP ID: ENSP00000485660

SEQ ID NO: 57188 - protein, 1160 aa, Homo sapiens; identical to SEQ ID NO: 57183
  Payload ID: 11245
  Gene Symbol: NAIP
  Gene Name: NLR family, apoptosis inhibitory protein
  ENSP ID: ENSP00000485780

SEQ ID NO: 57189 - protein, 1403 aa, Homo sapiens; identical to SEQ ID NO: 57184
  Payload ID: 11245
  Gene Symbol: NAIP
  Gene Name: NLR family, apoptosis inhibitory protein
  ENSP ID: ENSP00000487347

SEQ ID NO: 57190 - protein, 198 aa, Homo sapiens; identical to SEQ ID NO: 57174
  Payload ID: 11245
  Gene Symbol: NAIP
  Gene Name: NLR family, apoptosis inhibitory protein
  ENSP ID: ENSP00000487396

SEQ ID NO: 57191 - protein, 1112 aa, Homo sapiens
  Payload ID: 11246
  Gene Symbol: NLRC3
  Gene Name: NLR family, CARD domain containing 3
  ENSP ID: ENSP00000323897
MEMDAPRPPSLAVPGAASRPGRLLDGGHGRQQVQALSSQLLEVIPDSMRKQEVRTGREAGQGHGTGSPAEQVKALMDLLAGKGSQGSQAPQALDRTPDAPLGPCSNDSRIQRHRKALLSKVGGGPELGGPWHRLASLLLVEGLTDLQLREHDFTQVEATRGGGHPARTVALDRLFLPLSRVSVPPRVSITIGVAGMGKTTLVRHFVRLWAHGQVGKDFSLVLPLTFRDLNTHEKLCADRLICSVFPHVGEPSLAVAVPARALLILDGLDECRTPLDFSNTVACTDPKKEIPVDHLITNIIRGNLFPEVSIWITSRPSASGQIPGGLVDRMTEIRGFNEEEIKVCLEQMFPEDQALLGWMLSQVQADRALYLMCTVPAFCRLTGMALGHLWRSRTGPQDAELWPPRTLCELYSWYFRMALSGEGQEKGKASPRIEQVAHGGRKMVGTLGRLAFHGLLKKKYVFYEQDMKAFGVDLALLQGAPCSCFLQREETLASSVAYCFTHLSLQEFVAAAYYYGASRRAIFDLFTESGVSWPRLGFLTHFRSAAQRAMQAEDGRLDVFLRFLSGLLSPRVNALLAGSLLAQGEHQAYRTQVAELLQGCLRPDAAVCARAINVLHCLHELQHTELARSVEEAMESGALARLTGPAHRAALAYLLQVSDACAQEANLSLSLSQGVLQSLLPQLLYCRKLRLDTNQFQDPVMELLGSVLSGKDCRIQKISLAENQISNKGAKALARSLLVNRSLTSLDLRGNSIGPQGAKALADALKINRTLTSLSLQGNTVRDDGARSMAEALASNRTLSMLHLQKNSIGPMGAQRMADALKQNRSLKELMFSSNSIGDGGAKALAEALKVNQGLESLDLQSNSISDAGVAALMGALCTNQTLLSLSLRENSISPEGAQAIAHALCANSTLKNLDLTANLLHDQGARAIAVAVRENRTLTSLHLQWNFIQAGAAQALGQALQLNRSLTSLDLQENAIGDDGACAVARALKVNTALTALYLQVASIGASGAQVLGEALAVNRTLEILDLRGNAIGVAGAKALANALKVNSSLRRLNLQENSLGMDGAICIATALSGNHRLQHINLQGNHIGDSGARMISEAIKTNAPTCTVEM

SEQ ID NO: 57192 - protein, 1065 aa, Homo sapiens
  Payload ID: 11246
  Gene Symbol: NLRC3
  Gene Name: NLR family, CARD domain containing 3
  Uniprot ID: Q7RTR2
  ENSP ID: ENSP00000352039
MRKQEVRTGREAGQGHGTGSPAEQVKALMDLLAGKGSQGSQAPQALDRTPDAPLGPCSNDSRIQRHRKALLSKVGGGPELGGPWHRLASLLLVEGLTDLQLREHDFTQVEATRGGGHPARTVALDRLFLPLSRVSVPPRVSITIGVAGMGKTTLVRHFVRLWAHGQVGKDFSLVLPLTFRDLNTHEKLCADRLICSVFPHVGEPSLAVAVPARALLILDGLDECRTPLDFSNTVACTDPKKEIPVDHLITNIIRGNLFPEVSIWITSRPSASGQIPGGLVDRMTEIRGFNEEEIKVCLEQMFPEDQALLGWMLSQVQADRALYLMCTVPAFCRLTGMALGHLWRSRTGPQDAELWPPRTLCELYSWYFRMALSGEGQEKGKASPRIEQVAHGGRKMVGTLGRLAFHGLLKKKYVFYEQDMKAFGVDLALLQGAPCSCFLQREETLASSVAYCFTHLSLQEFVAAAYYYGASRRAIFDLFTESGVSWPRLGFLTHFRSAAQRAMQAEDGRLDVFLRFLSGLLSPRVNALLAGSLLAQGEHQAYRTQVAELLQGCLRPDAAVCARAINVLHCLHELQHTELARSVEEAMESGALARLTGPAHRAALAYLLQVSDACAQEANLSLSLSQGVLQSLLPQLLYCRKLRLDTNQFQDPVMELLGSVLSGKDCRIQKISLAENQISNKGAKALARSLLVNRSLTSLDLRGNSIGPQGAKALADALKINRTLTSLSLQGNTVRDDGARSMAEALASNRTLSMLHLQKNSIGPMGAQRMADALKQNRSLKELMFSSNSIGDGGAKALAEALKVNQGLESLDLQSNSISDAGVAALMGALCTNQTLLSLSLRENSISPEGAQAIAHALCANSTLKNLDLTANLLHDQGARAIAVAVRENRTLTSLHLQWNFIQAGAAQALGQALQLNRSLTSLDLQENAIGDDGACAVARALKVNTALTALYLQVASIGASGAQVLGEALAVNRTLEILDLRGNAIGVAGAKALANALKVNSSLRRLNLQENSLGMDGAICIATALSGNHRLQHINLQGNHIGDSGARMISEAIKTNAPTCTVEM

SEQ ID NO: 57193 - protein, 1065 aa, Homo sapiens; identical to SEQ ID NO: 57192
  Payload ID: 11246
  Gene Symbol: NLRC3
  Gene Name: NLR family, CARD domain containing 3
  Uniprot ID: Q7RTR2
  ENSP ID: ENSP00000414415

SEQ ID NO: 57194 - protein, 196 aa, Homo sapiens
  Payload ID: 11246
  Gene Symbol: NLRC3
  Gene Name: NLR family, CARD domain containing 3
  ENSP ID: ENSP00000482302
  MOD_RES (1)..(1): Any amino acid
XLRGNSIGPQGAKALADALKINRTLTSLSLQGNTVRDDGARSMAEALASNRTLSMLHLQKNSIGPMGAQRMADALKQNRSLKELMFSSNSIGDGGAKALAEALKVNQGLESLDLQSNSISDAGVAALMGALCTNQTLLSLSLRENSISPEGAQAIAHALCANSTLKNLDLQWNFIQAGAAQALGQALQLNRSLTSL

SEQ ID NO: 57195 - protein, 761 aa, Homo sapiens
  Payload ID: 11246
  Gene Symbol: NLRC3
  Gene Name: NLR family, CARD domain containing 3
  Uniprot ID: Q7RTR2
  ENSP ID: ENSP00000482989
MRKQEVRTGREAGQGHGTGSPAEQVKALMDLLAGKGSQGSQAPQALDRTPDAPLGPCSNDSRIQRHRKALLSKVGGGPELGGPWHRLASLLLVEGLTDLQLREHDFTQVEATRGGGHPARTVALDRLFLPLSRVSVPPRVSITIGVAGMGKTTLVRHFVRLWAHGQVGKDFSLVLPLTFRDLNTHEKLCADRLICSVFPHVGEPSLAVAVPARALLILDGLDECRTPLDFSNTVACTDPKKEIPVDHLITNIIRGNLFPEVSIWITSRPSASGQIPGGLVDRMTEIRGFNEEEIKVCLEQMFPEDQALLGWMLSQVQADRALYLMCTVPAFCRLTGMALGHLWRSRTGPQDAELWPPRTLCELYSWYFRMALSGEGQEKGKASPRIEQVAHGGRKMVGTLGRLAFHGLLKKKYVFYEQDMKAFGVDLALLQGAPCSCFLQREETLASSVAYCFTHLSLQEFVAAAYYYGASRRAIFDLFTESGVSWPRLGFLTHFRSAAQRAMQAEDGRLDVFLRFLSGLLSPRVNALLAGSLLAQGEHQAYRTQVAELLQGCLRPDAAVCARAINVLHCLHELQHTELARSVEEAMESGALARLTGPAHRAALAYLLQVSDACAQEANLSLSLSQGVLQSLLPQLLYCRKLRLDTNQFQDPVMELLGSVLSGKDCRIQKISLAENQISNKGAKALARSLLVNRSLTSLDLRGNSIGPQGAKALADALKINRTLTSLRVKFMYHKIDCFRRVPEADACNPSTLGGQGRWIT

SEQ ID NO: 57196 - protein, 359 aa, Homo sapiens
  Payload ID: 11247
  Gene Symbol: NLRC4
  Gene Name: NLR family, CARD domain containing 4
  Uniprot ID: Q9NPP4
  ENSP ID: ENSP00000339666
MNFIKDNSRALIQRMGMTVIKQITDDLFVWNVLNREEVNIICCEKVEQDAARGIIHMILKKGSESCNLFLKSLKEWNYPLFQDLNGQSGLTDSLGNLKNLTKLIMDNIKMNEEDAIKLAEGLKNLKKMCLFHLTHLSDIGEGMDYIVKSLSSEPCDLEEIQLVSCCLSANAVKILAQNLHNLVKLSILDLSENYLEKDGNEALHELIDRMNVLEQLTALMLPWGCDVQGSLSSLLKHLEEVPQLVKLGLKNWRLTDTEIRILGAFFGKNPLKNFQQLNLAGNRVSSDGWLAFMGVFENLKQLVFFDFSTKEFLPDPALVRKLSQVLSKLTFLQEARLVGWQFDDDDLSVITGAFKLVTA

SEQ ID NO: 57197 - protein, 1024 aa, Homo sapiens
  Payload ID: 11247
  Gene Symbol: NLRC4
  Gene Name: NLR family, CARD domain containing 4
  Uniprot ID: Q9NPP4
  ENSP ID: ENSP00000354159
MNFIKDNSRALIQRMGMTVIKQITDDLFVWNVLNREEVNIICCEKVEQDAARGIIHMILKKGSESCNLFLKSLKEWNYPLFQDLNGQSLFHQTSEGDLDDLAQDLKDLYHTPSFLNFYPLGEDIDIIFNLKSTFTEPVLWRKDQHHHRVEQLTLNGLLQALQSPCIIEGESGKGKSTLLQRIAMLWGSGKCKALTKFKFVFFLRLSRAQGGLFETLCDQLLDIPGTIRKQTFMAMLLKLRQRVLFLLDGYNEFKPQNCPEIEALIKENHRFKNMVIVTTTTECLRHIRQFGALTAEVGDMTEDSAQALIREVLIKELAEGLLLQIQKSRCLRNLMKTPLFVVITCAIQMGESEFHSHTQTTLFHTFYDLLIQKNKHKHKGVAASDFIRSLDHCGDLALEGVFSHKFDFELQDVSSVNEDVLLTTGLLCKYTAQRFKPKYKFFHKSFQEYTAGRRLSSLLTSHEPEEVTKGNGYLQKMVSISDITSTYSSLLRYTCGSSVEATRAVMKHLAAVYQHGCLLGLSIAKRPLWRQESLQSVKNTTEQEILKAININSFVECGIHLYQESTSKSALSQEFEAFFQGKSLYINSGNIPDYLFDFFEHLPNCASALDFIKLDFYGGAMASWEKAAEDTGGIHMEEAPETYIPSRAVSLFFNWKQEFRTLEVTLRDFSKLNKQDIRYLGKIFSSATSLRLQIKRCAGVAGSLSLVLSTCKNIYSLMVEASPLTIEDERHITSVTNLKTLSIHDLQNQRLPGGLTDSLGNLKNLTKLIMDNIKMNEEDAIKLAEGLKNLKKMCLFHLTHLSDIGEGMDYIVKSLSSEPCDLEEIQLVSCCLSANAVKILAQNLHNLVKLSILDLSENYLEKDGNEALHELIDRMNVLEQLTALMLPWGCDVQGSLSSLLKHLEEVPQLVKLGLKNWRLTDTEIRILGAFFGKNPLKNFQQLNLAGNRVSSDGWLAFMGVFENLKQLVFFDFSTKEFLPDPALVRKLSQVLSKLTFLQEARLVGWQFDDDDLSVITGAFKLVTA

SEQ ID NO: 57198 - protein, 1024 aa, Homo sapiens; identical to SEQ ID NO: 57197
  Payload ID: 11247
  Gene Symbol: NLRC4
  Gene Name: NLR family, CARD domain containing 4
  Uniprot ID: Q9NPP4
  ENSP ID: ENSP00000385090

SEQ ID NO: 57199 - protein, 1024 aa, Homo sapiens; identical to SEQ ID NO: 57197
  Payload ID: 11247
  Gene Symbol: NLRC4
  Gene Name: NLR family, CARD domain containing 4
  Uniprot ID: Q9NPP4
  ENSP ID: ENSP00000385428

SEQ ID NO: 57200 - protein, 1866 aa, Homo sapiens
  Payload ID: 11248
  Gene Symbol: NLRC5
  Gene Name: NLR family, CARD domain containing 5
  Uniprot ID: Q86WI3
  ENSP ID: ENSP00000262510
MDPVGLQLGNKNLWSCLVRLLTKDPEWLNAKMKFFLPNTDLDSRNETLDPEQRVILQLNKLHVQGSDTWQSFIHCVCMQLEVPLDLEVLLLSTFGYDDGFTSQLGAEGKSQPESQLHHGLKRPHQSCGSSPRRKQCKKQQLELAKKYLQLLRTSAQQRYRSQIPGSGQPHAFHQVYVPPILRRATASLDTPEGAIMGDVKVEDGADVSISDLFNTRVNKGPRVTVLLGKAGMGKTTLAHRLCQKWAEGHLNCFQALFLFEFRQLNLITRFLTPSELLFDLYLSPESDHDTVFQYLEKNADQVLLIFDGLDEALQPMGPDGPGPVLTLFSHLCNGTLLPGCRVMATSRPGKLPACLPAEAAMVHMLGFDGPRVEEYVNHFFSAQPSREGALVELQTNGRLRSLCAVPALCQVACLCLHHLLPDHAPGQSVALLPNMTQLYMQMVLALSPPGHLPTSSLLDLGEVALRGLETGKVIFYAKDIAPPLIAFGATHSLLTSFCVCTGPGHQQTGYAFTHLSLQEFLAALHLMASPKVNKDTLTQYVTLHSRWVQRTKARLGLSDHLPTFLAGLASCTCRPFLSHLAQGNEDCVGAKQAAVVQVLKKLATRKLTGPKVVELCHCVDETQEPELASLTAQSLPYQLPFHNFPLTCTDLATLTNILEHREAPIHLDFDGCPLEPHCPEALVGCGQIENLSFKSRKCGDAFAEALSRSLPTMGRLQMLGLAGSKITARGISHLVKALPLCPQLKEVSFRDNQLSDQVVLNIVEVLPHLPRLRKLDLSSNSICVSTLLCLARVAVTCPTVRMLQAREADLIFLLSPPTETTAELQRAPDLQESDGQRKGAQSRSLTLRLQKCQLQVHDAEALIALLQEGPHLEEVDLSGNQLEDEGCRLMAEAASQLHIARKLDLSNNGLSVAGVHCVLRAVSACWTLAELHISLQHKTVIFMFAQEPEEQKGPQERAAFLDSLMLQMPSELPLSSRRMRLTHCGLQEKHLEQLCKALGGSCHLGHLHLDFSGNALGDEGAARLAQLLPGLGALQSLNLSENGLSLDAVLGLVRCFSTLQWLFRLDISFESQHILLRGDKTSRDMWATGSLPDFPAAAKFLGFRQRCIPRSLCLSECPLEPPSLTRLCATLKDCPGPLELQLSCEFLSDQSLETLLDCLPQLPQLSLLQLSQTGLSPKSPFLLANTLSLCPRVKKVDLRSLHHATLHFRSNEEEEGVCCGRFTGCSLSQEHVESLCWLLSKCKDLSQVDLSANLLGDSGLRCLLECLPQVPISGLLDLSHNSISQESALYLLETLPSCPRVREASVNLGSEQSFRIHFSREDQAGKTLRLSECSFRPEHVSRLATGLSKSLQLTELTLTQCCLGQKQLAILLSLVGRPAGLFSLRVQEPWADRARVLSLLEVCAQASGSVTEISISETQQQLCVQLEFPRQEENPEAVALRLAHCDLGAHHSLLVGQLMETCARLQQLSLSQVNLCEDDDASSLLLQSLLLSLSELKTFRLTSSCVSTEGLAHLASGLGHCHHLEELDLSNNQFDEEGTKALMRALEGKWMLKRLDLSHLLLNSSTLALLTHRLSQMTCLQSLRLNRNSIGDVGCCHLSEALRAATSLEELDLSHNQIGDAGVQHLATILPGLPELRKIDLSGNSISSAGGVQLAESLVLCRRLEELMLGCNALGDPTALGLAQELPQHLRVLHLPFSHLGPGGALSLAQALDGSPHLEEISLAENNLAGGVLRFCMELPLLRQIDLVSCKIDNQTAKLLTSSFTSCPALEVILLSWNLLGDEAAAELAQVLPQMGRLKRVDLEKNQITALGAWLLAEGLAQGSSIQVIRLWNNPIPCDMAQHLKSQEPRLDFAFFDNQPQAPWGT

SEQ ID NO: 57201 - protein, 1866 aa, Homo sapiens; identical to SEQ ID NO: 57200
  Payload ID: 11248
  Gene Symbol: NLRC5
  Gene Name: NLR family, CARD domain containing 5
  Uniprot ID: Q86WI3
  ENSP ID: ENSP00000389739

SEQ ID NO: 57202 - protein, 325 aa, Homo sapiens
  Payload ID: 11248
  Gene Symbol: NLRC5
  Gene Name: NLR family, CARD domain containing 5
  ENSP ID: ENSP00000437583
  MOD_RES (1)..(1): Any amino acid
XWLFRLDISFESQHILLRGDKTSRDMWATGSLPDFPAAAKFLGFRQRCIPRSLCLSECPLEPPSLTRLCATLKDCPGPLELQLSCEFLSDQSLETLLDCLPQLPQLSLLQLSQTGLSPKSPFLLANTLSLCPRVKKVDLRSLHHATLHFRSNEEEEGVCCGFTGCSLSQEHVESLCWLLSKCKDLSQVDLSANLLGDSGLRCLLECLPQVPISGLLDLSHNSISQESALYLLETLPSCPRVREASVNLGSEQSFRIHFSREDQAGKTLRLSECSFRPEHVSRLATGLSKSLQLTELTLTQCCLGQKQLAILLSLVGRPAGLFSLS

SEQ ID NO: 57203 - protein, 387 aa, Homo sapiens
  Payload ID: 11248
  Gene Symbol: NLRC5
  Gene Name: NLR family, CARD domain containing 5
  ENSP ID: ENSP00000438548
  MOD_RES (1)..(1): Any amino acid
XELPLSSRRMRLTHCGLQEKHLEQLCKALGGSCHLGHLHLDFSGNALGDEGAARLAQLLPGLGALQSLNLSENGLSLDAVLGLVRCFSTLQWLFRLDISFESQHILLRGDKTSRDMWATGSLPDFPAAAKFLGFRQRCIPRSLCLSECPLEPPSLTRLCATLKDCPGPLELQLSCEFLSDQSLETLLDCLPQLPQLSLLQLSQTGLSPKSPFLLANTLSLCPRVKKVDLRSLHHATLHFRSNEEEEGVCCGLSANLLGDSGLRCLLECLPQVPISGLLDLSHNSISQESALYLLETLPSCPRVREASVNLGSEQSFRIHFSREDQAGKTLRLSECSFRPEHVSRLATGLSKSLQLTELTLTQCCLGQKQLAILLSLVGRPAGLFSLS

SEQ ID NO: 57204 - protein, 74 aa, Homo sapiens
  Payload ID: 11248
  Gene Symbol: NLRC5
  Gene Name: NLR family, CARD domain containing 5
  ENSP ID: ENSP00000439464
MDPVGLQLGNKNLWSCLVRLLTKDPEWLNAKMKFFLPNTDLDSRNETLDPEQRVILQLNKLHVQGSDTWQSFIH

SEQ ID NO: 57205 - protein, 631 aa, Homo sapiens
  Payload ID: 11248
  Gene Symbol: NLRC5
  Gene Name: NLR family, CARD domain containing 5
  ENSP ID: ENSP00000440153
LTCTDLATLTNILEHREAPIHLDFDGCPLEPHCPEALVGCGQIENLSFKSRKCGDAFAEALSRSLPTMGRLQMLGLSSNSICVSTLLCLARVAVTCPTVRMLQAREADLIFLLSPPTETTAELQRAPDLQESDGQRKGAQSRSLTLRLQKCQLQVHDAEALIALLQEGPHLEEVDLSGNQLEDEGCRLMAEAASQLHIARKLDLSNNGLSVAGVHCVLRAVSACWTLAELHISLQHKTVIFMFAQEPEEQKGPQERAAFLDSLMLQMPSELPLSSRRMRLTHCGLQEKHLEQLCKALGGSCHLGHLHLDFSGNALGDEGAARLAQLLPGLGALQSLNLSENGLSLDAVLGLVRCFSTLQWLFRLDISFESQHILLRGDKTSSLSECPLEPPSLTRLCATLKDCPGPLELQLSCEFLSDQSLETLLDCLPQLPQLSLLQLSQTGLSPKSPFLLANTLSLCPRVKKVDLRSLHHATLHFRSNEEEEGVCCGRFTGCSLSQEHVESLCWLLSKCKDLSQVDLGSEQSFRIHFSREDQAGKTLRLSECSFRPEHVSRLATGLSKSLQLTELTLTQCCLGQKQLAILLSLVGRPAGLFSLRDSTRHTEKLSFPTLEACALGFKKKRKKERKKVSED

SEQ ID NO: 57206 - protein, 157 aa, Homo sapiens
  Payload ID: 11248
  Gene Symbol: NLRC5
  Gene Name: NLR family, CARD domain containing 5
  ENSP ID: ENSP00000440184
  MOD_RES (1)..(1): Any amino acid
XLSANLLGDSGLRCLLECLPQVPISGLLDLSHNSISQESALYLLETLPSCPRVREASVNLGSEQSFRIHFSREDQAGKTLRLSECSFRPEHVSRLATGLSKSLQLTELTLTQCCLGQKQLAILLSLVGRPAGLFSLRLHKAHRETVLPHTGGLCFGI

SEQ ID NO: 57207 - protein, 19 aa, Homo sapiens
  Payload ID: 11248
  Gene Symbol: NLRC5
  Gene Name: NLR family, CARD domain containing 5
  ENSP ID: ENSP00000441311
MDPVGLQLGNKNLWSCLVR

SEQ ID NO: 57208 - protein, 885 aa, Homo sapiens
  Payload ID: 11248
  Gene Symbol: NLRC5
  Gene Name: NLR family, CARD domain containing 5
  ENSP ID: ENSP00000441597
LTSFCVCTGPGHQQTGYAFTHLSLQEFLAALHLMASPKVNKDTLTQYVTLHSRWVQRTKARLGLSDHLPTFLAGLASCTCRPFLSHLAQGNEDCVGAKQAAVVQVLKKLATRKLTGPKVVELCHCVDETQEPELASLTAQSLPYQLPFHNFPLTCTDLATLTNILEHREAPIHLDFDGCPLEPHCPEALVGCGQIENLSFKSRKCGDAFAEALSRSLPTMGRLQMLGLAGSKITARGISHLVKALPLCPQLKEVSFRDNQLSDQVVLNIVEVLPHLPRLRKLDLSSNSICVSTLLCLARVAVTCPTVRMLQAREADLIFLLSPPTETTAELQRAPDLQESDGQRKGAQSRSLTLRLQKCQLQVHDAEALIALLQEGPHLEEVDLSGNQLEDEGCRLMAEAASQLHIARKLDLSNNGLSVAGVHCVLRAVSACWTLAELHISLQHKTVIFMFAQEPEEQKGPQERAAFLDSLMLQMPSELPLSSRRMRLTHCGLQEKHLEQLCKALGGSCHLGHLHLDFSGNALGDEGAARLAQLLPGLGALQSLNLSENGLSLDAVLGLVRCFSTLQWLFRLDISFESQHILLRGDKTSSLSECPLEPPSLTRLCATLKDCPGPLELQLSCEFLSDQSLETLLDCLPQLPQLSLLQLSQTGLSPKSPFLLANTLSLCPRVKKVDLRSLHHATLHFRSNEEEEGVCCGFTGCSLSQEHVESLCWLLSKCKDLSQVDLSANLLGDSGLRCLLECLPQVPISGLLDLSHNSISQESALYLLETLPSCPRVREASVNLGSEQSFRIHFSREDQAGKTLRLSECSFRPEHVSRLATGLSKSLQLTELTLTQCCLGQKQLAILLSLVGRPAGLFSLRDSTRHTEKLSFPTLEACALGFKKK

SEQ ID NO: 57209 - protein, 720 aa, Homo sapiens
  Payload ID: 11248
  Gene Symbol: NLRC5
  Gene Name: NLR family, CARD domain containing 5
  Uniprot ID: Q86WI3
  ENSP ID: ENSP00000441679
MDPVGLQLGNKNLWSCLVRLLTKDPEWLNAKMKFFLPNTDLDSRNETLDPEQRVILQLNKLHVQGSDTWQSFIHCVCMQLEVPLDLEVLLLSTFGYDDGFTSQLGAEGKSQPESQLHHGLKRPHQSCGSSPRRKQCKKQQLELAKKYLQLLRTSAQQRYRSQIPGSGQPHAFHQVYVPPILRRATASLDTPEGAIMGDVKVEDGADVSISDLFNTRVNKGPRVTVLLGKAGMGKTTLAHRLCQKWAEGHLNCFQALFLFEFRQLNLITRFLTPSELLFDLYLSPESDHDTVFQYLEKNADQVLLIFDGLDEALQPMGPDGPGPVLTLFSHLCNGTLLPGCRVMATSRPGKLPACLPAEAAMVHMLGFDGPRVEEYVNHFFSAQPSREGALVELQTNGRLRSLCAVPALCQVACLCLHHLLPDHAPGQSVALLPNMTQLYMQMVLALSPPGHLPTSSLLDLGEVALRGLETGKVIFYAKDIAPPLIAFGATHSLLTSFCVCTGPGHQQTGYAFTHLSLQEFLAALHLMASPKVNKDTLTQYVTLHSRWVQRTKARLGLSDHLPTFLAGLASCTCRPFLSHLAQGNEDCVGAKQAAVVQVLKKLATRKLTGPKVVELCHCVDETQEPELASLTAQSLPYQLPFHNFPLTCTDLATLTNILEHREAPIHLDFDGCPLEPHCPEALVGCGQIENLSFKSRKCGDAFAEALSRSLPTMGRLQMLG

SEQ ID NO: 57210 - protein, 1837 aa, Homo sapiens
  Payload ID: 11248
  Gene Symbol: NLRC5
  Gene Name: NLR family, CARD domain containing 5
  Uniprot ID: Q86WI3
  ENSP ID: ENSP00000441727
MDPVGLQLGNKNLWSCLVRLLTKDPEWLNAKMKFFLPNTDLDSRNETLDPEQRVILQLNKLHVQGSDTWQSFIHCVCMQLEVPLDLEVLLLSTFGYDDGFTSQLGAEGKSQPESQLHHGLKRPHQSCGSSPRRKQCKKQQLELAKKYLQLLRTSAQQRYRSQIPGSGQPHAFHQVYVPPILRRATASLDTPEGAIMGDVKVEDGADVSISDLFNTRVNKGPRVTVLLGKAGMGKTTLAHRLCQKWAEGHLNCFQALFLFEFRQLNLITRFLTPSELLFDLYLSPESDHDTVFQYLEKNADQVLLIFDGLDEALQPMGPDGPGPVLTLFSHLCNGTLLPGCRVMATSRPGKLPACLPAEAAMVHMLGFDGPRVEEYVNHFFSAQPSREGALVELQTNGRLRSLCAVPALCQVACLCLHHLLPDHAPGQSVALLPNMTQLYMQMVLALSPPGHLPTSSLLDLGEVALRGLETGKVIFYAKDIAPPLIAFGATHSLLTSFCVCTGPGHQQTGYAFTHLSLQEFLAALHLMASPKVNKDTLTQYVTLHSRWVQRTKARLGLSDHLPTFLAGLASCTCRPFLSHLAQGNEDCVGAKQAAVVQVLKKLATRKLTGPKVVELCHCVDETQEPELASLTAQSLPYQLPFHNFPLTCTDLATLTNILEHREAPIHLDFDGCPLEPHCPEALVGCGQIENLSFKSRKCGDAFAEALSRSLPTMGRLQMLGLAGSKITARGISHLVKALPLCPQLKEVSFRDNQLSDQVVLNIVEVLPHLPRLRKLDLSSNSICVSTLLCLARVAVTCPTVRMLQAREADLIFLLSPPTETTAELQRAPDLQESDGQRKGAQSRSLTLRLQKCQLQVHDAEALIALLQEGPHLEEVDLSGNQLEDEGCRLMAEAASQLHIARKLDLSNNGLSVAGVHCVLRAVSACWTLAELHISLQHKTVIFMFAQEPEEQKGPQERAAFLDSLMLQMPSELPLSSRRMRLTHCGLQEKHLEQLCKALGGSCHLGHLHLDFSGNALGDEGAARLAQLLPGLGALQSLNLSENGLSLDAVLGLVRCFSTLQWLFRLDISFESQHILLRGDKTSRDMWATGSLPDFPAAAKFLGFRQRCIPRSLCLSECPLEPPSLTRLCATLKDCPGPLELQLSCEFLSDQSLETLLDCLPQLPQLSLLQLSQTGLSPKSPFLLANTLSLCPRVKKVDLRSLHHATLHFRSNEEEEGVCCGLSANLLGDSGLRCLLECLPQVPISGLLDLSHNSISQESALYLLETLPSCPRVREASVNLGSEQSFRIHFSREDQAGKTLRLSECSFRPEHVSRLATGLSKSLQLTELTLTQCCLGQKQLAILLSLVGRPAGLFSLRVQEPWADRARVLSLLEVCAQASGSVTEISISETQQQLCVQLEFPRQEENPEAVALRLAHCDLGAHHSLLVGQLMETCARLQQLSLSQVNLCEDDDASSLLLQSLLLSLSELKTFRLTSSCVSTEGLAHLASGLGHCHHLEELDLSNNQFDEEGTKALMRALEGKWMLKRLDLSHLLLNSSTLALLTHRLSQMTCLQSLRLNRNSIGDVGCCHLSEALRAATSLEELDLSHNQIGDAGVQHLATILPGLPELRKIDLSGNSISSAGGVQLAESLVLCRRLEELMLGCNALGDPTALGLAQELPQHLRVLHLPFSHLGPGGALSLAQALDGSPHLEEISLAENNLAGGVLRFCMELPLLRQIDLVSCKIDNQTAKLLTSSFTSCPALEVILLSWNLLGDEAAAELAQVLPQMGRLKRVDLEKNQITALGAWLLAEGLAQGSSIQVIRLWNNPIPCDMAQHLKSQEPRLDFAFFDNQPQAPWGT

SEQ ID NO: 57211 - protein, 1180 aa, Homo sapiens
  Payload ID: 11248
  Gene Symbol: NLRC5
  Gene Name: NLR family, CARD domain containing 5
  ENSP ID: ENSP00000442906
  MOD_RES (1)..(1): Any amino acid
XHLNCFQALFLFEFRQLNLITRFLTPSELLFDLYLSPESDHDTVFQYLEKNADQVLLIFDGLDEALQPMGPDGPGPVLTLFSHLCNGTLLPGCRVMATSRPGKLPACLPAEAAMVHMLGFDGPRVEEYVNHFFSAQPSREGALVELQTNGRLRSLCAVPALCQVACLCLHHLLPDHAPGQSVALLPNMTQLYMQMVLALSPPGHLPTSSLLDLGEVALRGLETGKVIFYAKDIAPPLIAFGATHSLLTSFCVCTGPGHQQTGYAFTHLSLQEFLAALHLMASPKVNKDTLTQYVTLHSRWVQRTKARLGLSDHLPTFLAGLASCTCRPFLSHLAQGNEDCVGAKQAAVVQVLKKLATRKLTGPKVVELCHCVDETQEPELASLTAQSLPYQLPFHNFPLTCTDLATLTNILEHREAPIHLDFDGCPLEPHCPEALVGCGQIENLSFKSRKCGDAFAEALSRSLPTMGRLQMLGLAGSKITARGISHLVKALPLCPQLKEVSFRDNQLSDQVVLNIVEVLPHLPRLRKLDLSSNSICVSTLLCLARVAVTCPTVRMLQAREADLIFLLSPPTETTAELQRAPDLQESDGQRKGAQSRSLTLRLQKCQLQVHDAEALIALLQEGPHLEEVDLSGNQLEDEGCRLMAEAASQLHIARKLDLSNNGLSVAGVHCVLRAVSACWTLAELHISLQHKTVIFMFAQEPEEQKGPQERAAFLDSLMLQMPSELPLSSRRMRLTHCGLQEKHLEQLCKALGGSCHLGHLHLDFSGNALGDEGAARLAQLLPGLGALQSLNLSENGLSLDAVLGLVRCFSTLQWLFRLDISFESQHILLRGDKTSRDMWATGSLPDFPAAAKFLGFRQRCIPRSLCLSECPLEPPSLTRLCATLKDCPGPLELQLSCEFLSDQSLETLLDCLPQLPQLSLLQLSQTGLSPKSPFLLANTLSLCPRVKKVDLRSLHHATLHFRSNEEEEGVCCGFTGCSLSQEHVESLCWLLSKCKDLSQVDLSANLLGDSGLRCLLECLPQVPISGLLDLSHNSISQESALYLLETLPSCPRVREASVNLGSEQSFRIHFSREDQAGKTLRLSECSFRPEHVSRLATGLSKSLQLTELTLTQCCLGQKQLAILLSLVGRPAGLFSLRDSTRHTEKLSFPTLEACALGFKKKRKKERKKVSEDTELRTKIN

SEQ ID NO: 57212 - protein, 1057 aa, Homo sapiens
  Payload ID: 11248
  Gene Symbol: NLRC5
  Gene Name: NLR family, CARD domain containing 5
  ENSP ID: ENSP00000443825
  MOD_RES (1)..(1): Any amino acid
XSELLFDLYLSPESDHDTVFQYLEKNADQVLLIFDGLDEALQPMGPDGPGPVLTLFSHLCNGTLLPGCRVMATSRPGKLPACLPAEAAMVHMLGFDGPRVEEYVNHFFSAQPSREGALVELQTNGRLRSLCAVPALCQVACLCLHHLLPDHAPGQSVALLPNMTQLYMQMVLALSPPGHLPTSSLLDLGEVALRGLETGKVIFYAKDIAPPLIAFGATHSLLTSFCVCTGPGHQQTGYAFTHLSLQEFLAALHLMASPKVNKDTLTQYVTLHSRWVQRTKARLGLSDHLPTFLAGLASCTCRPFLSHLAQGNEDCVGAKQAAVVQVLKKLATRKLTGPKVVELCHCVDETQEPELASLTAQSLPYQLPFHNFPLTCTDLATLTNILEHREAPIHLDFDGCPLEPHCPEALVGCGQIENLSFKSRKCGDAFAEALSRSLPTMGRLQMLGLAGSKITARGISHLVKALPLCPQLKEVSFRDNQLSDQVVLNIVEVLPHLPRLRKLDLSSNSICVSTLLCLARVAVTCPTVRMLQAREADLIFLLSPPTETTAELQRAPDLQESDGQRKGAQSRSLTLRLQKCQLQVHDAEALIALLQEGPHLEEVDLSGNQLEDEGCRLMAEAASQLHIARKLDLSNNGLSVAGVHCVLRAVSACWTLAELHISLQHKTVIFMFAQEPEEQKGPQERAAFLDSLMLQMPSELPLSSRRMRLTHCGLQEKHLEQLCKALGGSCHLGHLHLDFSGNALGDEGAARLAQLLPGLGALQSLNLSENGLSLDAVLGLVRCFSTLQWLFRLDISFESQHILLRGDKTSRDMWATGSLPDFPAAAKFLGFRQRCIPRSLCLSECPLEPPSLTRLCATLKDCPGPLELQLSCEFLSDQSLETLLDCLPQLPQLSLLQLSQTGLSPKSPFLLANTLSLCPRVKKVDLRSLHHATLHFRSNEEEEGVCCGRFTGCSLSQEHVESLCWLLSKCKDLSQVDLSANLLGDSGLRCLLECLPQVPISGLLDLSHNSISQESALYLLETLPSCPRVREASVKCLGSWHVWAPCFPRPFSLQPGL

SEQ ID NO: 57213 - protein, 702 aa, Homo sapiens
  Payload ID: 11248
  Gene Symbol: NLRC5
  Gene Name: NLR family, CARD domain containing 5
  ENSP ID: ENSP00000444773
QKCQLQVHDAEALIALLQEGPHLEEVDLSGNQLEDEGCRLMAEAASQLHIARKLDLSNNGLSVAGVHCVLRAVSACWTLAELHISLQHKTVIFMFAQEPEEQKGPQERAAFLDSLMLQMPSELPLSSRRMRLTHCGLQEKHLEQLCKALGGSCHLGHLHLDFSGNALGDEGAARLAQLLPGLGALQSLNLSENGLSLDAVLGLVRCFSTLQWLFRLDISFESQHILLRGDKTSRDMWATGSLPDFPAAAKFLGFRQRCIPRSLCLSECPLEPPSLTRLCATLKDCPGPLELQLSCEFLSDQSLETLLDCLPQLPQLSLLQLSQTGLSPKSPFLLANTLSLCPRVKKVDLRSLHHATLHFRSNEEEEGVCCGRFTGCSLSQEHVESLCWLLSKCKDLSQVDLSANLLGDSGLRCLLECLPQVPISGLLDLSHNSISQESALYLLETLPSCPRVREASVNLGSEQSFRIHFSREDQAGKTLRLSECSFRPEHVSRLATGLSKSLQLTELTLTQCCLGQKQLAILLSLVGRPAGLFSLRVQEPWADRARVLSLLEVCAQASGSVTEISISETQQQLCVQLEFPRQEENPEAVALRLAHCDLGAHHSLLVGQLMETCARLQQLSLSQVNLCEDDDASSLLLQSLLLSLSELKTFRIQSSQDPGRLLPDLLPFDPHQADLQLCEHRGPRPPGIWSGPLPPLGGAGLV

SEQ ID NO: 57214 - protein, 110 aa, Homo sapiens
  Payload ID: 11248
  Gene Symbol: NLRC5
  Gene Name: NLR family, CARD domain containing 5
  ENSP ID: ENSP00000444960
  MOD_RES (1)..(1): Any amino acid
XASGLGHCHHLEELDLSNNQFDEEGTKALMRALEGKWMLKRLDLSHLLLNSSTLALLTHRLSQMTCLQSLSLTLSPRLECSGMISLHCNLCLLGSSDSGASAAQVAGITD

SEQ ID NO: 57215 - protein, 1375 aa, Homo sapiens
  Payload ID: 11249
  Gene Symbol: NLRP1
  Gene Name: NLR family, pyrin domain containing 1
  Uniprot ID: Q9C000
  ENSP ID: ENSP00000262467
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGLDQTTLSDEMRQELRALEQEKPQLLIFSRRKPSVMTPTEGLDTGEMSNSTSSLKRQRLGSERAASHVAQANLKLLDVSKIFPIAEIAGKSHEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKAIDDLEMKFQFVRIHKPPPLTPLYMGCRYTVSGSGSGMLEILPKELELCYRSPGEDQLFSEFYVGHLGSGIRLQVKDKKDETLVWEALVKPGRNTSQPWNLRCNRDARRY

SEQ ID NO: 57216 - protein, 1429 aa, Homo sapiens
  Payload ID: 11249
  Gene Symbol: NLRP1
  Gene Name: NLR family, pyrin domain containing 1
  Uniprot ID: Q9C000
  ENSP ID: ENSP00000269280
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGLDQTTLSDEMRQELRALEQEKPQLLIFSRRKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKELELCYRSPGEDQLFSEFYVGHLGSGIRLQVKDKKDETLVWEALVKPGDLMPATTLIPPARIAVPSPLDAPQLLHFVDQYREQLIARVTSVEVVLDKLHGQVLSQEQYERVLAENTRPSQMRKLFSLSQSWDRKCKDGLYQALKETHPHLIMELWEKGSKKGLLPLSS

SEQ ID NO: 57217 - protein, 1429 aa, Homo sapiens; identical to SEQ ID NO: 57216
  Payload ID: 11249
  Gene Symbol: NLRP1
  Gene Name: NLR family, pyrin domain containing 1
  Uniprot ID: Q9C000
  ENSP ID: ENSP00000324366

SEQ ID NO: 57218 - protein, 1443 aa, Homo sapiens
  Payload ID: 11249
  Gene Symbol: NLRP1
  Gene Name: NLR family, pyrin domain containing 1
  Uniprot ID: Q9C000
  ENSP ID: ENSP00000346390
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKAIDDLEMKFQFVRIHKPPPLTPLYMGCRYTVSGSGSGMLEILPKELELCYRSPGEDQLFSEFYVGHLGSGIRLQVKDKKDETLVWEALVKPGDLMPATTLIPPARIAVPSPLDAPQLLHFVDQYREQLIARVTSVEVVLDKLHGQVLSQEQYERVLAENTRPSQMRKLFSLSQSWDRKCKDGLYQALKETHPHLIMELWEKGSKKGLLPLSS

SEQ ID NO: 57219 - protein, 1375 aa, Homo sapiens; identical to SEQ ID NO: 57215
  Payload ID: 11249
  Gene Symbol: NLRP1
  Gene Name: NLR family, pyrin domain containing 1
  Uniprot ID: Q9C000
  ENSP ID: ENSP00000442029

SEQ ID NO: 57220 - protein, 35 aa, Homo sapiens
  Payload ID: 11249
  Gene Symbol: NLRP1
  Gene Name: NLR family, pyrin domain containing 1
  ENSP ID: ENSP00000458303
MAGGAWGRLACYLEFLKKEELKEFQLLLANKAHSR

SEQ ID NO: 57221 - protein, 1051 aa, Homo sapiens
  Payload ID: 11249
  Gene Symbol: NLRP1
  Gene Name: NLR family, pyrin domain containing 1
  ENSP ID: ENSP00000459661
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGLDQTTLSDEMRQELRALEQEKPQLLIFSRRKPSVMTPTEGLDTGEMSNSTSSLKRQRLGSERAASHVAQANLKLLDVSKIFPIAEIAEESSPEV

SEQ ID NO: 57222 - protein, 1399 aa, Homo sapiens
  Payload ID: 11249
  Gene Symbol: NLRP1
  Gene Name: NLR family, pyrin domain containing 1
  Uniprot ID: Q9C000
  ENSP ID: ENSP00000460216
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKELELCYRSPGEDQLFSEFYVGHLGSGIRLQVKDKKDETLVWEALVKPGDLMPATTLIPPARIAVPSPLDAPQLLHFVDQYREQLIARVTSVEVVLDKLHGQVLSQEQYERVLAENTRPSQMRKLFSLSQSWDRKCKDGLYQALKETHPHLIMELWEKGSKKGLLPLSS

SEQ ID NO: 57223 - protein, 1473 aa, Homo sapiens
  Payload ID: 11249
  Gene Symbol: NLRP1
  Gene Name: NLR family, pyrin domain containing 1
  Uniprot ID: Q9C000
  ENSP ID: ENSP00000460475
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPWEPSVRESLCSTWPWKNEDFNQKFTQLLLLQRPHPRSQDPLVKRSWPDYVEENRGHLIEIRDLFGPGLDTQEPRIVILQGAAGIGKSTLARQVKEAWGRGQLYGDRFQHVFYFSCRELAQSKVVSLAELIGKDGTATPAPIRQILSRPERLLFILDGVDEPGWVLQEPSSELCLHWSQPQPADALLGSLLGKTILPEASFLITARTTALQNLIPSLEQARWVEVLGFSESSRKEYFYRYFTDERQAIRAFRLVKSNKELWALCLVPWVSWLACTCLMQQMKRKEKLTLTSKTTTTLCLHYLAQALQAQPLGPQLRDLCSLAAEGIWQKKTLFSPDDLRKHGLDGAIISTFLKMGILQEHPIPLSYSFIHLCFQEFFAAMSYVLEDEKGRGKHSNCIIDLEKTLEAYGIHGLFGASTTRFLLGLLSDEGEREMENIFHCRLSQGRNLMQWVPSLQLLLQPHSLESLHCLYETRNKTFLTQVMAHFEEMGMCVETDMELLVCTFCIKFSRHVKKLQLIEGRQHRSTWSPTMVVLFRWVPVTDAYWQILFSVLKVTRNLKELDLSGNSLSHSAVKSLCKTLRRPRCLLETLRLAGCGLTAEDCKDLAFGLRANQTLTELDLSFNVLTDAGAKHLCQRLRQPSCKLQRLQLVSCGLTSDCCQDLASVLSASPSLKELDLQQNNLDDVGVRLLCEGLRHPACKLIRLGLDQTTLSDEMRQELRALEQEKPQLLIFSRRKPSVMTPTEGLDTGEMSNSTSSLKRQRLGSERAASHVAQANLKLLDVSKIFPIAEIAEESSPEVVPVELLCVPSPASQGDLHTKPLGTDDDFWGPTGPVATEVVDKEKNLYRVHFPVAGSYRWPNTGLCFVMREAVTVEIEFCVWDQFLGEINPQHSWMVAGPLLDIKAEPGAVEAVHLPHFVALQGGHVDTSLFQMAHFKEEGMLLEKPARVELHHIVLENPSFSPLGVLLKMIHNALRFIPVTSVVLLYHRVHPEEVTFHLYLIPSDCSIRKAIDDLEMKFQFVRIHKPPPLTPLYMGCRYTVSGSGSGMLEILPKELELCYRSPGEDQLFSEFYVGHLGSGIRLQVKDKKDETLVWEALVKPGDLMPATTLIPPARIAVPSPLDAPQLLHFVDQYREQLIARVTSVEVVLDKLHGQVLSQEQYERVLAENTRPSQMRKLFSLSQSWDRKCKDGLYQALKETHPHLIMELWEKGSKKGLLPLSS

SEQ ID NO: 57224 - protein, 1473 aa, Homo sapiens; identical to SEQ ID NO: 57223
  Payload ID: 11249
  Gene Symbol: NLRP1
  Gene Name: NLR family, pyrin domain containing 1
  Uniprot ID: Q9C000
  ENSP ID: ENSP00000478516

SEQ ID NO: 57225 - protein, 1375 aa, Homo sapiens; identical to SEQ ID NO: 57215
  Payload ID: 11249
  Gene Symbol: NLRP1
  Gene Name: NLR family, pyrin domain containing 1
  Uniprot ID: Q9C000
  ENSP ID: ENSP00000483359

SEQ ID NO: 57226 - protein, 1443 aa, Homo sapiens; identical to SEQ ID NO: 57218
  Payload ID: 11249
  Gene Symbol: NLRP1
  Gene Name: NLR family, pyrin domain containing 1
  Uniprot ID: Q9C000
  ENSP ID: ENSP00000484692

SEQ ID NO: 57227 - protein, 655 aa, Homo sapiens
  Payload ID: 11250
  Gene Symbol: NLRP10
  Gene Name: NLR family, pyrin domain containing 10
  Uniprot ID: Q86W26
  ENSP ID: ENSP00000327763
MAMAKARKPREALLWALSDLEENDFKKLKFYLRDMTLSEGQPPLARGELEGLIPVDLAELLISKYGEKEAVKVVLKGLKVMNLLELVDQLSHICLHDYREVYREHVRCLEEWQEAGVNGRYNQVLLVAKPSSESPESLACPFPEQELESVTVEALFDSGEKPSLAPSLVVLQGSAGTGKTTLARKMVLDWATGTLYPGRFDYVFYVSCKEVVLLLESKLEQLLFWCCGDNQAPVTEILRQPERLLFILDGFDELQRPFEEKLKKRGLSPKESLLHLLIRRHTLPTCSLLITTRPLALRNLEPLLKQARHVHILGFSEEERARYFSSYFTDEKQADRAFDIVQKNDILYKACQVPGICWVVCSWLQGQMERGKVVLETPRNSTDIFMAYVSTFLPPDDDGGCSELSRHRVLRSLCSLAAEGIQHQRFLFEEAELRKHNLDGPRLAAFLSSNDYQLGLAIKKFYSFRHISFQDFFHAMSYLVKEDQSRLGKESRREVQRLLEVKEQEGNDEMTLTMQFLLDISKKDSFSNLELKFCFRISPCLAQDLKHFKEQMESMKHNRTWDLEFSLYEAKIKNLVKGIQMNNVSFKIKHSNEKKSQSQNLFSVKSSLSHGPKEEQKCPSVHGQKEGKDNIAGTQKEASTGKGRGTEETPKNTYI

SEQ ID NO: 57228 - protein, 65 aa, Homo sapiens
  Payload ID: 11250
  Gene Symbol: NLRP10
  Gene Name: NLR family, pyrin domain containing 10
  ENSP ID: ENSP00000436255
MAMAKARKPREALLWALSDLEENDFKKLKFYLRDMTLSEGQPPLARGELEGLIPVDLAELLISKY

SEQ ID NO: 57229 - protein, 655 aa, Homo sapiens; identical to SEQ ID NO: 57227
  Payload ID: 11250
  Gene Symbol: NLRP10
  Gene Name: NLR family, pyrin domain containing 10
  Uniprot ID: Q86W26
  ENSP ID: ENSP00000478480

SEQ ID NO: 57230 - protein, 65 aa, Homo sapiens; identical to SEQ ID NO: 57228
  Payload ID: 11250
  Gene Symbol: NLRP10
  Gene Name: NLR family, pyrin domain containing 10
  ENSP ID: ENSP00000485716

SEQ ID NO: 57231 - protein, 655 aa, Homo sapiens; identical to SEQ ID NO: 57227
  Payload ID: 11250
  Gene Symbol: NLRP10
  Gene Name: NLR family, pyrin domain containing 10
  Uniprot ID: Q86W26
  ENSP ID: ENSP00000486762

SEQ ID NO: 57232 - protein, 65 aa, Homo sapiens; identical to SEQ ID NO: 57228
  Payload ID: 11250
  Gene Symbol: NLRP10
  Gene Name: NLR family, pyrin domain containing 10
  ENSP ID: ENSP00000487371

SEQ ID NO: 57233 - protein, 1033 aa, Homo sapiens
  Payload ID: 11251
  Gene Symbol: NLRP11
  Gene Name: NLR family, pyrin domain containing 11
  Uniprot ID: P59045
  ENSP ID: ENSP00000466285
MAESDSTDFDLLWYLENLSDKEFQSFKKYLARKILDFKLPQFPLIQMTKEELANVLPISYEGQYIWNMLFSIFSMMRKEDLCRKIIGRRNRNQEACKAVMRRKFMLQWESHTFGKFHYKFFRDVSSDVFYILQLAYDSTSYYSANNLNVFLMGERASGKTIVINLAVLRWIKGEMWQNMISYVVHLTAHEINQMTNSSLAELIAKDWPDGQAPIADILSDPKKLLFILEDLDNIRFELNVNESALCSNSTQKVPIPVLLVSLLKRKMAPGCWFLISSRPTRGNNVKTFLKEVDCCTTLQLSNGKREIYFNSFFKDRQRASAALQLVHEDEILVGLCRVAILCWITCTVLKRQMDKGRDFQLCCQTPTDLHAHFLADALTSEAGLTANQYHLGLLKRLCLLAAGGLFLSTLNFSGEDLRCVGFTEADVSVLQAANILLPSNTHKDRYKFIHLNVQEFCTAIAFLMAVPNYLIPSGSREYKEKREQYSDFNQVFTFIFGLLNANRRKILETSFGYQLPMVDSFKWYSVGYMKHLDRDPEKLTHHMPLFYCLYENREEEFVKTIVDALMEVTVYLQSDKDMMVSLYCLDYCCHLRTLKLSVQRIFQNKEPLIRPTASQMKSLVYWREICSLFYTMESLRELHIFDNDLNGISERILSKALEHSSCKLRTLKLSYVSTASGFEDLLKALARNRSLTYLSINCTSISLNMFSLLHDILHEPTCQISHLSLMKCDLRASECEEIASLLISGGSLRKLTLSSNPLRSDGMNILCDALLHPNCTLISLVLVFCCLTENCCSALGRVLLFSPTLRQLDLCVNRLKNYGVLHVTFPLLFPTCQLEELHLSGCFFSSDICQYIAIVIATNEKLRSLEIGSNKIEDAGMQLLCGGLRHPNCMLVNIGLEECMLTSACCRSLASVLTTNKTLERLNLLQNHLGNDGVAKLLESLISPDCVLKVVGLPLTGLNTQTQQLLMTVKERKPSLIFLSETWSLKEGREIGVTPASQPGSIIPNSNLDYMFFKFPRMSAAMRTSNTASRQPL

SEQ ID NO: 57234 - protein, 654 aa, Homo sapiens
  Payload ID: 11251
  Gene Symbol: NLRP11
  Gene Name: NLR family, pyrin domain containing 11
  ENSP ID: ENSP00000466582
MRRKFMLQWESHTFGKFHYKFFRDVSSDVFYILQLAYDSTSYYSANNLNVFLMGERASGKTIVINLAVLRWIKGEMWQNMISYVVHLTAHEINQMTNSSLAELIAKDWPDGQAPIADILSDPKKLLFILEDLDNIRFELNVNESALCSNSTQKVPIPVLLVSLLKRKMAPGCWFLISSRPTRGNNVKTFLKEVDCCTTLQLSNGKREIYFNSFFKDRQRASAALQLVHEDEILVGLCRVAILCWITCTVLKRQMDKGRDFQLCCQTPTDLHAHFLADALTSEAGLTANQYHLGLLKRLCLLAAGGLFLSTLNFSGEDLRCVGFTEADVSVLQAANILLPSNTHKDRYKFIHLNVQEFCTAIAFLMAVPNYLIPSGSREYKEKREQYSDFNQVFTFIFGLLNANRRKILETSFGYQLPMVDSFKWYSVGYMKHLDRDPEKLTHHMPLFYCLYENREEEFVKTIVDALMEVTVYLQSDKDMMVSLYCLDYCCHLRTLKLSVQRIFQNKEPLIRPTASQMKSLVYWREICSLFYTMESLRELHIFDNDLNGISERILSKALEHSSCKLRTLKLSYVSTASGFEDLLKALARNRSLTYLSINCTSISLNMFSLLHDILHEPTCQISHLRIHRPTRRLTPGIPTLWEAEAGRSPELDEM

SEQ ID NO: 57235 - protein, 751 aa, Homo sapiens
  Payload ID: 11251
  Gene Symbol: NLRP11
  Gene Name: NLR family, pyrin domain containing 11
  ENSP ID: ENSP00000467988
MAESDSTDFDLLWYLENLSDKEFQSFKKYLARKILDFKLPQFPLIQMTKEELANVLPISYEGQYIWNMLFSIFSMMRKEDLCRKIIGRRNRNQEACKAVMRRKFMLQWESHTFGKFHYKFFRDVSSDVFYILQLAYDSTSYYSANNLNVFLMGERASGKTIVINLAVLRWIKGEMWQNMISYVVHLTAHEINQMTNSSLAELIAKDWPDGQAPIADILSDPKKLLFILEDLDNIRFELNVNESALCSNSTQKVPIPVLLVSLLKRKMAPGCWFLISSRPTRGNNVKTFLKEVDCCTTLQLSNGKREIYFNSFFKDRQRASAALQLVHEDEILVGLCRVAILCWITCTVLKRQMDKGRDFQLCCQTPTDLHAHFLADALTSEAGLTANQYHLGLLKRLCLLAAGGLFLSTLNFSGEDLRCVGFTEADVSVLQAANILLPSNTHKDRYKFIHLNVQEFCTAIAFLMAVPNYLIPSGSREYKEKREQYSDFNQVFTFIFGLLNANRRKILETSFGYQLPMVDSFKWYSVGYMKHLDRDPEKLTHHMPLFYCLYENREEEFVKTIVDALMEVTVYLQSDKDMMVSLYCLDYCCHLRTLKLSVQRIFQNKEPLIRPTASQMKSLVYWREICSLFYTMESLRELHIFDNDLNGISERILSKALEHSSCKLRTLKLSYVSTASGFEDLLKALARNRSLTYLSINCTSISLNMFSLLHDILHEPTCQISHLRWSFALVAQARVQWHSLSSPQPLTSRFK

SEQ ID NO: 57236 - protein, 979 aa, Homo sapiens
  Payload ID: 11251
  Gene Symbol: NLRP11
  Gene Name: NLR family, pyrin domain containing 11
  Uniprot ID: P59045
  ENSP ID: ENSP00000468082
MAESDSTDFDLLWYLENLSDKEFQSFKKYLARKILDFKLPQFPLIQMTKEELANVLPISYEGQYIWNMLFSIFSMMRKEDLCRKIIGRRNRNQEACKAVMRRKFMLQWESHTFGKFHYKFFRDVSSDVFYILQLAYDSTSYYSANNLNVFLMGERASGKTIVINLAVLRWIKGEMWQNMISYVVHLTAHEINQMTNSSLAELIAKDWPDGQAPIADILSDPKKLLFILEDLDNIRFELNVNESALCSNSTQKVPIPVLLVSLLKRKMAPGCWFLISSRPTRGNNVKTFLKEVDCCTTLQLSNGKREIYFNSFFKDRQRASAALQLVHEDEILVGLCRVAILCWITCTVLKRQMDKGRDFQLCCQTPTDLHAHFLADALTSEAGLTANQYHLGLLKRLCLLAAGGLFLSTLNFSGEDLRCVGFTEADVSVLQAANILLPSNTHKDRYKFIHLNVQEFCTAIAFLMAVPNYLIPSGSREYKEKREQYSDFNQVFTFIFGLLNANRRKILETSFGYQLPMVDSFKWYSVGYMKHLDRDPEKLTHHMPLFYCLYENREEEFVKTIVDALMEVTVYLQSDKDMMVSLYCLDYCCHLRTLKLSVQRIFQNKEPLIRPTARLSYVSTASGFEDLLKALARNRSLTYLSINCTSISLNMFSLLHDILHEPTCQISHLSLMKCDLRASECEEIASLLISGGSLRKLTLSSNPLRSDGMNILCDALLHPNCTLISLVLVFCCLTENCCSALGRVLLFSPTLRQLDLCVNRLKNYGVLHVTFPLLFPTCQLEELHLSGCFFSSDICQYIAIVIATNEKLRSLEIGSNKIEDAGMQLLCGGLRHPNCMLVNIGLEECMLTSACCRSLASVLTTNKTLERLNLLQNHLGNDGVAKLLESLISPDCVLKVVGLPLTGLNTQTQQLLMTVKERKPSLIFLSETWSLKEGREIGVTPASQPGSIIPNSNLDYMFFKFPRMSAAMRTSNTASRQPL

SEQ ID NO: 57237 - protein, 934 aa, Homo sapiens
  Payload ID: 11251
  Gene Symbol: NLRP11
  Gene Name: NLR family, pyrin domain containing 11
  Uniprot ID: P59045
  ENSP ID: ENSP00000468196
MRRKFMLQWESHTFGKFHYKFFRDVSSDVFYILQLAYDSTSYYSANNLNVFLMGERASGKTIVINLAVLRWIKGEMWQNMISYVVHLTAHEINQMTNSSLAELIAKDWPDGQAPIADILSDPKKLLFILEDLDNIRFELNVNESALCSNSTQKVPIPVLLVSLLKRKMAPGCWFLISSRPTRGNNVKTFLKEVDCCTTLQLSNGKREIYFNSFFKDRQRASAALQLVHEDEILVGLCRVAILCWITCTVLKRQMDKGRDFQLCCQTPTDLHAHFLADALTSEAGLTANQYHLGLLKRLCLLAAGGLFLSTLNFSGEDLRCVGFTEADVSVLQAANILLPSNTHKDRYKFIHLNVQEFCTAIAFLMAVPNYLIPSGSREYKEKREQYSDFNQVFTFIFGLLNANRRKILETSFGYQLPMVDSFKWYSVGYMKHLDRDPEKLTHHMPLFYCLYENREEEFVKTIVDALMEVTVYLQSDKDMMVSLYCLDYCCHLRTLKLSVQRIFQNKEPLIRPTASQMKSLVYWREICSLFYTMESLRELHIFDNDLNGISERILSKALEHSSCKLRTLKLSYVSTASGFEDLLKALARNRSLTYLSINCTSISLNMFSLLHDILHEPTCQISHLSLMKCDLRASECEEIASLLISGGSLRKLTLSSNPLRSDGMNILCDALLHPNCTLISLVLVFCCLTENCCSALGRVLLFSPTLRQLDLCVNRLKNYGVLHVTFPLLFPTCQLEELHLSGCFFSSDICQYIAIVIATNEKLRSLEIGSNKIEDAGMQLLCGGLRHPNCMLVNIGLEECMLTSACCRSLASVLTTNKTLERLNLLQNHLGNDGVAKLLESLISPDCVLKVVGLPLTGLNTQTQQLLMTVKERKPSLIFLSETWSLKEGREIGVTPASQPGSIIPNSNLDYMFFKFPRMSAAMRTSNTASRQPL

SEQ ID NO: 57238 - protein, 25 aa, Homo sapiens
  Payload ID: 11251
  Gene Symbol: NLRP11
  Gene Name: NLR family, pyrin domain containing 11
  ENSP ID: ENSP00000468696
MRRKFMLQWESHTFGKFHYKFFRDV

SEQ ID NO: 57239 - protein, 1061 aa, Homo sapiens
  Payload ID: 11252
  Gene Symbol: NLRP12
  Gene Name: NLR family, pyrin domain containing 12
  Uniprot ID: P59046
  ENSP ID: ENSP00000319377
MLRTAGRDGLCRLSTYLEELEAVELKKFKLYLGTATELGEGKIPWGSMEKAGPLEMAQLLITHFGPEEAWRLALSTFERINRKDLWERGQREDLVRDTPPGGPSSLGNQSTCLLEVSLVTPRKDPQETYRDYVRRKFRLMEDRNARLGECVNLSHRYTRLLLVKEHSNPMQVQQQLLDTGRGHARTVGHQASPIKIETLFEPDEERPEPPRTVVMQGAAGIGKSMLAHKVMLDWADGKLFQGRFDYLFYINCREMNQSATECSMQDLIFSCWPEPSAPLQELIRVPERLLFIIDGFDELKPSFHDPQGPWCLCWEEKRPTELLLNSLIRKKLLPELSLLITTRPTALEKLHRLLEHPRHVEILGFSEAERKEYFYKYFHNAEQAGQVFNYVRDNEPLFTMCFVPLVCWVVCTCLQQQLEGGGLLRQTSRTTTAVYMLYLLSLMQPKPGAPRLQPPPNQRGLCSLAADGLWNQKILFEEQDLRKHGLDGEDVSAFLNMNIFQKDINCERYYSFIHLSFQEFFAAMYYILDEGEGGAGPDQDVTRLLTEYAFSERSFLALTSRFLFGLLNEETRSHLEKSLCWKVSPHIKMDLLQWIQSKAQSDGSTLQQGSLEFFSCLYEIQEEEFIQQALSHFQVIVVSNIASKMEHMVSSFCLKRCRSAQVLHLYGATYSADGEDRARCSAGAHTLLVQLPERTVLLDAYSEHLAAALCTNPNLIELSLYRNALGSRGVKLLCQGLRHPNCKLQNLRLKRCRISSSACEDLSAALIANKNLTRMDLSGNGVGFPGMMLLCEGLRHPQCRLQMIQLRKCQLESGACQEMASVLGTNPHLVELDLTGNALEDLGLRLLCQGLRHPVCRLRTLWLKICRLTAAACDELASTLSVNQSLRELDLSLNELGDLGVLLLCEGLRHPTCKLQTLRLGICRLGSAACEGLSVVLQANHNLRELDLSFNDLGDWGLWLLAEGLQHPACRLQKLWLDSCGLTAKACENLYFTLGINQTLTDLYLTNNALGDTGVRLLCKRLSHPGCKLRVLWLFGMDLNKMTHSRLAALRVTKPYLDIGC

SEQ ID NO: 57240 - protein, 1006 aa, Homo sapiens
  Payload ID: 11252
  Gene Symbol: NLRP12
  Gene Name: NLR family, pyrin domain containing 12
  ENSP ID: ENSP00000341428
MLRTAGRDGLCRLSTYLEELEAVELKKFKLYLGTATELGEGKIPWGSMEKAGPLEMAQLLITHFGPEEAWRLALSTFERINRKDLWERGQREDLVRDTPPGGPSSLGNQSTCLLEVSLVTPRKDPQETYRDYVRRKFRLMEDRNARLGECVNLSHRYTRLLLVKEHSNPMQVQQQLLDTGRGHARTVGHQASPIKIETLFEPDEERPEPPRTVVMQGAAGIGKSMLAHKVMLDWADGKLFQGRFDYLFYINCREMNQSATECSMQDLIFSCWPEPSAPLQELIRVPERLLFIIDGFDELKPSFHDPQGPWCLCWEEKRPTELLLNSLIRKKLLPELSLLITTRPTALEKLHRLLEHPRHVEILGFSEAERKEYFYKYFHNAEQAGQVFNYVRDNEPLFTMCFVPLVCWVVCTCLQQQLEGGGLLRQTSRTTTAVYMLYLLSLMQPKPGAPRLQPPPNQRGLCSLAADGLWNQKILFEEQDLRKHGLDGEDVSAFLNMNIFQKDINCERYYSFIHLSFQEFFAAMYYILDEGEGGAGPDQDVTRLLTEYAFSERSFLALTSRFLFGLLNEETRSHLEKSLCWKVSPHIKMDLLQWIQSKAQSDGSTLQQGSLEFFSCLYEIQEEEFIQQALSHFQVIVVSNIASKMEHMVSSFCLKRCRSAQVLHLYGATYSADGEDRARCSAGAHTLLVQLRPERTVLLDAYSEHLAAALCTNPNLIELSLYRNALGSRGVKLLCQGLRHPNCKLQNLRLKRCRISSSACEDLSAALIANKNLTRMDLSGNGVGFPGMMLLCEGLRHPQCRLQMIQLRKCQLESGACQEMASVLGTNPHLVELDLTGNALEDLGLRLLCQGLRHPVCRLRTLWLKICRLTAAACDELASTLSVNQSLRELDLSLNELGDLGVLLLCEGLRHPTCKLQTLRLGICRLGSAACEGLSVVLQANHNLRELDLSFNDLGDWGLWLLAEGLQHPACRLQKLWWLFGMDLNKMTHSRLAALRVTKPYLDIGC

SEQ ID NO: 57241 - protein, 892 aa, Homo sapiens
  Payload ID: 11252
  Gene Symbol: NLRP12
  Gene Name: NLR family, pyrin domain containing 12
  ENSP ID: ENSP00000375652
MLRTAGRDGLCRLSTYLEELEAVELKKFKLYLGTATELGEGKIPWGSMEKAGPLEMAQLLITHFGPEEAWRLALSTFERINRKDLWERGQREDLVRDTPPGGPSSLGNQSTCLLEVSLVTPRKDPQETYRDYVRRKFRLMEDRNARLGECVNLSHRYTRLLLVKEHSNPMQVQQQLLDTGRGHARTVGHQASPIKIETLFEPDEERPEPPRTVVMQGAAGIGKSMLAHKVMLDWADGKLFQGRFDYLFYINCREMNQSATECSMQDLIFSCWPEPSAPLQELIRVPERLLFIIDGFDELKPSFHDPQGPWCLCWEEKRPTELLLNSLIRKKLLPELSLLITTRPTALEKLHRLLEHPRHVEILGFSEAERKEYFYKYFHNAEQAGQVFNYVRDNEPLFTMCFVPLVCWVVCTCLQQQLEGGGLLRQTSRTTTAVYMLYLLSLMQPKPGAPRLQPPPNQRGLCSLAADGLWNQKILFEEQDLRKHGLDGEDVSAFLNMNIFQKDINCERYYSFIHLSFQEFFAAMYYILDEGEGGAGPDQDVTRLLTEYAFSERSFLALTSRFLFGLLNEETRSHLEKSLCWKVSPHIKMDLLQWIQSKAQSDGSTLQQGSLEFFSCLYEIQEEEFIQQALSHFQVIVVSNIASKMEHMVSSFCLKRCRSAQVLHLYGATYSADGEDRARCSAGAHTLLVQLRPERTVLLDAYSEHLAAALCTNPNLIELSLYRNALGSRGVKLLCQGLRHPNCKLQNLRLKRCRISSSACEDLSAALIANKNLTRMDLSGNGVGFPGMMLLCEGLRHPQCRLQMIQLRKCQLESGACQEMASVLGTNPHLVELDLTGNALEDLGLRLLCQGLRHPVCRLRTLWWLFGMDLNKMTHSRLAALRVTKPYLDIGC

SEQ ID NO: 57242 - protein, 1062 aa, Homo sapiens
  Payload ID: 11252
  Gene Symbol: NLRP12
  Gene Name: NLR family, pyrin domain containing 12
  Uniprot ID: P59046
  ENSP ID: ENSP00000375653
MLRTAGRDGLCRLSTYLEELEAVELKKFKLYLGTATELGEGKIPWGSMEKAGPLEMAQLLITHFGPEEAWRLALSTFERINRKDLWERGQREDLVRDTPPGGPSSLGNQSTCLLEVSLVTPRKDPQETYRDYVRRKFRLMEDRNARLGECVNLSHRYTRLLLVKEHSNPMQVQQQLLDTGRGHARTVGHQASPIKIETLFEPDEERPEPPRTVVMQGAAGIGKSMLAHKVMLDWADGKLFQGRFDYLFYINCREMNQSATECSMQDLIFSCWPEPSAPLQELIRVPERLLFIIDGFDELKPSFHDPQGPWCLCWEEKRPTELLLNSLIRKKLLPELSLLITTRPTALEKLHRLLEHPRHVEILGFSEAERKEYFYKYFHNAEQAGQVFNYVRDNEPLFTMCFVPLVCWVVCTCLQQQLEGGGLLRQTSRTTTAVYMLYLLSLMQPKPGAPRLQPPPNQRGLCSLAADGLWNQKILFEEQDLRKHGLDGEDVSAFLNMNIFQKDINCERYYSFIHLSFQEFFAAMYYILDEGEGGAGPDQDVTRLLTEYAFSERSFLALTSRFLFGLLNEETRSHLEKSLCWKVSPHIKMDLLQWIQSKAQSDGSTLQQGSLEFFSCLYEIQEEEFIQQALSHFQVIVVSNIASKMEHMVSSFCLKRCRSAQVLHLYGATYSADGEDRARCSAGAHTLLVQLRPERTVLLDAYSEHLAAALCTNPNLIELSLYRNALGSRGVKLLCQGLRHPNCKLQNLRLKRCRISSSACEDLSAALIANKNLTRMDLSGNGVGFPGMMLLCEGLRHPQCRLQMIQLRKCQLESGACQEMASVLGTNPHLVELDLTGNALEDLGLRLLCQGLRHPVCRLRTLWLKICRLTAAACDELASTLSVNQSLRELDLSLNELGDLGVLLLCEGLRHPTCKLQTLRLGICRLGSAACEGLSVVLQANHNLRELDLSFNDLGDWGLWLLAEGLQHPACRLQKLWLDSCGLTAKACENLYFTLGINQTLTDLYLTNNALGDTGVRLLCKRLSHPGCKLRVLWLFGMDLNKMTHSRLAALRVTKPYLDIGC

SEQ ID NO: 57243 - protein, 1004 aa, Homo sapiens
  Payload ID: 11252
  Gene Symbol: NLRP12
  Gene Name: NLR family, pyrin domain containing 12
  Uniprot ID: P59046
  ENSP ID: ENSP00000375655
MLRTAGRDGLCRLSTYLEELEAVELKKFKLYLGTATELGEGKIPWGSMEKAGPLEMAQLLITHFGPEEAWRLALSTFERINRKDLWERGQREDLVRDTPPGGPSSLGNQSTCLLEVSLVTPRKDPQETYRDYVRRKFRLMEDRNARLGECVNLSHRYTRLLLVKEHSNPMQVQQQLLDTGRGHARTVGHQASPIKIETLFEPDEERPEPPRTVVMQGAAGIGKSMLAHKVMLDWADGKLFQGRFDYLFYINCREMNQSATECSMQDLIFSCWPEPSAPLQELIRVPERLLFIIDGFDELKPSFHDPQGPWCLCWEEKRPTELLLNSLIRKKLLPELSLLITTRPTALEKLHRLLEHPRHVEILGFSEAERKEYFYKYFHNAEQAGQVFNYVRDNEPLFTMCFVPLVCWVVCTCLQQQLEGGGLLRQTSRTTTAVYMLYLLSLMQPKPGAPRLQPPPNQRGLCSLAADGLWNQKILFEEQDLRKHGLDGEDVSAFLNMNIFQKDINCERYYSFIHLSFQEFFAAMYYILDEGEGGAGPDQDVTRLLTEYAFSERSFLALTSRFLFGLLNEETRSHLEKSLCWKVSPHIKMDLLQWIQSKAQSDGSTLQQGSLEFFSCLYEIQEEEFIQQALSHFQVIVVSNIASKMEHMVSSFCLKRCRSAQVLHLYGATYSADGEDRARCSAGAHTLLVQLPERTVLLDAYSEHLAAALCTNPNLIELSLYRNALGSRGVKLLCQGLRHPNCKLQNLRLKRCRISSSACEDLSAALIANKNLTRMDLSGNGVGFPGMMLLCEGLRHPQCRLQMIQLRKCQLESGACQEMASVLGTNPHLVELDLTGNALEDLGLRLLCQGLRHPVCRLRTLWLKICRLTAAACDELASTLSVNQSLRELDLSLNELGDLGVLLLCEGLRHPTCKLQTLRLDSCGLTAKACENLYFTLGINQTLTDLYLTNNALGDTGVRLLCKRLSHPGCKLRVLWLFGMDLNKMTHSRLAALRVTKPYLDIGC

SEQ ID NO: 57244 - protein, 1043 aa, Homo sapiens
  Payload ID: 11253
  Gene Symbol: NLRP13
  Gene Name: NLR family, pyrin domain containing 13
  Uniprot ID: Q86W25
  ENSP ID: ENSP00000343891
MNFSVITCPNGGTNQGLLPYLMALDQYQLEEFKLCLEPQQLMDFWSAPQGHFPRIPWANLRAADPLNLSFLLDEHFPKGQAWKVVLGIFQTMNLTSLCEKVRAEMKENVQTQELQDPTQEDLEMLEAAAGNMQTQGCQDPNQEELDELEEETGNVQAQGCQDPNQEEPEMLEEADHRRKYRENMKAELLETWDNISWPKDHVYIRNTSKDEHEELQRLLDPNRTRAQAQTIVLVGRAGVGKTTLAMQAMLHWANGVLFQQRFSYVFYLSCHKIRYMKETTFAELISLDWPDFDAPIEEFMSQPEKLLFIIDGFEEIIISESRSESLDDGSPCTDWYQELPVTKILHSLLKKELVPLATLLITIKTWFVRDLKASLVNPCFVQITGFTGDDLRVYFMRHFDDSSEVEKILQQLRKNETLFHSCSAPMVCWTVCSCLKQPKVRYYDLQSITQTTTSLYAYFFSNLFSTAEVDLADDSWPGQWRALCSLAIEGLWSMNFTFNKEDTEIEGLEVPFIDSLYEFNILQKINDCGGCTTFTHLSFQEFFAAMSFVLEEPREFPPHSTKPQEMKMLLQHVLLDKEAYWTPVVLFFFGLLNKNIARELEDTLHCKISPRVMEELLKWGEELGKAESASLQFHILRLFHCLHESQEEDFTKKMLGRIFEVDLNILEDEELQASSFCLKHCKRLNKLRLSVSSHILERDLEILETSKFDSRMHAWNSICSTLVTNENLHELDLSNSKLHASSVKGLCLALKNPRCKVQKLTCKSVTPEWVLQDLIIALQGNSKLTHLNFSSNKLGMTVPLILKALRHSACNLKYLCLEKCNLSAASCQDLALFLTSIQHVTRLCLGFNRLQDDGIKLLCAALTHPKCALERLELWFCQLAAPACKHLSDALLQNRSLTHLNLSKNSLRDEGVKFLCEALGRPDGNLQSLNLSGCSFTREGCGELANALSHNHNVKILDLGENDLQDDGVKLLCEALKPHRALHTLGLAKCNLTTACCQHLFSVLSSSKSLVNLNLLGNELDTDGVKMLCKALKKSTCRLQKLG

SEQ ID NO: 57245 - protein, 1036 aa, Homo sapiens
  Payload ID: 11253
  Gene Symbol: NLRP13
  Gene Name: NLR family, pyrin domain containing 13
  ENSP ID: ENSP00000467899
MNFSVITCPNGGTNQGLLPYLMALDQYQLEEFKLCLEPQQLMDFWSAPQGHFPRIPWANLRAADPLNLSFLLDEHFPKGQAWKVVLGIFQTMNLTSLCEKVRAEMKENVQTQELQDPTQEDLEMLEAAAGNMQTQGCQDPNQEELDELEEETGNVQAQGCQDPNQEEPEMLEEADHRRKYRENMKAELLETWDNISWPKDHVYIRNTSKDEHEELQRLLDPNRTRAQAQTIVLVGRAGVGKTTLAMQAMLHWANGVLFQQRFSYVFYLSCHKIRYMKETTFAELISLDWPDFDAPIEEFMSQPEKLLFIIDGFEEIIISESRSESLDDGSPCTDWYQELPVTKILHSLLKKELVPLATLLITIKTWFVRDLKASLVNPCFVQITGFTGDDLRVYFMRHFDDSSEVEKILQQLRKNETLFHSCSAPMVCWTVCSCLKQPKVRYYDLQSITQTTTSLYAYFFSNLFSTAEVDLADDSWPGQWRALCSLAIEGLWSMNFTFNKEDTEIEGLEVPFIDSLYEFNILQKINDCGGCTTFTHLSFQEFFAAMSFVLEEPREFPPHSTKPQEMKMLLQHVLLDKEAYWTPVVLFFFGLLNKNIARELEDTLHCKISPRVMEELLKWGEELGKAESASLQFHILRLFHCLHESQEEDFTKKMLGRIFEVDLNILEDEELQASSFCLKHCKRLNKLRLSVSSHILERDLEILETSKFDSRMHAWNSICSTLVTNENLHELDLSNSKLHASSVKGLCLALKNPRCKVQKLTCKSVTPEWVLQDLIIALQGNSKLTHLNFSSNKLGMTVPLILKALRHSACNLKYLCLEKCNLSAASCQDLALFLTSIQHVTRLCLGFNRLQDDGIKLLCAALTHPKCALERLELWFCQLAAPACKHLSDALLQNRSLTHLNLSKNSLRDEGVKFLCEALGRPDGNLQSLNLSGCSFTREGCGELANALSHNHNVKILDLGENDLQDDGVKLLCEALKPHRALHTLGLAKCNLTTACCQHLFSVLSSSKSLVNLNLLGNELDTDGVKMLCFKKTCTM

SEQ ID NO: 57246 - protein, 1093 aa, Homo sapiens
  Payload ID: 11254
  Gene Symbol: NLRP14
  Gene Name: NLR family, pyrin domain containing 14
  Uniprot ID: Q86W24
  ENSP ID: ENSP00000299481
MADSSSSSFFPDFGLLLYLEELNKEELNTFKLFLKETMEPEHGLTPWNEVKKARREDLANLMKKYYPGEKAWSVSLKIFGKMNLKDLCERAKEEINWSAQTIGPDDAKAGETQEDQEAVLGDGTEYRNRIKEKFCITWDKKSLAGKPEDFHHGIAEKDRKLLEHLFDVDVKTGAQPQIVVLQGAAGVGKTTLVRKAMLDWAEGSLYQQRFKYVFYLNGREINQLKERSFAQLISKDWPSTEGPIEEIMYQPSSLLFIIDSFDELNFAFEEPEFALCEDWTQEHPVSFLMSSLLRKVMLPEASLLVTTRLTTSKRLKQLLKNHHYVELLGMSEDAREEYIYQFFEDKRWAMKVFSSLKSNEMLFSMCQVPLVCWAACTCLKQQMEKGGDVTLTCQTTTALFTCYISSLFTPVDGGSPSLPNQAQLRRLCQVAAKGIWTMTYVFYRENLRRLGLTQSDVSSFMDSNIIQKDAEYENCYVFTHLHVQEFFAAMFYMLKGSWEAGNPSCQPFEDLKSLLQSTSYKDPHLTQMKCFLFGLLNEDRVKQLERTFNCKMSLKIKSKLLQCMEVLGNSDYSPSQLGFLELFHCLYETQDKAFISQAMRCFPKVAINICEKIHLLVSSFCLKHCRCLRTIRLSVTVVFEKKILKTSLPTNTWDGDRITHCWQDLCSVLHTNEHLRELDLYHSNLDKSAMNILHHELRHPNCKLQKLLLKFITFPDGCQDISTSLIHNKNLMHLDLKGSDIGDNGVKSLCEALKHPECKLQTLRLESCNLTVFCCLNISNALIRSQSLIFLNLSTNNLLDDGVQLLCEALRHPKCYLERLSLESCGLTEAGCEYLSLALISNKRLTHLCLADNVLGDGGVKLMSDALQHAQCTLKSLVLRRCHFTSLSSEYLSTSLLHNKSLTHLDLGSNWLQDNGVKLLCDVFRHPSCNLQDLELMGCVLTNACCLDLASVILNNPNLRSLDLGNNDLQDDGVKILCDALRYPNCNIQRLGLEYCGLTSLCCQDLSSALICNKRLIKMNLTQNTLGYEGIVKLYKVLKSPKCKLQVLGLCKEAFDEEAQKLLEAVGVSNPHLIIKPDCNYHNEEDVSWWWCF

SEQ ID NO: 57247 - protein, 1059 aa, Homo sapiens
  Payload ID: 11255
  Gene Symbol: NLRP2
  Gene Name: NLR family, pyrin domain containing 2
  ENSP ID: ENSP00000263437
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQETKGNVICLGKEVFKGKKPDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHTWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLVLWNCDITSDGCCDLTKLLQEKSSLLCLDLGLNHIGVKGMKFLCEALRKPLCNLRCLWLWGCSIPPFSCEDLCSALSCNQSLVTLDLGQNPLGSSGVKMLFETLTCSSGTLRTLRLKIDDFNDELNKLLEEIEEKNPQLIIDTEKHHPWAERPSSHDFMI

SEQ ID NO: 57248 - protein, 1040 aa, Homo sapiens
  Payload ID: 11255
  Gene Symbol: NLRP2
  Gene Name: NLR family, pyrin domain containing 2
  Uniprot ID: Q9NX02
  ENSP ID: ENSP00000344074
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHTWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLVLWNCDITSDGCCDLTKLLQEKSSLLCLDLGLNHIGVKGMKFLCEALRKPLCNLRCLWLWGCSIPPFSCEDLCSALSCNQSLVTLDLGQNPLGSSGVKMLFETLTCSSGTLRTLRLKIDDFNDELNKLLEEIEEKNPQLIIDTEKHHPWAERPSSHDFMI

SEQ ID NO: 57249 - protein, 1038 aa, Homo sapiens
  Payload ID: 11255
  Gene Symbol: NLRP2
  Gene Name: NLR family, pyrin domain containing 2
  Uniprot ID: Q9NX02
  ENSP ID: ENSP00000375601
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLAFTETKGNVICLGKEVFKGKKPDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHTWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLVLWNCDITSDGCCDLTKLLQEKSSLLCLDLGLNHIGVKGMKFLCEALRKPLCNLRCLWLWGCSIPPFSCEDLCSALSCNQSLVTLDLGQNPLGSSGVKMLFETLTCSSGTLRTLRLKIDDFNDELNKLLEEIEEKNPQLIIDTEKHHPWAERPSSHDFMI

SEQ ID NO: 57250 - protein, 1039 aa, Homo sapiens
  Payload ID: 11255
  Gene Symbol: NLRP2
  Gene Name: NLR family, pyrin domain containing 2
  Uniprot ID: Q9NX02
  ENSP ID: ENSP00000402474
MVSSAQMGFNLQALLEQLSQDELSKFKYLITTFSLAHELQKIPHKEMASLQVFEKMHRMDLSERAKDEVREAALKSFNKRKPLSLGITRKERPPLDVDEMLERFKTEAQAFTETKGNVICLGKEVFKGKKPDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHTWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLVLWNCDITSDGCCDLTKLLQEKSSLLCLDLGLNHIGVKGMKFLCEALRKPLCNLRCLWLWGCSIPPFSCEDLCSALSCNQSLVTLDLGQNPLGSSGVKMLFETLTCSSGTLRTLRLKIDDFNDELNKLLEEIEEKNPQLIIDTEKHHPWAERPSSHDFMI

SEQ ID NO: 57251 - protein, 1062 aa, Homo sapiens
  Payload ID: 11255
  Gene Symbol: NLRP2
  Gene Name: NLR family, pyrin domain containing 2
  Uniprot ID: Q9NX02
  ENSP ID: ENSP00000409370
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQAFTETKGNVICLGKEVFKGKKPDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHTWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLVLWNCDITSDGCCDLTKLLQEKSSLLCLDLGLNHIGVKGMKFLCEALRKPLCNLRCLWLWGCSIPPFSCEDLCSALSCNQSLVTLDLGQNPLGSSGVKMLFETLTCSSGTLRTLRLKIDDFNDELNKLLEEIEEKNPQLIIDTEKHHPWAERPSSHDFMI

SEQ ID NO: 57252 - protein, 1040 aa, Homo sapiens; identical to SEQ ID NO: 57248
  Payload ID: 11255
  Gene Symbol: NLRP2
  Gene Name: NLR family, pyrin domain containing 2
  Uniprot ID: Q9NX02
  ENSP ID: ENSP00000440601

SEQ ID NO: 57253 - protein, 165 aa, Homo sapiens
  Payload ID: 11255
  Gene Symbol: NLRP2
  Gene Name: NLR family, pyrin domain containing 2
  ENSP ID: ENSP00000441363
MLAIKRYKQPSAVAHACNPNTLGGREAALKSFNKRKPLSLGITRKERPPLDVDEMLERFKTEAQAFTETKGNVICLGKEVFKGKKPDKDNRCRYILKTKFREMWKSWPGDSKEVQVMAERYKMLIPFSNPRVLPGPFSYTVVLYGPAGLGKTTLAQKLMLDWAED

SEQ ID NO: 57254 - protein, 109 aa, Homo sapiens
  Payload ID: 11255
  Gene Symbol: NLRP2
  Gene Name: NLR family, pyrin domain containing 2
  ENSP ID: ENSP00000442351
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLG

SEQ ID NO: 57255 - protein, 154 aa, Homo sapiens
  Payload ID: 11255
  Gene Symbol: NLRP2
  Gene Name: NLR family, pyrin domain containing 2
  ENSP ID: ENSP00000443519
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQAFTETKGNVICLGKEVFKGKKP

SEQ ID NO: 57256 - protein, 1062 aa, Homo sapiens; identical to SEQ ID NO: 57251
  Payload ID: 11255
  Gene Symbol: NLRP2
  Gene Name: NLR family, pyrin domain containing 2
  Uniprot ID: Q9NX02
  ENSP ID: ENSP00000445135

SEQ ID NO: 57257 - protein, 88 aa, Homo sapiens
  Payload ID: 11255
  Gene Symbol: NLRP2
  Gene Name: NLR family, pyrin domain containing 2
  ENSP ID: ENSP00000445846
GHKTVTYLTLQGNDQDDMFPALCEVLRHPECNLRYLGLVSCSATTQQWADLSLALEVNQSLTAAVLSIWGHRRAMVMPDLAVWNLSLM

SEQ ID NO: 57258 - protein, 124 aa, Homo sapiens
  Payload ID: 11255
  Gene Symbol: NLRP2
  Gene Name: NLR family, pyrin domain containing 2
  ENSP ID: ENSP00000465069
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEML

SEQ ID NO: 57259 - protein, 140 aa, Homo sapiens
  Payload ID: 11255
  Gene Symbol: NLRP2
  Gene Name: NLR family, pyrin domain containing 2
  ENSP ID: ENSP00000466260
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQAFTETKGN

SEQ ID NO: 57260 - protein, 197 aa, Homo sapiens
  Payload ID: 11255
  Gene Symbol: NLRP2
  Gene Name: NLR family, pyrin domain containing 2
  ENSP ID: ENSP00000466537
  MOD_RES (1)..(1): Any amino acid
XSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGYIS

SEQ ID NO: 57261 - protein, 135 aa, Homo sapiens
  Payload ID: 11255
  Gene Symbol: NLRP2
  Gene Name: NLR family, pyrin domain containing 2
  ENSP ID: ENSP00000467349
MASLQVFEKMHRMDLSERAKDEVREAALKSFNKRKPLSLGITRKERPPLDVDEMLERFKTEAQAFTETKGNVICLGKEVFKGKKPDKDNRCRYILKTKFREMWKSWPGDSKEVQVMAERYKMLIPFSNPRVLPGP

SEQ ID NO: 57262 - protein, 9 aa, Homo sapiens
  Payload ID: 11255
  Gene Symbol: NLRP2
  Gene Name: NLR family, pyrin domain containing 2
  ENSP ID: ENSP00000469973
  MOD_RES (1)..(1): Any amino acid
XECNLRYLG

SEQ ID NO: 57263 - protein, 1040 aa, Homo sapiens; identical to SEQ ID NO: 57248
  Payload ID: 11255
  Gene Symbol: NLRP2
  Gene Name: NLR family, pyrin domain containing 2
  Uniprot ID: Q9NX02
  ENSP ID: ENSP00000477726

SEQ ID NO: 57264 - protein, 879 aa, Homo sapiens
  Payload ID: 11255
  Gene Symbol: NLRP2
  Gene Name: NLR family, pyrin domain containing 2
  ENSP ID: ENSP00000477745
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLAFTETKGNVICLGKEVFKGKKPDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHAWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLV

SEQ ID NO: 57265 - protein, 1040 aa, Homo sapiens
  Payload ID: 11255
  Gene Symbol: NLRP2
  Gene Name: NLR family, pyrin domain containing 2
  ENSP ID: ENSP00000478111
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHAWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLVLWNCDITSDGCCDLTKLLQEKSSLLCLDLGLNHIGVKGMKFLCEALRKPLCNLRCLWLWGCSIPPFSCEDLCSALSCNQSLVTLDLGQNPLGSSGVKMLFETLTCSSGTLRTLRLKIDDFNDELNKLLEEIEEKNPQLIIDTEKHHPWAERPSSHDFMI

SEQ ID NO: 57266 - protein, 1062 aa, Homo sapiens; identical to SEQ ID NO: 57251
  Payload ID: 11255
  Gene Symbol: NLRP2
  Gene Name: NLR family, pyrin domain containing 2
  Uniprot ID: Q9NX02
  ENSP ID: ENSP00000478265

SEQ ID NO: 57267 - protein, 1039 aa, Homo sapiens; identical to SEQ ID NO: 57250
  Payload ID: 11255
  Gene Symbol: NLRP2
  Gene Name: NLR family, pyrin domain containing 2
  Uniprot ID: Q9NX02
  ENSP ID: ENSP00000478318

SEQ ID NO: 57268 - protein, 1062 aa, Homo sapiens; identical to SEQ ID NO: 57251
  Payload ID: 11255
  Gene Symbol: NLRP2
  Gene Name: NLR family, pyrin domain containing 2
  ENSP ID: ENSP00000478450

SEQ ID NO: 57269 - protein, 154 aa, Homo sapiens; identical to SEQ ID NO: 57255
  Payload ID: 11255
  Gene Symbol: NLRP2
  Gene Name: NLR family, pyrin domain containing 2
  ENSP ID: ENSP00000478559

SEQ ID NO: 57270 - protein, 1062 aa, Homo sapiens; identical to SEQ ID NO: 57251
  Payload ID: 11255
  Gene Symbol: NLRP2
  Gene Name: NLR family, pyrin domain containing 2
  Uniprot ID: Q9NX02
  ENSP ID: ENSP00000478774

SEQ ID NO: 57271 - protein, 1040 aa, Homo sapiens; identical to SEQ ID NO: 57248
  Payload ID: 11255
  Gene Symbol: NLRP2
  Gene Name: NLR family, pyrin domain containing 2
  Uniprot ID: Q9NX02
  ENSP ID: ENSP00000478787

SEQ ID NO: 57272 - protein, 1062 aa, Homo sapiens; identical to SEQ ID NO: 57251
  Payload ID: 11255
  Gene Symbol: NLRP2
  Gene Name: NLR family, pyrin domain containing 2
  Uniprot ID: Q9NX02
  ENSP ID: ENSP00000478876

SEQ ID NO: 57273 - protein, 1062 aa, Homo sapiens; identical to SEQ ID NO: 57251
  Payload ID: 11255
  Gene Symbol: NLRP2
  Gene Name: NLR family, pyrin domain containing 2
  ENSP ID: ENSP00000479109

SEQ ID NO: 57274 - protein, 1039 aa, Homo sapiens
  Payload ID: 11255
  Gene Symbol: NLRP2
  Gene Name: NLR family, pyrin domain containing 2
  ENSP ID: ENSP00000479218
MVSSAQMGFNLQALLEQLSQDELSKFKYLITTFSLAHELQKIPHKEMASLQVFEKMHRMDLSERAKDEVREAALKSFNKRKPLSLGITRKERPPLDVDEMLERFKTEAQAFTETKGNVICLGKEVFKGKKPDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHAWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLVLWNCDITSDGCCDLTKLLQEKSSLLCLDLGLNHIGVKGMKFLCEALRKPLCNLRCLWLWGCSIPPFSCEDLCSALSCNQSLVTLDLGQNPLGSSGVKMLFETLTCSSGTLRTLRLKIDDFNDELNKLLEEIEEKNPQLIIDTEKHHPWAERPSSHDFMI

SEQ ID NO: 57275 - protein, 1062 aa, Homo sapiens; identical to SEQ ID NO: 57251
  Payload ID: 11255
  Gene Symbol: NLRP2
  Gene Name: NLR family, pyrin domain containing 2
  ENSP ID: ENSP00000479220

SEQ ID NO: 57276 - protein, 1062 aa, Homo sapiens; identical to SEQ ID NO: 57251
  Payload ID: 11255
  Gene Symbol: NLRP2
  Gene Name: NLR family, pyrin domain containing 2
  ENSP ID: ENSP00000479352

SEQ ID NO: 57277 - protein, 1059 aa, Homo sapiens; identical to SEQ ID NO: 57247
  Payload ID: 11255
  Gene Symbol: NLRP2
  Gene Name: NLR family, pyrin domain containing 2
  ENSP ID: ENSP00000479677

SEQ ID NO: 57278 - protein, 1062 aa, Homo sapiens; identical to SEQ ID NO: 57251
  Payload ID: 11255
  Gene Symbol: NLRP2
  Gene Name: NLR family, pyrin domain containing 2
  ENSP ID: ENSP00000479713

SEQ ID NO: 57279 - protein, 1062 aa, Homo sapiens; identical to SEQ ID NO: 57251
  Payload ID: 11255
  Gene Symbol: NLRP2
  Gene Name: NLR family, pyrin domain containing 2
  ENSP ID: ENSP00000479783

SEQ ID NO: 57280 - protein, 903 aa, Homo sapiens
  Payload ID: 11255
  Gene Symbol: NLRP2
  Gene Name: NLR family, pyrin domain containing 2
  ENSP ID: ENSP00000481095
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQAFTETKGNVICLGKEVFKGKKPDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHAWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLV

SEQ ID NO: 57281 - protein, 165 aa, Homo sapiens; identical to SEQ ID NO: 57253
  Payload ID: 11255
  Gene Symbol: NLRP2
  Gene Name: NLR family, pyrin domain containing 2
  ENSP ID: ENSP00000481255

SEQ ID NO: 57282 - protein, 1040 aa, Homo sapiens; identical to SEQ ID NO: 57248
  Payload ID: 11255
  Gene Symbol: NLRP2
  Gene Name: NLR family, pyrin domain containing 2
  Uniprot ID: Q9NX02
  ENSP ID: ENSP00000481564

SEQ ID NO: 57283 - protein, 1062 aa, Homo sapiens; identical to SEQ ID NO: 57251
  Payload ID: 11255
  Gene Symbol: NLRP2
  Gene Name: NLR family, pyrin domain containing 2
  ENSP ID: ENSP00000481851

SEQ ID NO: 57284 - protein, 1040 aa, Homo sapiens; identical to SEQ ID NO: 57248
  Payload ID: 11255
  Gene Symbol: NLRP2
  Gene Name: NLR family, pyrin domain containing 2
  ENSP ID: ENSP00000481999

SEQ ID NO: 57285 - protein, 1040 aa, Homo sapiens; identical to SEQ ID NO: 57248
  Payload ID: 11255
  Gene Symbol: NLRP2
  Gene Name: NLR family, pyrin domain containing 2
  ENSP ID: ENSP00000482044

SEQ ID NO: 57286 - protein, 1039 aa, Homo sapiens; identical to SEQ ID NO: 57250
  Payload ID: 11255
  Gene Symbol: NLRP2
  Gene Name: NLR family, pyrin domain containing 2
  ENSP ID: ENSP00000482065

SEQ ID NO: 57287 - protein, 1062 aa, Homo sapiens; identical to SEQ ID NO: 57251
  Payload ID: 11255
  Gene Symbol: NLRP2
  Gene Name: NLR family, pyrin domain containing 2
  Uniprot ID: Q9NX02
  ENSP ID: ENSP00000482253

SEQ ID NO: 57288 - protein, 1039 aa, Homo sapiens; identical to SEQ ID NO: 57250
  Payload ID: 11255
  Gene Symbol: NLRP2
  Gene Name: NLR family, pyrin domain containing 2
  ENSP ID: ENSP00000482309

SEQ ID NO: 57289 - protein, 124 aa, Homo sapiens; identical to SEQ ID NO: 57258
  Payload ID: 11255
  Gene Symbol: NLRP2
  Gene Name: NLR family, pyrin domain containing 2
  ENSP ID: ENSP00000482327

SEQ ID NO: 57290 - protein, 1039 aa, Homo sapiens; identical to SEQ ID NO: 57250
  Payload ID: 11255
  Gene Symbol: NLRP2
  Gene Name: NLR family, pyrin domain containing 2
  ENSP ID: ENSP00000482355

SEQ ID NO: 57291 - protein, 1039 aa, Homo sapiens; identical to SEQ ID NO: 57250
  Payload ID: 11255
  Gene Symbol: NLRP2
  Gene Name: NLR family, pyrin domain containing 2
  ENSP ID: ENSP00000482465

SEQ ID NO: 57292 - protein, 1039 aa, Homo sapiens; identical to SEQ ID NO: 57250
  Payload ID: 11255
  Gene Symbol: NLRP2
  Gene Name: NLR family, pyrin domain containing 2
  Uniprot ID: Q9NX02
  ENSP ID: ENSP00000482628

SEQ ID NO: 57293 - protein, 1040 aa, Homo sapiens; identical to SEQ ID NO: 57248
  Payload ID: 11255
  Gene Symbol: NLRP2
  Gene Name: NLR family, pyrin domain containing 2
  ENSP ID: ENSP00000482727

SEQ ID NO: 57294 - protein, 881 aa, Homo sapiens
  Payload ID: 11255
  Gene Symbol: NLRP2
  Gene Name: NLR family, pyrin domain containing 2
  ENSP ID: ENSP00000482817
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHAWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLV

SEQ ID NO: 57295 - protein, 1062 aa, Homo sapiens; identical to SEQ ID NO: 57251
  Payload ID: 11255
  Gene Symbol: NLRP2
  Gene Name: NLR family, pyrin domain containing 2
  Uniprot ID: Q9NX02
  ENSP ID: ENSP00000482889

SEQ ID NO: 57296 - protein, 1062 aa, Homo sapiens; identical to SEQ ID NO: 57251
  Payload ID: 11255
  Gene Symbol: NLRP2
  Gene Name: NLR family, pyrin domain containing 2
  Uniprot ID: Q9NX02
  ENSP ID: ENSP00000483281

SEQ ID NO: 57297 - protein, 197 aa, Homo sapiens; identical to SEQ ID NO: 57260
  Payload ID: 11255
  Gene Symbol: NLRP2
  Gene Name: NLR family, pyrin domain containing 2
  ENSP ID: ENSP00000483306
  MOD_RES (1)..(1): Any amino acid

SEQ ID NO: 57298 - protein, 846 aa, Homo sapiens
  Payload ID: 11255
  Gene Symbol: NLRP2
  Gene Name: NLR family, pyrin domain containing 2
  ENSP ID: ENSP00000483318
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQAFTETKGNVICLGKEVFKGKKPDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHAWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLS

SEQ ID NO: 57299 - protein, 140 aa, Homo sapiens; identical to SEQ ID NO: 57259
  Payload ID: 11255
  Gene Symbol: NLRP2
  Gene Name: NLR family, pyrin domain containing 2
  ENSP ID: ENSP00000483361

SEQ ID NO: 57300 - protein, 1040 aa, Homo sapiens; identical to SEQ ID NO: 57248
  Payload ID: 11255
  Gene Symbol: NLRP2
  Gene Name: NLR family, pyrin domain containing 2
  ENSP ID: ENSP00000483389

SEQ ID NO: 57301 - protein, 1062 aa, Homo sapiens; identical to SEQ ID NO: 57251
  Payload ID: 11255
  Gene Symbol: NLRP2
  Gene Name: NLR family, pyrin domain containing 2
  ENSP ID: ENSP00000483528

SEQ ID NO: 57302 - protein, 109 aa, Homo sapiens; identical to SEQ ID NO: 57254
  Payload ID: 11255
  Gene Symbol: NLRP2
  Gene Name: NLR family, pyrin domain containing 2
  ENSP ID: ENSP00000483772

SEQ ID NO: 57303 - protein, 1040 aa, Homo sapiens; identical to SEQ ID NO: 57248
  Payload ID: 11255
  Gene Symbol: NLRP2
  Gene Name: NLR family, pyrin domain containing 2
  ENSP ID: ENSP00000483886

SEQ ID NO: 57304 - protein, 1062 aa, Homo sapiens; identical to SEQ ID NO: 57251
  Payload ID: 11255
  Gene Symbol: NLRP2
  Gene Name: NLR family, pyrin domain containing 2
  ENSP ID: ENSP00000483963

SEQ ID NO: 57305 - protein, 1062 aa, Homo sapiens
  Payload ID: 11255
  Gene Symbol: NLRP2
  Gene Name: NLR family, pyrin domain containing 2
  ENSP ID: ENSP00000484080
MVSSAQMGFNLQALLEQLSQDELSKFKYLITTFSLAHELQKIPHKEVDKADGKQLVEILTTHCDSYWVEMASLQVFEKMHRMDLSERAKDEVREAALKSFNKRKPLSLGITRKERPPLDVDEMLERFKTEAQAFTETKGNVICLGKEVFKGKKPDKDNRCRYILKTKFREMWKSWPGDSKEVQVMAERYKMLIPFSNPRVLPGPFSYTVVLYGPAGLGKTTLAQKLMLDWAEDNLIHKFKYAFYLSCRELSRLGPCSFAELVFRDWPELQDDIPHILAQARKILFVIDGFDELGAAPGALIEDICGDWEKKKPVPVLLGSLLNRVMLPKAALLVTTRPRALRDLRILAEEPIYIRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQTSVLHREDLERLGVQESDLRLFLDGDILRQDRVSKGCYSFIHLSFQQFLTALFYTLEKEEEEDRDGHAWDIGDVQKLLSGVERLRNPDLIQAGYYSFGLANEKRAKELEATFGCRMSPDIKQELLRCDISCKGGHSTVTDLQELLGCLYESQEEELVKEVMAQFKEISLHLNAVDVVPSSFCVKHCRNLQKMSLQVIKENLPENVTASESDAEVERSQDDQHMLPFWTDLCSIFGSNKDLMGLAINDSFLSASLVRILCEQIASDTCHLQRVVFKNISPADAHRNLCLALRGHKTVTYLTLQGNDQDDMFPALCEVLRHPECNLRYLGLVSCSATTQQWADLSLALEVNQSLTCVNLSDNELLDEGAKLLYTTLRHPKCFLQRLSLENCHLTEANCKDLAAVLVVSRELTHLCLAKNPIGNTGVKFLCEGLRYPECKLQTLVLWNCDITSDGCCDLTKLLQEKSSLLCLDLGLNHIGVKGMKFLCEALRKPLCNLRCLWLWGCSIPPFSCEDLCSALSCNQSLVTLDLGQNPLGSSGVKMLFETLTCSSGTLRTLRLKIDDFNDELNKLLEEIEEKNPQLIIDTEKHHPWAERPSSHDFMI

SEQ ID NO: 57306 - protein, 1039 aa, Homo sapiens; identical to SEQ ID NO: 57250
  Payload ID: 11255
  Gene Symbol: NLRP2
  Gene Name: NLR family, pyrin domain containing 2
  ENSP ID: ENSP00000484150

SEQ ID NO: 57307 - protein, 1040 aa, Homo sapiens; identical to SEQ ID NO: 57248
  Payload ID: 11255
  Gene Symbol: NLRP2
  Gene Name: NLR family, pyrin domain containing 2
  Uniprot ID: Q9NX02
  ENSP ID: ENSP00000484351

SEQ ID NO: 57308 - protein, 1062 aa, Homo sapiens; identical to SEQ ID NO: 57251
  Payload ID: 11255
  Gene Symbol: NLRP2
  Gene Name: NLR family, pyrin domain containing 2
  ENSP ID: ENSP00000484354

SEQ ID NO: 57309 - protein, 1038 aa, Homo sapiens; identical to SEQ ID NO: 57249
  Payload ID: 11255
  Gene Symbol: NLRP2
  Gene Name: NLR family, pyrin domain containing 2
  Uniprot ID: Q9NX02
  ENSP ID: ENSP00000484382

SEQ ID NO: 57310 - protein, 9 aa, Homo sapiens
  Payload ID: 11255
  Gene Symbol: NLRP2
  Gene Name: NLR family, pyrin domain containing 2
  ENSP ID: ENSP00000484627
  MOD_RES (1)..(1): Any amino acid
XECNLRYLG

SEQ ID NO: 57311 - protein, 1039 aa, Homo sapiens; identical to SEQ ID NO: 57250
  Payload ID: 11255
  Gene Symbol: NLRP2
  Gene Name: NLR family, pyrin domain containing 2
  Uniprot ID: Q9NX02
  ENSP ID: ENSP00000484759

SEQ ID NO: 57312 - protein, 135 aa, Homo sapiens; identical to SEQ ID NO: 57261
  Payload ID: 11255
  Gene Symbol: NLRP2
  Gene Name: NLR family, pyrin domain containing 2
  ENSP ID: ENSP00000484846

SEQ ID NO: 57313 - protein, 88 aa, Homo sapiens; identical to SEQ ID NO: 57257
  Payload ID: 11255
  Gene Symbol: NLRP2
  Gene Name: NLR family, pyrin domain containing 2
  ENSP ID: ENSP00000484848

SEQ ID NO: 57314 - protein, 45 aa, Homo sapiens
  Payload ID: 11256
  Gene Symbol: NLRP2P
  Gene Name: NLR family, pyrin domain containing 2 pseudogene
  Uniprot ID: P0DMW2
  ENSP ID: ENSP00000488995
MVSSAQLDFNLQALLGQLSQDDLCKFKSLIRTVSLGNELQKIPQT

SEQ ID NO: 57315 - protein, 922 aa, Homo sapiens
  Payload ID: 11257
  Gene Symbol: NLRP3
  Gene Name: NLR family, pyrin domain containing 3
  Uniprot ID: Q96P20
  ENSP ID: ENSP00000294752
MKMASTRCKLARYLEDLEDVDLKKFKMHLEDYPPQKGCIPLPRGQTEKADHVDLATLMIDFNGEEKAWAMAVWIFAAINRRDLYEKAKRDEPKWGSDNARVSNPTVICQEDSIEEEWMGLLEYLSRISICKMKKDYRKKYRKYVRSRFQCIEDRNARLGESVSLNKRYTRLRLIKEHRSQQEREQELLAIGKTKTCESPVSPIKMELLFDPDDEHSEPVHTVVFQGAAGIGKTILARKMMLDWASGTLYQDRFDYLFYIHCREVSLVTQRSLGDLIMSCCPDPNPPIHKIVRKPSRILFLMDGFDELQGAFDEHIGPLCTDWQKAERGDILLSSLIRKKLLPEASLLITTRPVALEKLQHLLDHPRHVEILGFSEAKRKEYFFKYFSDEAQARAAFSLIQENEVLFTMCFIPLVCWIVCTGLKQQMESGKSLAQTSKTTTAVYVFFLSSLLQPRGGSQEHGLCAHLWGLCSLAADGIWNQKILFEESDLRNHGLQKADVSAFLRMNLFQKEVDCEKFYSFIHMTFQEFFAAMYYLLEEEKEGRTNVPGSRLKLPSRDVTVLLENYGKFEKGYLIFVVRFLFGLVNQERTSYLEKKLSCKISQQIRLELLKWIEVKAKAKKLQIQPSQLELFYCLYEMQEEDFVQRAMDYFPKIEINLSTRMDHMVSSFCIENCHRVESLSLGFLHNMPKEEEEEEKEGRHLDMVQCVLPSSSHAACSHGLGRCGLSHECCFDISLVLSSNQKLVELDLSDNALGDFGIRLLCVGLKHLLCNLKKLWLVNSGLTSVCCSALSSVLSTNQNLTHLYLRGNTLGDKGIKLLCEGLLHPDCKLQVLELDNCNLTSHCCWDLSTLLTSSQSLRKLSLGNNDLGDLGVMMFCEVLKQQSCLLQNLGLSEMYFNYETKSALETLQEEKPELTVVFEPSW

SEQ ID NO: 57316 - protein, 1036 aa, Homo sapiens
  Payload ID: 11257
  Gene Symbol: NLRP3
  Gene Name: NLR family, pyrin domain containing 3
  Uniprot ID: Q96P20
  ENSP ID: ENSP00000337383
MKMASTRCKLARYLEDLEDVDLKKFKMHLEDYPPQKGCIPLPRGQTEKADHVDLATLMIDFNGEEKAWAMAVWIFAAINRRDLYEKAKRDEPKWGSDNARVSNPTVICQEDSIEEEWMGLLEYLSRISICKMKKDYRKKYRKYVRSRFQCIEDRNARLGESVSLNKRYTRLRLIKEHRSQQEREQELLAIGKTKTCESPVSPIKMELLFDPDDEHSEPVHTVVFQGAAGIGKTILARKMMLDWASGTLYQDRFDYLFYIHCREVSLVTQRSLGDLIMSCCPDPNPPIHKIVRKPSRILFLMDGFDELQGAFDEHIGPLCTDWQKAERGDILLSSLIRKKLLPEASLLITTRPVALEKLQHLLDHPRHVEILGFSEAKRKEYFFKYFSDEAQARAAFSLIQENEVLFTMCFIPLVCWIVCTGLKQQMESGKSLAQTSKTTTAVYVFFLSSLLQPRGGSQEHGLCAHLWGLCSLAADGIWNQKILFEESDLRNHGLQKADVSAFLRMNLFQKEVDCEKFYSFIHMTFQEFFAAMYYLLEEEKEGRTNVPGSRLKLPSRDVTVLLENYGKFEKGYLIFVVRFLFGLVNQERTSYLEKKLSCKISQQIRLELLKWIEVKAKAKKLQIQPSQLELFYCLYEMQEEDFVQRAMDYFPKIEINLSTRMDHMVSSFCIENCHRVESLSLGFLHNMPKEEEEEEKEGRHLDMVQCVLPSSSHAACSHGLVNSHLTSSFCRGLFSVLSTSQSLTELDLSDNSLGDPGMRVLCETLQHPGCNIRRLWLGRCGLSHECCFDISLVLSSNQKLVELDLSDNALGDFGIRLLCVGLKHLLCNLKKLWLVSCCLTSACCQDLASVLSTSHSLTRLYVGENALGDSGVAILCEKAKNPQCNLQKLGLVNSGLTSVCCSALSSVLSTNQNLTHLYLRGNTLGDKGIKLLCEGLLHPDCKLQVLELDNCNLTSHCCWDLSTLLTSSQSLRKLSLGNNDLGDLGVMMFCEVLKQQSCLLQNLGLSEMYFNYETKSALETLQEEKPELTVVFEPSW

SEQ ID NO: 57317 - protein, 979 aa, Homo sapiens
  Payload ID: 11257
  Gene Symbol: NLRP3
  Gene Name: NLR family, pyrin domain containing 3
  Uniprot ID: Q96P20
  ENSP ID: ENSP00000355452
MKMASTRCKLARYLEDLEDVDLKKFKMHLEDYPPQKGCIPLPRGQTEKADHVDLATLMIDFNGEEKAWAMAVWIFAAINRRDLYEKAKRDEPKWGSDNARVSNPTVICQEDSIEEEWMGLLEYLSRISICKMKKDYRKKYRKYVRSRFQCIEDRNARLGESVSLNKRYTRLRLIKEHRSQQEREQELLAIGKTKTCESPVSPIKMELLFDPDDEHSEPVHTVVFQGAAGIGKTILARKMMLDWASGTLYQDRFDYLFYIHCREVSLVTQRSLGDLIMSCCPDPNPPIHKIVRKPSRILFLMDGFDELQGAFDEHIGPLCTDWQKAERGDILLSSLIRKKLLPEASLLITTRPVALEKLQHLLDHPRHVEILGFSEAKRKEYFFKYFSDEAQARAAFSLIQENEVLFTMCFIPLVCWIVCTGLKQQMESGKSLAQTSKTTTAVYVFFLSSLLQPRGGSQEHGLCAHLWGLCSLAADGIWNQKILFEESDLRNHGLQKADVSAFLRMNLFQKEVDCEKFYSFIHMTFQEFFAAMYYLLEEEKEGRTNVPGSRLKLPSRDVTVLLENYGKFEKGYLIFVVRFLFGLVNQERTSYLEKKLSCKISQQIRLELLKWIEVKAKAKKLQIQPSQLELFYCLYEMQEEDFVQRAMDYFPKIEINLSTRMDHMVSSFCIENCHRVESLSLGFLHNMPKEEEEEEKEGRHLDMVQCVLPSSSHAACSHGLVNSHLTSSFCRGLFSVLSTSQSLTELDLSDNSLGDPGMRVLCETLQHPGCNIRRLWLGRCGLSHECCFDISLVLSSNQKLVELDLSDNALGDFGIRLLCVGLKHLLCNLKKLWLVNSGLTSVCCSALSSVLSTNQNLTHLYLRGNTLGDKGIKLLCEGLLHPDCKLQVLELDNCNLTSHCCWDLSTLLTSSQSLRKLSLGNNDLGDLGVMMFCEVLKQQSCLLQNLGLSEMYFNYETKSALETLQEEKPELTVVFEPSW

SEQ ID NO: 57318 - protein, 979 aa, Homo sapiens; identical to SEQ ID NO: 57317
  Payload ID: 11257
  Gene Symbol: NLRP3
  Gene Name: NLR family, pyrin domain containing 3
  Uniprot ID: Q96P20
  ENSP ID: ENSP00000355453

SEQ ID NO: 57319 - protein, 979 aa, Homo sapiens
  Payload ID: 11257
  Gene Symbol: NLRP3
  Gene Name: NLR family, pyrin domain containing 3
  Uniprot ID: Q96P20
  ENSP ID: ENSP00000375703
MKMASTRCKLARYLEDLEDVDLKKFKMHLEDYPPQKGCIPLPRGQTEKADHVDLATLMIDFNGEEKAWAMAVWIFAAINRRDLYEKAKRDEPKWGSDNARVSNPTVICQEDSIEEEWMGLLEYLSRISICKMKKDYRKKYRKYVRSRFQCIEDRNARLGESVSLNKRYTRLRLIKEHRSQQEREQELLAIGKTKTCESPVSPIKMELLFDPDDEHSEPVHTVVFQGAAGIGKTILARKMMLDWASGTLYQDRFDYLFYIHCREVSLVTQRSLGDLIMSCCPDPNPPIHKIVRKPSRILFLMDGFDELQGAFDEHIGPLCTDWQKAERGDILLSSLIRKKLLPEASLLITTRPVALEKLQHLLDHPRHVEILGFSEAKRKEYFFKYFSDEAQARAAFSLIQENEVLFTMCFIPLVCWIVCTGLKQQMESGKSLAQTSKTTTAVYVFFLSSLLQPRGGSQEHGLCAHLWGLCSLAADGIWNQKILFEESDLRNHGLQKADVSAFLRMNLFQKEVDCEKFYSFIHMTFQEFFAAMYYLLEEEKEGRTNVPGSRLKLPSRDVTVLLENYGKFEKGYLIFVVRFLFGLVNQERTSYLEKKLSCKISQQIRLELLKWIEVKAKAKKLQIQPSQLELFYCLYEMQEEDFVQRAMDYFPKIEINLSTRMDHMVSSFCIENCHRVESLSLGFLHNMPKEEEEEEKEGRHLDMVQCVLPSSSHAACSHGLGRCGLSHECCFDISLVLSSNQKLVELDLSDNALGDFGIRLLCVGLKHLLCNLKKLWLVSCCLTSACCQDLASVLSTSHSLTRLYVGENALGDSGVAILCEKAKNPQCNLQKLGLVNSGLTSVCCSALSSVLSTNQNLTHLYLRGNTLGDKGIKLLCEGLLHPDCKLQVLELDNCNLTSHCCWDLSTLLTSSQSLRKLSLGNNDLGDLGVMMFCEVLKQQSCLLQNLGLSEMYFNYETKSALETLQEEKPELTVVFEPSW

SEQ ID NO: 57320 - protein, 1036 aa, Homo sapiens; identical to SEQ ID NO: 57316
  Payload ID: 11257
  Gene Symbol: NLRP3
  Gene Name: NLR family, pyrin domain containing 3
  Uniprot ID: Q96P20
  ENSP ID: ENSP00000375704

SEQ ID NO: 57321 - protein, 994 aa, Homo sapiens
  Payload ID: 11258
  Gene Symbol: NLRP4
  Gene Name: NLR family, pyrin domain containing 4
  Uniprot ID: Q96MN2
  ENSP ID: ENSP00000301295
MAASFFSDFGLMWYLEELKKEEFRKFKEHLKQMTLQLELKQIPWTEVKKASREELANLLIKHYEEQQAWNITLRIFQKMDRKDLCMKVMRERTGYTKTYQAHAKQKFSRLWSSKSVTEIHLYFEEEVKQEECDHLDRLFAPKEAGKQPRTVIIQGPQGIGKTTLLMKLMMAWSDNKIFRDRFLYTFYFCCRELRELPPTSLADLISREWPDPAAPITEIVSQPERLLFVIDSFEELQGGLNEPDSDLCGDLMEKRPVQVLLSSLLRKKMLPEASLLIAIKPVCPKELRDQVTISEIYQPRGFNESDRLVYFCCFFKDPKRAMEAFNLVRESEQLFSICQIPLLCWILCTSLKQEMQKGKDLALTCQSTTSVYSSFVFNLFTPEGAEGPTPQTQHQLKALCSLAAEGMWTDTFEFCEDDLRRNGVVDADIPALLGTKILLKYGERESSYVFLHVCIQEFCAALFYLLKSHLDHPHPAVRCVQELLVANFEKARRAHWIFLGCFLTGLLNKKEQEKLDAFFGFQLSQEIKQQIHQCLKSLGERGNPQGQVDSLAIFYCLFEMQDPAFVKQAVNLLQEANFHIIDNVDLVVSAYCLKYCSSLRKLCFSVQNVFKKEDEHSSTSDYSLICWHHICSVLTTSGHLRELQVQDSTLSESTFVTWCNQLRHPSCRLQKLGINNVSFSGQSVLLFEVLFYQPDLKYLSFTLTKLSRDDIRSLCDALNYPAGNVKELALVNCHLSPIDCEVLAGLLTNNKKLTYLNVSCNQLDTGVPLLCEALCSPDTVLVYLMLAFCHLSEQCCEYISEMLLRNKSVRYLDLSANVLKDEGLKTLCEALKHPDCCLDSLCLVKCFITAAGCEDLASALISNQNLKILQIGCNEIGDVGVQLLCRALTHTDCRLEILGLEECGLTSTCCKDLASVLTCSKTLQQLNLTLNTLDHTGVVVLCEALRHPECALQVLGLRKTDFDEETQALLTAEEERNPNLTITDDCDTITRVEI

SEQ ID NO: 57322 - protein, 919 aa, Homo sapiens
  Payload ID: 11258
  Gene Symbol: NLRP4
  Gene Name: NLR family, pyrin domain containing 4
  Uniprot ID: Q96MN2
  ENSP ID: ENSP00000465463
MQECLTLWVFSPLALTDSGYTKTYQAHAKQKFSRLWSSKSVTEIHLYFEEEVKQEECDHLDRLFAPKEAGKQPRTVIIQGPQGIGKTTLLMKLMMAWSDNKIFRDRFLYTFYFCCRELRELPPTSLADLISREWPDPAAPITEIVSQPERLLFVIDSFEELQGGLNEPDSDLCGDLMEKRPVQVLLSSLLRKKMLPEASLLIAIKPVCPKELRDQVTISEIYQPRGFNESDRLVYFCCFFKDPKRAMEAFNLVRESEQLFSICQIPLLCWILCTSLKQEMQKGKDLALTCQSTTSVYSSFVFNLFTPEGAEGPTPQTQHQLKALCSLAAEGMWTDTFEFCEDDLRRNGVVDADIPALLGTKILLKYGERESSYVFLHVCIQEFCAALFYLLKSHLDHPHPAVRCVQELLVANFEKARRAHWIFLGCFLTGLLNKKEQEKLDAFFGFQLSQEIKQQIHQCLKSLGERGNPQGQVDSLAIFYCLFEMQDPAFVKQAVNLLQEANFHIIDNVDLVVSAYCLKYCSSLRKLCFSVQNVFKKEDEHSSTSDYSLICWHHICSVLTTSGHLRELQVQDSTLSESTFVTWCNQLRHPSCRLQKLGINNVSFSGQSVLLFEVLFYQPDLKYLSFTLTKLSRDDIRSLCDALNYPAGNVKELALVNCHLSPIDCEVLAGLLTNNKKLTYLNVSCNQLDTGVPLLCEALCSPDTVLVYLMLAFCHLSEQCCEYISEMLLRNKSVRYLDLSANVLKDEGLKTLCEALKHPDCCLDSLCLVKCFITAAGCEDLASALISNQNLKILQIGCNEIGDVGVQLLCRALTHTDCRLEILGLEECGLTSTCCKDLASVLTCSKTLQQLNLTLNTLDHTGVVVLCEALRHPECALQVLGLRKTDFDEETQALLTAEEERNPNLTITDDCDTITRVEI

SEQ ID NO: 57323 - protein, 155 aa, Homo sapiens
  Payload ID: 11258
  Gene Symbol: NLRP4
  Gene Name: NLR family, pyrin domain containing 4
  ENSP ID: ENSP00000468496
MAASFFSDFGLMWYLEELKKEEFRKFKEHLKQMTLQLELKQIPWTEVKKASREELANLLIKHYEEQQAWNITLRIFQKMDRKDLCMKVMRERTGYTKTYQAHAKQKFSRLWSSKSVTEIHLYFEEEVKQEECDHLDRLFAPKEAGKQPRTVIIQG

SEQ ID NO: 57324 - protein, 504 aa, Homo sapiens
  Payload ID: 11258
  Gene Symbol: NLRP4
  Gene Name: NLR family, pyrin domain containing 4
  ENSP ID: ENSP00000468754
  MOD_RES (1)..(1): Any amino acid
XKILLKYGERESSYVFLHVCIQEFCAALFYLLKSHLDHPHPAVRCVQELLVANFEKARRAHWIFLGCFLTGLLNKKEQEKLDAFFGFQLSQEIKQQIHQCLKSLGERGNPQGQVDSLAIFYCLFEMQDPAFVKQAVNLLQEANFHIIDNVDLVVSAYCLKYCSSLRKLCFSVQNVFKKEDEHSSTSDYSLICWHHICSVLTTSGHLRELQVQDSTLSESTFVTWCNQLRHPSCRLQKLGINNVSFSGQSVLLFEVLFYQPDLKYLSFTLTKLSRDDIRSLCDALNYPAGNVKELALAFCHLSEQCCEYISEMLLRNKSVRYLDLSANVLKDEGLKTLCEALKHPDCCLDSLCLVKCFITAAGCEDLASALISNQNLKILQIGCNEIGDVGVQLLCRALTHTDCRLEILGLEECGLTSTCCKDLASVLTCSKTLQQLNLTLNTLDHTGVVVLCEALRHPECALQVLGLRKTDFDEETQALLTAEEERNPNLTITDDCDTITRVEI

SEQ ID NO: 57325 - protein, 1200 aa, Homo sapiens
  Payload ID: 11259
  Gene Symbol: NLRP5
  Gene Name: NLR family, pyrin domain containing 5
  Uniprot ID: P59047
  ENSP ID: ENSP00000375063
MKVAGGLELGAAALLSASPRALVTLSTGPTCSILPKNPLFPQNLSSQPCIKMEGDKSLTFSSYGLQWCLYELDKEEFQTFKELLKKKSSESTTCSIPQFEIENANVECLALLLHEYYGASLAWATSISIFENMNLRTLSEKARDDMKRHSPEDPEATMTDQGPSKEKVPGISQAVQQDSATAAETKEQEISQAMEQEGATAAETEEQEISQAMEQEGATAAETEEQGHGGDTWDYKSHVMTKFAEEEDVRRSFENTAADWPEMQTLAGAFDSDRWGFRPRTVVLHGKSGIGKSALARRIVLCWAQGGLYQGMFSYVFFLPVREMQRKKESSVTEFISREWPDSQAPVTEIMSRPERLLFIIDGFDDLGSVLNNDTKLCKDWAEKQPPFTLIRSLLRKVLLPESFLIVTVRDVGTEKLKSEVVSPRYLLVRGISGEQRIHLLLERGIGEHQKTQGLRAIMNNRELLDQCQVPAVGSLICVALQLQDVVGESVAPFNQTLTGLHAAFVFHQLTPRGVVRRCLNLEERVVLKRFCRMAVEGVWNRKSVFDGDDLMVQGLGESELRALFHMNILLPDSHCEEYYTFFHLSLQDFCAALYYVLEGLEIEPALCPLYVEKTKRSMELKQAGFHIHSLWMKRFLFGLVSEDVRRPLEVLLGCPVPLGVKQKLLHWVSLLGQQPNATTPGDTLDAFHCLFETQDKEFVRLALNSFQEVWLPINQNLDLIASSFCLQHCPYLRKIRVDVKGIFPRDESAEACPVVPLWMRDKTLIEEQWEDFCSMLGTHPHLRQLDLGSSILTERAMKTLCAKLRHPTCKIQTLMFRNAQITPGVQHLWRIVMANRNLRSLNLGGTHLKEEDVRMACEALKHPKCLLESLRLDCCGLTHACYLKISQILTTSPSLKSLSLAGNKVTDQGVMPLSDALRVSQCALQKLILEDCGITATGCQSLASALVSNRSLTHLCLSNNSLGNEGVNLLCRSMRLPHCSLQRLMLNQCHLDTAGCGFLALALMGNSWLTHLSLSMNPVEDNGVKLLCEVMREPSCHLQDLELVKCHLTAACCESLSCVISRSRHLKSLDLTDNALGDGGVAALCEGLKQKNSVLARLGLKACGLTSDCCEALSLALSCNRHLTSLNLVQNNFSPKGMMKLCSAFACPTSNLQIIGLWKWQYPVQIRKLLEEVQLLKPRVVIDGSWHSFDEDDRYWWKN

SEQ ID NO: 57326 - protein, 178 aa, Homo sapiens
  Payload ID: 11259
  Gene Symbol: NLRP5
  Gene Name: NLR family, pyrin domain containing 5
  ENSP ID: ENSP00000471494
GPTCSILPKNPLFPQNLSSQPCIKMEGDKSLTFSSYGLQWCLYELDKEEFQTFKELLKKKSSESTTCSIPQFEIENANVECLALLLHEYYGASLAWATSISIFENMNLRTLSEKARDDMKRHSPEDPEATMTDQGPSKEKVPGISQAVQQDSATAAETKEQESFAVLLRLQCSGYPQA

SEQ ID NO: 57327 - protein, 1200 aa, Homo sapiens
  Payload ID: 11259
  Gene Symbol: NLRP5
  Gene Name: NLR family, pyrin domain containing 5
  ENSP ID: ENSP00000481137
MKVAGGLELGAAALLSASPRALVTLSTGPTCSILPKNPLFPQNLSSQPCIKMEGDKSLTFSSYGLQWCLYELDKEEFQTFKELLKKKSSESTTCSIPQFEIENANVECLALLLHEYYGASLAWATSISIFENMNLRTLSEKARDDMKRHSPEDPEATMTDQGPSKEKVPDISDSNNKHKYVGIHSSFAEISQAMEQEGATAAETEEQEISQAMEQEGATAAETEEQGHGGDTWDYKSHVMTKFAEEEDVRRSFENTAADWPEMQTLAGAFDSDRWGFRPRTVVLHGKSGIGKSALARRIVLCWAQGGLYQGMFSYVFFLPVREMQRKKESSVTEFISREWPDSQAPVTEIMSRPERLLFIIDGFDDLGSVLNNDTKLCKDWAEKQPPFTLIRSLLRKVLLPESFLIVTVRDVGTEKLKSEVVSPRYLLVRGISGEQRIHLLLERGIGEHQKTQGLRAIMNNRELLDQCQVPAVGSLICVALQLQDVVGESVAPFNQTLTGLHAAFVFHQLTPRGVVRRCLNLEERVVLKRFCRMAVEGVWNRKSVFDGDDLMVQGLGESELRALFHMNILLPDSHCEEYYTFFHLSLQDFCAALYYVLEGLEIEPALCPLYVEKTKRSMELKQAGFHIHSLWMKRFLFGLVSEDVRRPLEVLLGCPVPLGVKQKLLHWVSLLGQQPNATTPGDTLDAFHCLFETQDKEFVRLALNSFQEVWLPINQNLDLIASSFCLQHCPYLRKIRVDVKGIFPRDESAEACPVVPLWMRDKTLIEEQWEDFCSMLGTHPHLRQLDLGSSILTERAMKTLCAKLRHPTCKIQTLMFRNAQITPGVQHLWRIVMANRNLRSLNLGGTHLKEEDVRMACEALKHPKCLLESLRLDCCGLTHACYLKISQILTTSPSLKSLSLAGNKVTDQGVMPLSDALRVSQCALQKLILEDCGITATGCQSLASALVSNRSLTHLCLSNNSLGNEGVNLLCRSMRLPHCSLQRLMLNQCHLDTAGCGFLALALMGNSWLTHLSLSMNPVEDNGVKLLCEVMREPSCHLQDLELVKCHLTAACCESLSCVISRSRHLKSLDLTDNALGDGGVAALCEGLKQKNSVLARLGLKACGLTSDCCEALSLALSCNRHLTSLNLVQNNFSPKGMMKLCSAFACPTSNLQIIGLWKWQYPVQIRKLLEEVQLLKPRVVIDGSWHSFDEDDRYWWKN

SEQ ID NO: 57328 - protein, 892 aa, Homo sapiens
  Payload ID: 11260
  Gene Symbol: NLRP6
  Gene Name: NLR family, pyrin domain containing 6
  Uniprot ID: P59044
  ENSP ID: ENSP00000309767
MDQPEAPCSSTGPRLAVARELLLAALEELSQEQLKRFRHKLRDVGPDGRSIPWGRLERADAVDLAEQLAQFYGPEPALEVARKTLKRADARDVAAQLQERRLQRLGLGSGTLLSVSEYKKKYREHVLQLHARVKERNARSVKITKRFTKLLIAPESAAPEEAMGPAEEPEPGRARRSDTHTFNRLFRRDEEGRRPLTVVLQGPAGIGKTMAAKKILYDWAAGKLYQGQVDFAFFMPCGELLERPGTRSLADLILDQCPDRGAPVPQMLAQPQRLLFILDGADELPALGGPEAAPCTDPFEAASGARVLGGLLSKALLPTALLLVTTRAAAPGRLQGRLCSPQCAEVRGFSDKDKKKYFYKYFRDERRAERAYRFVKENETLFALCFVPFVCWIVCTVLRQQLELGRDLSRTSKTTTSVYLLFITSVLSSAPVADGPRLQGDLRNLCRLAREGVLGRRAQFAEKELEQLELRGSKVQTLFLSKKELPGVLETEVTYQFIDQSFQEFLAALSYLLEDGGVPRTAAGGVGTLLRGDAQPHSHLVLTTRFLFGLLSAERMRDIERHFGCMVSERVKQEALRWVQGQGQGCPGVAPEVTEGAKGLEDTEEPEEEEEGEEPNYPLELLYCLYETQEDAFVRQALCRFPELALQRVRFCRMDVAVLSYCVRCCPAGQALRLISCRLVAAQEKKKKSLGKRLQASLGGGSSSQGTTKQLPASLLHPLFQAMTDPLCHLSSLTLSHCKLPDAVCRDLSEALRAAPALTELGLLHNRLSEAGLRMLSEGLAWPQCRVQTVRVQLPDPQRGLQYLVGMLRQSPALTTLDLSGCQLPAPMVTYLCAVLQHQGCGLQTLSLASVELSEQSLQELQAVKRAKPDLVITHPALDGHPQPPKELISTF

SEQ ID NO: 57329 - protein, 891 aa, Homo sapiens
  Payload ID: 11260
  Gene Symbol: NLRP6
  Gene Name: NLR family, pyrin domain containing 6
  Uniprot ID: P59044
  ENSP ID: ENSP00000433617
MDQPEAPCSSTGPRLAVARELLLAALEELSQEQLKRFRHKLRDVGPDGRSIPWGRLERADAVDLAEQLAQFYGPEPALEVARKTLKRADARDVAAQLQERRLQRLGLGSGTLLSVSEYKKKYREHVLQLHARVKERNARSVKITKRFTKLLIAPESAAPEEAMGPAEEPEPGRARRSDTHTFNRLFRRDEEGRRPLTVVLQGPAGIGKTMAAKKILYDWAAGKLYQGQVDFAFFMPCGELLERPGTRSLADLILDQCPDRGAPVPQMLAQPQRLLFILDGADELPALGGPEAAPCTDPFEAASGARVLGGLLSKALLPTALLLVTTRAAAPGRLQGRLCSPQCAEVRGFSDKDKKKYFYKYFRDERRAERAYRFVKENETLFALCFVPFVCWIVCTVLRQQLELGRDLSRTSKTTTSVYLLFITSVLSSAPVADGPRLQGDLRNLCRLAREGVLGRRAQFAEKELEQLELRGSKVQTLFLSKKELPGVLETEVTYQFIDQSFQEFLAALSYLLEDGGVPRTAAGGVGTLLRGDAQPHSHLVLTTRFLFGLLSAERMRDIERHFGCMVSERVKQEALRWVQGQGQGCPGVAPEVTEGAKGLEDTEEPEEEEEGEEPNYPLELLYCLYETQEDAFVRQALCRFPELALQRVRFCRMDVAVLSYCVRCCPAGQALRLISCRLVAAQEKKKKSLGKRLQASLGGGSSQGTTKQLPASLLHPLFQAMTDPLCHLSSLTLSHCKLPDAVCRDLSEALRAAPALTELGLLHNRLSEAGLRMLSEGLAWPQCRVQTVRVQLPDPQRGLQYLVGMLRQSPALTTLDLSGCQLPAPMVTYLCAVLQHQGCGLQTLSLASVELSEQSLQELQAVKRAKPDLVITHPALDGHPQPPKELISTF

SEQ ID NO: 57330 - protein, 1009 aa, Homo sapiens
  Payload ID: 11261
  Gene Symbol: NLRP7
  Gene Name: NLR family, pyrin domain containing 7
  Uniprot ID: Q8WX94
  ENSP ID: ENSP00000329568
MTSPQLEWTLQTLLEQLNEDELKSFKSLLWAFPLEDVLQKTPWSEVEEADGKKLAEILVNTSSENWIRNATVNILEEMNLTELCKMAKAEMMEDGQVQEIDNPELGDAEEDSELAKPGEKEGWRNSMEKQSLVWKNTFWQGDIDNFHDDVTLRNQRFIPFLNPRTPRKLTPYTVVLHGPAGVGKTTLAKKCMLDWTDCNLSPTLRYAFYLSCKELSRMGPCSFAELISKDWPELQDDIPSILAQAQRILFVVDGLDELKVPPGALIQDICGDWEKKKPVPVLLGSLLKRKMLPRAALLVTTRPRALRDLQLLAQQPIYVRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQMSVFHREDLERLGVQESDLRLFLDGDILRQDRVSKGCYSFIHLSFQQFLTALFYALEKEEGEDRDGHAWDIGDVQKLLSGEERLKNPDLIQVGHFLFGLANEKRAKELEATFGCRMSPDIKQELLQCKAHLHANKPLSVTDLKEVLGCLYESQEEELAKVVVAPFKEISIHLTNTSEVMHCSFSLKHCQDLQKLSLQVAKGVFLENYMDFELDIEFESSNSNLKFLEVKQSFLSDSSVRILCDHVTRSTCHLQKVEIKNVTPDTAYRDFCLAFIGKKTLTHLTLAGHIEWERTMMLMLCDLLRNHKCNLQYLRLGGHCATPEQWAEFFYVLKANQSLKHLRLSANVLLDEGAMLLYKTMTRPKHFLQMLSLENCRLTEASCKDLAAVLVVSKKLTHLCLAKNPIGDTGVKFLCEGLSYPDCKLQTLVLQQCSITKLGCRYLSEALQEACSLTNLDLSINQIARGLWILCQALENPNCNLKHLRLWSCSLMPFYCQHLGSALLSNQKLETLDLGQNHLWKSGIIKLFGVLRQRTGSLKILRLKTYETNLEIKKLLEEVKEKNPKLTIDCNASGATAPPCCDFFC

SEQ ID NO: 57331 - protein, 980 aa, Homo sapiens
  Payload ID: 11261
  Gene Symbol: NLRP7
  Gene Name: NLR family, pyrin domain containing 7
  Uniprot ID: Q8WX94
  ENSP ID: ENSP00000339491
MTSPQLEWTLQTLLEQLNEDELKSFKSLLWAFPLEDVLQKTPWSEVEEADGKKLAEILVNTSSENWIRNATVNILEEMNLTELCKMAKAEMMEDGQVQEIDNPELGDAEEDSELAKPGEKEGWRNSMEKQSLVWKNTFWQGDIDNFHDDVTLRNQRFIPFLNPRTPRKLTPYTVVLHGPAGVGKTTLAKKCMLDWTDCNLSPTLRYAFYLSCKELSRMGPCSFAELISKDWPELQDDIPSILAQAQRILFVVDGLDELKVPPGALIQDICGDWEKKKPVPVLLGSLLKRKMLPRAALLVTTRPRALRDLQLLAQQPIYVRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQMSVFHREDLERLGVQESDLRLFLDGDILRQDRVSKGCYSFIHLSFQQFLTALFYALEKEEGEDRDGHAWDIGDVQKLLSGEERLKNPDLIQVGHFLFGLANEKRAKELEATFGCRMSPDIKQELLQCKAHLHANKPLSVTDLKEVLGCLYESQEEELAKVVVAPFKEISIHLTNTSEVMHCSFSLKHCQDLQKLSLQVAKGVFLENYMDFELDIEFERCTYLTIPNWARQDLRSLRLWTDFCSLFSSNSNLKFLEVKQSFLSDSSVRILCDHVTRSTCHLQKVEIKNVTPDTAYRDFCLAFIGKKTLTHLTLAGHIEWERTMMLMLCDLLRNHKCNLQYLRLGGHCATPEQWAEFFYVLKANQSLKHLRLSANVLLDEGAMLLYKTMTRPKHFLQMLSLENCRLTEASCKDLAAVLVVSKKLTHLCLAKNPIGDTGVKFLCEGLSYPDCKLQTLVLQQCSITKLGCRYLSEALQEACSLTNLDLSINQIARGLWILCQALENPNCNLKHLRLKTYETNLEIKKLLEEVKEKNPKLTIDCNASGATAPPCCDFFC

SEQ ID NO: 57332 - protein, 980 aa, Homo sapiens; identical to SEQ ID NO: 57331
  Payload ID: 11261
  Gene Symbol: NLRP7
  Gene Name: NLR family, pyrin domain containing 7
  Uniprot ID: Q8WX94
  ENSP ID: ENSP00000465520

SEQ ID NO: 57333 - protein, 1037 aa, Homo sapiens
  Payload ID: 11261
  Gene Symbol: NLRP7
  Gene Name: NLR family, pyrin domain containing 7
  Uniprot ID: Q8WX94
  ENSP ID: ENSP00000467123
MTSPQLEWTLQTLLEQLNEDELKSFKSLLWAFPLEDVLQKTPWSEVEEADGKKLAEILVNTSSENWIRNATVNILEEMNLTELCKMAKAEMMEDGQVQEIDNPELGDAEEDSELAKPGEKEGWRNSMEKQSLVWKNTFWQGDIDNFHDDVTLRNQRFIPFLNPRTPRKLTPYTVVLHGPAGVGKTTLAKKCMLDWTDCNLSPTLRYAFYLSCKELSRMGPCSFAELISKDWPELQDDIPSILAQAQRILFVVDGLDELKVPPGALIQDICGDWEKKKPVPVLLGSLLKRKMLPRAALLVTTRPRALRDLQLLAQQPIYVRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQMSVFHREDLERLGVQESDLRLFLDGDILRQDRVSKGCYSFIHLSFQQFLTALFYALEKEEGEDRDGHAWDIGDVQKLLSGEERLKNPDLIQVGHFLFGLANEKRAKELEATFGCRMSPDIKQELLQCKAHLHANKPLSVTDLKEVLGCLYESQEEELAKVVVAPFKEISIHLTNTSEVMHCSFSLKHCQDLQKLSLQVAKGVFLENYMDFELDIEFERCTYLTIPNWARQDLRSLRLWTDFCSLFSSNSNLKFLEVKQSFLSDSSVRILCDHVTRSTCHLQKVEIKNVTPDTAYRDFCLAFIGKKTLTHLTLAGHIEWERTMMLMLCDLLRNHKCNLQYLRLGGHCATPEQWAEFFYVLKANQSLKHLRLSANVLLDEGAMLLYKTMTRPKHFLQMLSLENCRLTEASCKDLAAVLVVSKKLTHLCLAKNPIGDTGVKFLCEGLSYPDCKLQTLVLQQCSITKLGCRYLSEALQEACSLTNLDLSINQIARGLWILCQALENPNCNLKHLRLWSCSLMPFYCQHLGSALLSNQKLETLDLGQNHLWKSGIIKLFGVLRQRTGSLKILRLKTYETNLEIKKLLEEVKEKNPKLTIDCNASGATAPPCCDFFC

SEQ ID NO: 57334 - protein, 70 aa, Homo sapiens
  Payload ID: 11261
  Gene Symbol: NLRP7
  Gene Name: NLR family, pyrin domain containing 7
  ENSP ID: ENSP00000467234
MTSPQLEWTLQTLLEQLNEDELKSFKSLLWAFPLEDVLQKTPWSEVEEADGKKLAEILVNTSSENWIRNA

SEQ ID NO: 57335 - protein, 53 aa, Homo sapiens
  Payload ID: 11261
  Gene Symbol: NLRP7
  Gene Name: NLR family, pyrin domain containing 7
  ENSP ID: ENSP00000467589
MTSPQLEWTLQTLLEQLNEDELKSFKSLLWAFPLEDVLQKTPWSEVEEADGKK

SEQ ID NO: 57336 - protein, 96 aa, Homo sapiens
  Payload ID: 11261
  Gene Symbol: NLRP7
  Gene Name: NLR family, pyrin domain containing 7
  ENSP ID: ENSP00000468161
MTSPQLEWTLQTLLEQLNEDELKSFKSLLWAFPLEDVLQKTPWSEVEEADGKKLAEILVNTSSENWIRNATVNILEEMNLTELCKMAKAEMMEDGQ

SEQ ID NO: 57337 - protein, 963 aa, Homo sapiens
  Payload ID: 11261
  Gene Symbol: NLRP7
  Gene Name: NLR family, pyrin domain containing 7
  ENSP ID: ENSP00000468243
MTSPQLEWTLQTLLEQLNEDELKSFKSLLWAFPLEDVLQKTPWSEVEEADGKKLAEILVNTSSENWIRNATVNILEEMNLTELCKMAKAEMMEDGQVQEIDNPELGDAEEDSELAKPGEKEGWRNSMEKQSLVWKNTFWQGDIDNFHDDVTLRNQRFIPFLNPRTPRKLTPYTVVLHGPAGVGKTTLAKKCMLDWTDCNLSPTLRYAFYLSCKELSRMGPCSFAELISKDWPELQDDIPSILAQAQRILFVVDGLDELKVPPGALIQDICGDWEKKKPVPVLLGSLLKRKMLPRAALLVTTRPRALRDLQLLAQQPIYVRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQMSVFHREDLERLGVQESDLRLFLDGDILRQDRVSKGCYSFIHLSFQQFLTALFYALEKEEGEDRDGHAWDIGDVQKLLSGEERLKNPDLIQVGHFLFGLANEKRAKELEATFGCRMSPDIKQELLQCKAHLHANKPLSVTDLKEVLGCLYESQEEELAKVVVAPFKEISIHLTNTSEVMHCSFSLKHCQDLQKLSLQVAKGVFLENYMDFELDIEFERCTYLTIPNWARQDLRSLRLWTDFCSLFSSNSNLKFLEVKQSFLSDSSVRILCDHVTRSTCHLQKVEIKNVTPDTAYRDFCLAFIGKKTLTHLTLAGHIEWERTMMLMLCDLLRNHKCNLQYLRLGGHCATPEQWAEFFYVLKANQSLKHLRLSANVLLDEGAMLLYKTMTRPKHFLQMLSLENCRLTEASCKDLAAVLVVSKKLTHLCLAKNPIGDTGVKFLCEGLSYPDCKLQTLVLQQCSITKLGCRYLSEALQEACSLTNLDLSINQIARGLWILCQALENPNCNLKHLRILDLLSSAIRSLKLWTWARIICGRVA

SEQ ID NO: 57338 - protein, 1037 aa, Homo sapiens; identical to SEQ ID NO: 57333
  Payload ID: 11261
  Gene Symbol: NLRP7
  Gene Name: NLR family, pyrin domain containing 7
  Uniprot ID: Q8WX94
  ENSP ID: ENSP00000468706

SEQ ID NO: 57339 - protein, 935 aa, Homo sapiens
  Payload ID: 11261
  Gene Symbol: NLRP7
  Gene Name: NLR family, pyrin domain containing 7
  ENSP ID: ENSP00000478429
MTSPQLEWTLQTLLEQLNEDELKSFKSLLWAFPLEDVLQKTPWSEVEEADGKKLAEILVNTSSENWIRNATVNILEEMNLTELCKMAKAEMMEDGQVQEIDNPELGDAEEDSELAKPGEKEGWRNSMEKQSLVWKNTFWQGDIDNFHDDVTLRNQRFIPFLNPRTPRKLTPYTVVLHGPAGVGKTTLAKKCMLDWTDCNLSPTLRYAFYLSCKELSRMGPCSFAELISKDWPELQDDIPSILAQAQRILFVVDGLDELKVPPGALIQDICGDWEKKKPVPVLLGSLLKRKMLPRAALLVTTRPRALRDLQLLAQQPIYVRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQMSVFHREDLERLGVQESDLRLFLDGDILRQDRVSKGCYSFIHLSFQQFLTALFYTLEKEEGEDRDGHAWDIGDVQKLLSGEERLKNPDLIQVGHFLFGLANEKRAKELEATFGCRMSPDIKQELLQCKAHLHANKPLSVTDLKEVLGCLYESQEEELAKVVVAPFKEISIHLTNTSEVMHCSFSLKHCQDLQKLSLQVAKGVFLENYMDFELDIEFESSNSNLKFLEVKQSFLSDSSVRILCDHVTRSTCHLQKVEIKNVTPDTAYRDFCLAFIGKKTLTHLTLAGHIEWERTMMLMLCDLLRNHKCNLQYLRLGGHCATPEQWAEFFYVLKANQSLKHLRLSANVLLDEGAMLLYKTMTRPKHFLQMLSLENCRLTEASCKDLAAVLVVSKKLTHLCLAKNPIGDTGVKFLCEGLSYPDCKLQTLVLQQCSITKLGCRYLSEALQEACSLTNLDLSINQIARGLWILCQALENPNCNLKHLRILDLLSSAIRSLKLWTWARIICGRVA

SEQ ID NO: 57340 - protein, 157 aa, Homo sapiens
  Payload ID: 11261
  Gene Symbol: NLRP7
  Gene Name: NLR family, pyrin domain containing 7
  ENSP ID: ENSP00000478621
  MOD_RES (1)..(1): Any amino acid
XLQQCSITKLGCRYLSEALQEACSLTNLDLSINQIARGLWILCQALENPNCNLKHLRLWSCSLMPFYCQHLGSALLSNQKLETLDLGQNHLWKSGIIKLFGVLRQRTGSLKILRLKTYETNLEIKKLLEEVKEKNPKLTIDCNASGATAPPCCDFFC

SEQ ID NO: 57341 - protein, 980 aa, Homo sapiens; identical to SEQ ID NO: 57331
  Payload ID: 11261
  Gene Symbol: NLRP7
  Gene Name: NLR family, pyrin domain containing 7
  Uniprot ID: Q8WX94
  ENSP ID: ENSP00000478726

SEQ ID NO: 57342 - protein, 70 aa, Homo sapiens; identical to SEQ ID NO: 57334
  Payload ID: 11261
  Gene Symbol: NLRP7
  Gene Name: NLR family, pyrin domain containing 7
  ENSP ID: ENSP00000478753

SEQ ID NO: 57343 - protein, 980 aa, Homo sapiens
  Payload ID: 11261
  Gene Symbol: NLRP7
  Gene Name: NLR family, pyrin domain containing 7
  ENSP ID: ENSP00000478889
MTSPQLEWTLQTLLEQLNEDELKSFKSLLWAFPLEDVLQKTPWSEVEEADGKKLAEILVNTSSENWIRNATVNILEEMNLTELCKMAKAEMMEDGQVQEIDNPELGDAEEDSELAKPGEKEGWRNSMEKQSLVWKNTFWQGDIDNFHDDVTLRNQRFIPFLNPRTPRKLTPYTVVLHGPAGVGKTTLAKKCMLDWTDCNLSPTLRYAFYLSCKELSRMGPCSFAELISKDWPELQDDIPSILAQAQRILFVVDGLDELKVPPGALIQDICGDWEKKKPVPVLLGSLLKRKMLPRAALLVTTRPRALRDLQLLAQQPIYVRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQMSVFHREDLERLGVQESDLRLFLDGDILRQDRVSKGCYSFIHLSFQQFLTALFYTLEKEEGEDRDGHAWDIGDVQKLLSGEERLKNPDLIQVGHFLFGLANEKRAKELEATFGCRMSPDIKQELLQCKAHLHANKPLSVTDLKEVLGCLYESQEEELAKVVVAPFKEISIHLTNTSEVMHCSFSLKHCQDLQKLSLQVAKGVFLENYMDFELDIEFERCTYLTIPNWARQDLRSLRLWTDFCSLFSSNSNLKFLEVKQSFLSDSSVRILCDHVTRSTCHLQKVEIKNVTPDTAYRDFCLAFIGKKTLTHLTLAGHIEWERTMMLMLCDLLRNHKCNLQYLRLGGHCATPEQWAEFFYVLKANQSLKHLRLSANVLLDEGAMLLYKTMTRPKHFLQMLSLENCRLTEASCKDLAAVLVVSKKLTHLCLAKNPIGDTGVKFLCEGLSYPDCKLQTLVLQQCSITKLGCRYLSEALQEACSLTNLDLSINQIARGLWILCQALENPNCNLKHLRLKTYETNLEIKKLLEEVKEKNPKLTIDCNASGATAPPCCDFFC

SEQ ID NO: 57344 - protein, 1009 aa, Homo sapiens; identical to SEQ ID NO: 57330
  Payload ID: 11261
  Gene Symbol: NLRP7
  Gene Name: NLR family, pyrin domain containing 7
  Uniprot ID: Q8WX94
  ENSP ID: ENSP00000478890

SEQ ID NO: 57345 - protein, 1037 aa, Homo sapiens; identical to SEQ ID NO: 57333
  Payload ID: 11261
  Gene Symbol: NLRP7
  Gene Name: NLR family, pyrin domain containing 7
  ENSP ID: ENSP00000479459

SEQ ID NO: 57346 - protein, 980 aa, Homo sapiens; identical to SEQ ID NO: 57331
  Payload ID: 11261
  Gene Symbol: NLRP7
  Gene Name: NLR family, pyrin domain containing 7
  Uniprot ID: Q8WX94
  ENSP ID: ENSP00000479541

SEQ ID NO: 57347 - protein, 96 aa, Homo sapiens; identical to SEQ ID NO: 57336
  Payload ID: 11261
  Gene Symbol: NLRP7
  Gene Name: NLR family, pyrin domain containing 7
  ENSP ID: ENSP00000479859

SEQ ID NO: 57348 - protein, 980 aa, Homo sapiens; identical to SEQ ID NO: 57331
  Payload ID: 11261
  Gene Symbol: NLRP7
  Gene Name: NLR family, pyrin domain containing 7
  ENSP ID: ENSP00000480034

SEQ ID NO: 57349 - protein, 1037 aa, Homo sapiens; identical to SEQ ID NO: 57333
  Payload ID: 11261
  Gene Symbol: NLRP7
  Gene Name: NLR family, pyrin domain containing 7
  ENSP ID: ENSP00000480226

SEQ ID NO: 57350 - protein, 980 aa, Homo sapiens; identical to SEQ ID NO: 57331
  Payload ID: 11261
  Gene Symbol: NLRP7
  Gene Name: NLR family, pyrin domain containing 7
  Uniprot ID: Q8WX94
  ENSP ID: ENSP00000480449

SEQ ID NO: 57351 - protein, 963 aa, Homo sapiens; identical to SEQ ID NO: 57337
  Payload ID: 11261
  Gene Symbol: NLRP7
  Gene Name: NLR family, pyrin domain containing 7
  ENSP ID: ENSP00000480879

SEQ ID NO: 57352 - protein, 980 aa, Homo sapiens; identical to SEQ ID NO: 57331
  Payload ID: 11261
  Gene Symbol: NLRP7
  Gene Name: NLR family, pyrin domain containing 7
  Uniprot ID: Q8WX94
  ENSP ID: ENSP00000481117

SEQ ID NO: 57353 - protein, 1037 aa, Homo sapiens; identical to SEQ ID NO: 57333
  Payload ID: 11261
  Gene Symbol: NLRP7
  Gene Name: NLR family, pyrin domain containing 7
  Uniprot ID: Q8WX94
  ENSP ID: ENSP00000481395

SEQ ID NO: 57354 - protein, 1037 aa, Homo sapiens; identical to SEQ ID NO: 57333
  Payload ID: 11261
  Gene Symbol: NLRP7
  Gene Name: NLR family, pyrin domain containing 7
  Uniprot ID: Q8WX94
  ENSP ID: ENSP00000481452

SEQ ID NO: 57355 - protein, 83 aa, Homo sapiens
  Payload ID: 11261
  Gene Symbol: NLRP7
  Gene Name: NLR family, pyrin domain containing 7
  ENSP ID: ENSP00000481468
  MOD_RES (1)..(1): Any amino acid
XLQQCSITKLGCRYLSEALQEACSLTNLDLSINQIARGLWILCQALENPNCNLKHLRILDLLSSAIRSLKLWTWARIICGRVA

SEQ ID NO: 57356 - protein, 952 aa, Homo sapiens
  Payload ID: 11261
  Gene Symbol: NLRP7
  Gene Name: NLR family, pyrin domain containing 7
  ENSP ID: ENSP00000481546
MTSPQLEWTLQTLLEQLNEDELKSFKSLLWAFPLEDVLQKTPWSEVEEADGKKLAEILVNTSSENWIRNATVNILEEMNLTELCKMAKAEMMEDGQVQEIDNPELGDAEEDSELAKPGEKEGWRNSMEKQSLVWKNTFWQGDIDNFHDDVTLRNQRFIPFLNPRTPRKLTPYTVVLHGPAGVGKTTLAKKCMLDWTDCNLSPTLRYAFYLSCKELSRMGPCSFAELISKDWPELQDDIPSILAQAQRILFVVDGLDELKVPPGALIQDICGDWEKKKPVPVLLGSLLKRKMLPRAALLVTTRPRALRDLQLLAQQPIYVRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQMSVFHREDLERLGVQESDLRLFLDGDILRQDRVSKGCYSFIHLSFQQFLTALFYTLEKEEGEDRDGHAWDIGDVQKLLSGEERLKNPDLIQVGHFLFGLANEKRAKELEATFGCRMSPDIKQELLQCKAHLHANKPLSVTDLKEVLGCLYESQEEELAKVVVAPFKEISIHLTNTSEVMHCSFSLKHCQDLQKLSLQVAKGVFLENYMDFELDIEFESSNSNLKFLEVKQSFLSDSSVRILCDHVTRSTCHLQKVEIKNVTPDTAYRDFCLAFIGKKTLTHLTLAGHIEWERTMMLMLCDLLRNHKCNLQYLRLGGHCATPEQWAEFFYVLKANQSLKHLRLSANVLLDEGAMLLYKTMTRPKHFLQMLSLENCRLTEASCKDLAAVLVVSKKLTHLCLAKNPIGDTGVKFLCEGLSYPDCKLQTLVLQQCSITKLGCRYLSEALQEACSLTNLDLSINQIARGLWILCQALENPNCNLKHLRLKTYETNLEIKKLLEEVKEKNPKLTIDCNASGATAPPCCDFFC

SEQ ID NO: 57357 - protein, 1037 aa, Homo sapiens
  Payload ID: 11261
  Gene Symbol: NLRP7
  Gene Name: NLR family, pyrin domain containing 7
  ENSP ID: ENSP00000481565
MTSPQLEWTLQTLLEQLNEDELKSFKSLLWAFPLEDVLQKTPWSEVEEADGKKLAEILVNTSSENWIRNATVNILEEMNLTELCKMAKAEMMEDGQVQEIDNPELGDAEEDSELAKPGEKEGWRNSMEKQSLVWKNTFWQGDIDNFHDDVTLRNQRFIPFLNPRTPRKLTPYTVVLHGPAGVGKTTLAKKCMLDWTDCNLSPTLRYAFYLSCKELSRMGPCSFAELISKDWPELQDDIPSILAQAQRILFVVDGLDELKVPPGALIQDICGDWEKKKPVPVLLGSLLKRKMLPRAALLVTTRPRALRDLQLLAQQPIYVRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQMSVFHREDLERLGVQESDLRLFLDGDILRQDRVSKGCYSFIHLSFQQFLTALFYTLEKEEGEDRDGHAWDIGDVQKLLSGEERLKNPDLIQVGHFLFGLANEKRAKELEATFGCRMSPDIKQELLQCKAHLHANKPLSVTDLKEVLGCLYESQEEELAKVVVAPFKEISIHLTNTSEVMHCSFSLKHCQDLQKLSLQVAKGVFLENYMDFELDIEFERCTYLTIPNWARQDLRSLRLWTDFCSLFSSNSNLKFLEVKQSFLSDSSVRILCDHVTRSTCHLQKVEIKNVTPDTAYRDFCLAFIGKKTLTHLTLAGHIEWERTMMLMLCDLLRNHKCNLQYLRLGGHCATPEQWAEFFYVLKANQSLKHLRLSANVLLDEGAMLLYKTMTRPKHFLQMLSLENCRLTEASCKDLAAVLVVSKKLTHLCLAKNPIGDTGVKFLCEGLSYPDCKLQTLVLQQCSITKLGCRYLSEALQEACSLTNLDLSINQIARGLWILCQALENPNCNLKHLRLWSCSLMPFYCQHLGSALLSNQKLETLDLGQNHLWKSGIIKLFGVLRQRTGSLKILRLKTYETNLEIKKLLEEVKEKNPKLTIDCNASGATAPPCCDFFC

SEQ ID NO: 57358 - protein, 980 aa, Homo sapiens; identical to SEQ ID NO: 57331
  Payload ID: 11261
  Gene Symbol: NLRP7
  Gene Name: NLR family, pyrin domain containing 7
  ENSP ID: ENSP00000481809

SEQ ID NO: 57359 - protein, 100 aa, Homo sapiens
  Payload ID: 11261
  Gene Symbol: NLRP7
  Gene Name: NLR family, pyrin domain containing 7
  ENSP ID: ENSP00000482017
  MOD_RES (1)..(1): Any amino acid
XLQQCSITKLGCRYLSEALQEACSLTNLDLSINQIARGLWILCQALENPNCNLKHLRLKTYETNLEIKKLLEEVKEKNPKLTIDCNASGATAPPCCDFFC

SEQ ID NO: 57360 - protein, 1037 aa, Homo sapiens; identical to SEQ ID NO: 57333
  Payload ID: 11261
  Gene Symbol: NLRP7
  Gene Name: NLR family, pyrin domain containing 7
  Uniprot ID: Q8WX94
  ENSP ID: ENSP00000482194

SEQ ID NO: 57361 - protein, 1037 aa, Homo sapiens; identical to SEQ ID NO: 57333
  Payload ID: 11261
  Gene Symbol: NLRP7
  Gene Name: NLR family, pyrin domain containing 7
  ENSP ID: ENSP00000482551

SEQ ID NO: 57362 - protein, 53 aa, Homo sapiens; identical to SEQ ID NO: 57335
  Payload ID: 11261
  Gene Symbol: NLRP7
  Gene Name: NLR family, pyrin domain containing 7
  ENSP ID: ENSP00000482561

SEQ ID NO: 57363 - protein, 1037 aa, Homo sapiens; identical to SEQ ID NO: 57333
  Payload ID: 11261
  Gene Symbol: NLRP7
  Gene Name: NLR family, pyrin domain containing 7
  Uniprot ID: Q8WX94
  ENSP ID: ENSP00000482887

SEQ ID NO: 57364 - protein, 980 aa, Homo sapiens; identical to SEQ ID NO: 57331
  Payload ID: 11261
  Gene Symbol: NLRP7
  Gene Name: NLR family, pyrin domain containing 7
  ENSP ID: ENSP00000483203

SEQ ID NO: 57365 - protein, 980 aa, Homo sapiens; identical to SEQ ID NO: 57331
  Payload ID: 11261
  Gene Symbol: NLRP7
  Gene Name: NLR family, pyrin domain containing 7
  Uniprot ID: Q8WX94
  ENSP ID: ENSP00000483353

SEQ ID NO: 57366 - protein, 1009 aa, Homo sapiens
  Payload ID: 11261
  Gene Symbol: NLRP7
  Gene Name: NLR family, pyrin domain containing 7
  ENSP ID: ENSP00000483638
MTSPQLEWTLQTLLEQLNEDELKSFKSLLWAFPLEDVLQKTPWSEVEEADGKKLAEILVNTSSENWIRNATVNILEEMNLTELCKMAKAEMMEDGQVQEIDNPELGDAEEDSELAKPGEKEGWRNSMEKQSLVWKNTFWQGDIDNFHDDVTLRNQRFIPFLNPRTPRKLTPYTVVLHGPAGVGKTTLAKKCMLDWTDCNLSPTLRYAFYLSCKELSRMGPCSFAELISKDWPELQDDIPSILAQAQRILFVVDGLDELKVPPGALIQDICGDWEKKKPVPVLLGSLLKRKMLPRAALLVTTRPRALRDLQLLAQQPIYVRVEGFLEEDRRAYFLRHFGDEDQAMRAFELMRSNAALFQLGSAPAVCWIVCTTLKLQMEKGEDPVPTCLTRTGLFLRFLCSRFPQGAQLRGALRTLSLLAAQGLWAQMSVFHREDLERLGVQESDLRLFLDGDILRQDRVSKGCYSFIHLSFQQFLTALFYTLEKEEGEDRDGHAWDIGDVQKLLSGEERLKNPDLIQVGHFLFGLANEKRAKELEATFGCRMSPDIKQELLQCKAHLHANKPLSVTDLKEVLGCLYESQEEELAKVVVAPFKEISIHLTNTSEVMHCSFSLKHCQDLQKLSLQVAKGVFLENYMDFELDIEFESSNSNLKFLEVKQSFLSDSSVRILCDHVTRSTCHLQKVEIKNVTPDTAYRDFCLAFIGKKTLTHLTLAGHIEWERTMMLMLCDLLRNHKCNLQYLRLGGHCATPEQWAEFFYVLKANQSLKHLRLSANVLLDEGAMLLYKTMTRPKHFLQMLSLENCRLTEASCKDLAAVLVVSKKLTHLCLAKNPIGDTGVKFLCEGLSYPDCKLQTLVLQQCSITKLGCRYLSEALQEACSLTNLDLSINQIARGLWILCQALENPNCNLKHLRLWSCSLMPFYCQHLGSALLSNQKLETLDLGQNHLWKSGIIKLFGVLRQRTGSLKILRLKTYETNLEIKKLLEEVKEKNPKLTIDCNASGATAPPCCDFFC

SEQ ID NO: 57367 - protein, 1037 aa, Homo sapiens; identical to SEQ ID NO: 57333
  Payload ID: 11261
  Gene Symbol: NLRP7
  Gene Name: NLR family, pyrin domain containing 7
  ENSP ID: ENSP00000484426

SEQ ID NO: 57368 - protein, 980 aa, Homo sapiens; identical to SEQ ID NO: 57331
  Payload ID: 11261
  Gene Symbol: NLRP7
  Gene Name: NLR family, pyrin domain containing 7
  ENSP ID: ENSP00000484444

SEQ ID NO: 57369 - protein, 1037 aa, Homo sapiens; identical to SEQ ID NO: 57333
  Payload ID: 11261
  Gene Symbol: NLRP7
  Gene Name: NLR family, pyrin domain containing 7
  Uniprot ID: Q8WX94
  ENSP ID: ENSP00000484808

SEQ ID NO: 57370 - protein, 1048 aa, Homo sapiens
  Payload ID: 11262
  Gene Symbol: NLRP8
  Gene Name: NLR family, pyrin domain containing 8
  Uniprot ID: Q86W28
  ENSP ID: ENSP00000291971
MSDVNPPSDTPIPFSSSSTHSSHIPPWTFSCYPGSPCENGVMLYMRNVSHEELQRFKQLLLTELSTGTMPITWDQVETASWAEVVHLLIERFPGRRAWDVTSNIFAIMNCDKMCVVVRREINAILPTLEPEDLNVGETQVNLEEGESGKIRRYKSNVMEKFFPIWDITTWPGNQRDFFYQGVHRHEEYLPCLLLPKRPQGRQPKTVAIQGAPGIGKTILAKKVMFEWARNKFYAHKRWCAFYFHCQEVNQTTDQSFSELIEQKWPGSQDLVSKIMSKPDQLLLLLDGFEELTSTLIDRLEDLSEDWRQKLPGSVLLSSLLSKTMLPEATLLIMIRFTSWQTCKPLLKCPSLVTLPGFNTMEKIKYFQMYFGHTEEGDQVLSFAMENTILFSMCRVPVVCWMVCSGLKQQMERGNNLTQSCPNATSVFVRYISSLFPTRAENFSRKIHQAQLEGLCHLAADSMWHRKWVLGKEDLEEAKLDQTGVTAFLGMSILRRIAGEEDHYVFTLVTFQEFFAALFYVLCFPQRLKNFHVLSHVNIQRLIASPRGSKSYLSHMGLFLFGFLNEACASAVEQSFQCKVSFGNKRKLLKVIPLLHKCDPPSPGSGVPQLFYCLHEIREEAFVSQALNDYHKVVLRIGNNKEVQVSAFCLKRCQYLHEVELTVTLNFMNVWKLSSSSHPGSEAPESNGLHRWWQDLCSVFATNDKLEVLTMTNSVLGPPFLKALAAALRHPQCKLQKLLLRRVNSTMLNQDLIGVLTGNQHLRYLEIQHVEVESKAVKLLCRVLRSPRCRLQCLRLEDCLATPRIWTDLGNNLQGNGHLKTLILRKNSLENCGAYYLSVAQLERLSIENCNLTQLTCESLASCLRQSKMLTHLSLAENALKDEGAKHIWNALPHLRCPLQRLVLRKCDLTFNCCQDMISALCKNKTLKSLDLSFNSLKDDGVILLCEALKNPDCTLQILELENCLFTSICCQAMASMLRKNQHLRHLDLSKNAIGVYGILTLCEAFSSQKKREEVIFCIPAWTRITSFSPTPHPPDFTGKSDCLSQINP

SEQ ID NO: 57371 - protein, 1029 aa, Homo sapiens
  Payload ID: 11262
  Gene Symbol: NLRP8
  Gene Name: NLR family, pyrin domain containing 8
  Uniprot ID: Q86W28
  ENSP ID: ENSP00000468121
MSDVNPPSDTPIPFSSSSTHSSHIPPWTFSCYPGSPCENGVMLYMRNVSHEELQRFKQLLLTELSTGTMPITWDQVETASWAEVVHLLIERFPGRRAWDVTSNIFAIMNCDKMCVVVRREINAILPTLEPEDLNVGETQVNLEEGESGKIRRYKSNVMEKFFPIWDITTWPGNQRDFFYQGVHRHEEYLPCLLLPKRPQGRQPKTVAIQGAPGIGKTILAKKVMFEWARNKFYAHKRWCAFYFHCQEVNQTTDQSFSELIEQKWPGSQDLVSKIMSKPDQLLLLLDGFEELTSTLIDRLEDLSEDWRQKLPGSVLLSSLLSKTMLPEATLLIMIRFTSWQTCKPLLKCPSLVTLPGFNTMEKIKYFQMYFGHTEEGDQVLSFAMENTILFSMCRVPVVCWMVCSGLKQQMERGNNLTQSCPNATSVFVRYISSLFPTRAENFSRKIHQAQLEGLCHLAADSMWHRKWVLGKEDLEEAKLDQTGVTAFLGMSILRRIAGEEDHYVFTLVTFQEFFAALFYVLCFPQRLKNFHVLSHVNIQRLIASPRGSKSYLSHMGLFLFGFLNEACASAVEQSFQCKVSFGNKRKLLKVIPLLHKCDPPSPGSGVPQLFYCLHEIREEAFVSQALNDYHKVVLRIGNNKEVQVSAFCLKRCQYLHEVELTVTLNFMNVWKLSSSSHPGSEAPESNGLHRWWQDLCSVFATNDKLEVLTMTNSVLGPPFLKALAAALRHPQCKLQKLLLRRVNSTMLNQDLIGVLTGNQHLRYLEIQHVEVESKAVKLLCRVLRSPRCRLQCLRLEDCLATPRIWTDLGNNLQGNGHLKTLILRKNSLENCGAYYLSVAQLERLSQSKMLTHLSLAENALKDEGAKHIWNALPHLRCPLQRLVLRKCDLTFNCCQDMISALCKNKTLKSLDLSFNSLKDDGVILLCEALKNPDCTLQILELENCLFTSICCQAMASMLRKNQHLRHLDLSKNAIGVYGILTLCEAFSSQKKREEVIFCIPAWTRITSFSPTPHPPDFTGKSDCLSQINP

SEQ ID NO: 57372 - protein, 991 aa, Homo sapiens
  Payload ID: 11263
  Gene Symbol: NLRP9
  Gene Name: NLR family, pyrin domain containing 9
  Uniprot ID: Q7RTR0
  ENSP ID: ENSP00000331857
MAESFFSDFGLLWYLKELRKEEFWKFKELLKQPLEKFELKPIPWAELKKASKEDVAKLLDKHYPGKQAWEVTLNLFLQINRKDLWTKAQEEMRNKLNPYRKHMKETFQLIWEKETCLHVPEHFYKETMKNEYKELNDAYTAAARRHTVVLEGPDGIGKTTLLRKVMLDWAEGNLWKDRFTFVFFLNVCEMNGIAETSLLELLSRDWPESSEKIEDIFSQPERILFIMDGFEQLKFNLQLKADLSDDWRQRQPMPIILSSLLQKKMLPESSLLIALGKLAMQKHYFMLRHPKLIKLLGFSESEKKSYFSYFFGEKSKALKVFNFVRDNGPLFILCHNPFTCWLVCTCVKQRLERGEDLEINSQNTTYLYASFLTTVFKAGSQSFPPKVNRARLKSLCALAAEGIWTYTFVFSHGDLRRNGLSESEGVMWVGMRLLQRRGDCFAFMHLCIQEFCAAMFYLLKRPKDDPNPAIGSITQLVRASVVQPQTLLTQVGIFMFGISTEEIVSMLETSFGFPLSKDLKQEITQCLESLSQCEADREAIAFQELFIGLFETQEKEFVTKVMNFFEEVFIYIGNIEHLVIASFCLKHCQHLTTLRMCVENIFPDDSGCISDYNEKLVYWRELCSMFITNKNFQILDMENTSLDDPSLAILCKALAQPVCKLRKLIFTSVYFGHDSELFKAVLHNPHLKLLSLYGTSLSQSDIRHLCETLKHPMCKIEELILGKCDISSEVCEDIASVLACNSKLKHLSLVENPLRDEGMTLLCEALKHSHCALERLMLMYCCLTSVSCDSISEVLLCSKSLSLLDLGSNALEDNGVASLCAALKHPGCSIRELWLMGCFLTSDSCKDIAAVLICNGKLKTLKLGHNEIGDTGVRQLCAALQHPHCKLECLGLQTCPITRACCDDIAAALIACKTLRSLNLDWIALDADAVVVLCEALSHPDCALQMLGLHKSGFDEETQKILMSVEEKIPHLTISHGPWIDEEYKIRGVLL

SEQ ID NO: 57373 - protein, 986 aa, Homo sapiens
  Payload ID: 11263
  Gene Symbol: NLRP9
  Gene Name: NLR family, pyrin domain containing 9
  Uniprot ID: Q7RTR0
  ENSP ID: ENSP00000465253
MAESFFSDFGLLWYLKELRKEEFWKFKELLKQPLEKFELKPIPWAELKKASKEDVAKLLDKHYPGKQAWEVTLNLFLQINRKDLWTKAQEEMRNKLNPYRKHMKETFQLIWEKETCLHVPEHFYKETMKNEYKELNDAYTAAARRHTVVLEGPDGIGKTTLLRKVMLDWAEGNLWKDRFTFVFFLNVCEMNGIAETSLLELLSRDWPESSEKIEDIFSQPERILFIMDGFEQLKFNLQLKADLSDDWRQRQPMPIILSSLLQKKMLPESSLLIALGKLAMQKHYFMLRHPKLIKLLGFSESEKKSYFSYFFGEKSKALKVFNFVRDNGPLFILCHNPFTCWLVCTCVKQRLERGEDLEINSQNTTYLYASFLTTVFKAGSQSFPPKVNRARLKSLCALAAEGIWTYTFVFSHGDLRRNGLSESEGVMWVGMRLLQRRGDCFAFMHLCIQEFCAAMFYLLKRPKDDPNPAIGSITQLVRASVVQPQTLLTQVGIFMFGISTEEIVSMLETSFGFPLSKDLKQEITQCLESLSQCEADREAIAFQELFIGLFETQEKEFVTKVMNFFEEVFIYIGNIEHLVIASFCLKHCQHLTTLRMCVENIFPDDSGCISDYNEKLVYWRELCSMFITNKNFQILDMENTSLDDPSLAILCKALAQPVCKLRKLIFTSVYFGHDSELFKAVLHNPHLKLLSLYGTSLSQSDIRHLCETLKHPMCKIEELILGKCDISSEVCEDIASVLACNSKLKHLSLVENPLRDEGMTLLCEALKHSHCALERLMLMYCCLTSVSCDSISEVLLCSKSLSLLDLGSNALEDNGVASLCAALKHPGCSIRELWLMGCFLTSDSCKDIAAVLICNGKLKTLKLGHNEIGDTGVRQLCAALQHPHCKLECLGLQTCPITRACCDDIAAALIACKTLRSLNLDWIALDADAVVVLCEALSHPDCALQMLGNCQKSLGDTVAPGENHCSIKHLLLTLPINMQRQLRLQK

SEQ ID NO: 57374 - protein, 503 aa, Homo sapiens
  Payload ID: 11264
  Gene Symbol: NMD3
  Gene Name: NMD3 ribosome export adaptor
  Uniprot ID: Q96D46
  ENSP ID: ENSP00000307525
MEYMAESTDRSPGHILCCECGVPISPNPANICVACLRSKVDISQGIPKQVSISFCKQCQRYFQPPGTWIQCALESRELLALCLKKIKAPLSKVRLVDAGFVWTEPHSKRLKVKLTIQKEVMNGAILQQVFVVDYVVQSQMCGDCHRVEAKDFWKAVIQVRQKTLHKKTFYYLEQLILKYGMHQNTLRIKEIHDGLDFYYSSKQHAQKMVEFLQCTVPCRYKASQRLISQDIHSNTYNYKSTFSVEIVPICKDNVVCLSPKLAQSLGNMNQICVCIRVTSAIHLIDPNTLQVADIDGSTFWSHPFNSLCHPKQLEEFIVMECSIVQDIKRAAGAGMISKKHTLGEVWVQKTSEMNTDKQYFCRTHLGHLLNPGDLVLGFDLANCNLNDEHVNKMNSDRVPDVVLIKKSYDRTKRQRRRNWKLKELARERENMDTDDERQYQDFLEDLEEDEAIRKNVNIYRDSAIPVESDTDDEGAPRISLAEMLEDLHISQDATGEEGASMLT

SEQ ID NO: 57375 - protein, 529 aa, Homo sapiens
  Payload ID: 11264
  Gene Symbol: NMD3
  Gene Name: NMD3 ribosome export adaptor
  ENSP ID: ENSP00000417559
MEYMAESTDRSPGHILCCECGVPISPNPANICVACLRSKVDISQGIPKQVSISFCKQCQRYFQPPGTWIQCALESRELLALCLKKIKAPLSKVRLVDAGFVWTEPHSKRLKVKLTIQKEVMNGAILQQVFVVDYVVQSQMCGDCHRVEAKDFWKAVIQVRQKTLHKKTFYYLEQLILKYGMHQNTLRIKEIHDGLDFYYSSKQHAQKMVEFLQCTVPCRYKASQRLISQDIHSNTYNYKSTFSVEIVPICKDNVVCLSPKLAQSLGNMNQICVCIRVTSAIHLIDPNTLQVADIDGSTFWSHPFNSLCHPKQLEEFIVMECSIVQDIKRAAGAGMISKKHTLGEVWVQKTSEMNTDKQYFCRTHLGHLLNPGDLVLGFDLANCNLNDEHVNKMNSDRVPDVVLIKKSYDRTKRQRRRNWKLKELARERENMDTDDERQYQDFLEDLEEDEAIRKNVNIYRDSAIPVESDTDDEGAPRISLAEMLEDLHISQDATGEEAKSAPEAADLESEVTEGPSVVVDACNPSTLGG

SEQ ID NO: 57376 - protein, 98 aa, Homo sapiens
  Payload ID: 11264
  Gene Symbol: NMD3
  Gene Name: NMD3 ribosome export adaptor
  ENSP ID: ENSP00000418852
MEYMAESTDRSPGHILCCECGVPISPNPANICVACLRSKVDISQGIPKQVSISFCKQCQRYFQPPGTWIQCALESRELLALCLKKIKAPLSKVRLVDA

SEQ ID NO: 57377 - protein, 218 aa, Homo sapiens
  Payload ID: 11264
  Gene Symbol: NMD3
  Gene Name: NMD3 ribosome export adaptor
  ENSP ID: ENSP00000418908
MEYMAESTDRSPGHILCCECGVPISPNPANICVACLRSKVDISQGIPKQVSISFCKQCQRYFQPPGTWIQCALESRELLALCLKKIKAPLSKVRLVDAGFVWTEPHSKRLKVKLTIQKEVMNGAILQQVFVVDYVVQSQMCGDCHRVEAKDFWKAVIQVRQKTLHKKTFYYLEQLILKYGMHQNTLRIKEIHDGLDFYYSSKQHAQKMVEFLQCTVPC

SEQ ID NO: 57378 - protein, 155 aa, Homo sapiens
  Payload ID: 11264
  Gene Symbol: NMD3
  Gene Name: NMD3 ribosome export adaptor
  ENSP ID: ENSP00000418980
MEYMAESTDRSPGHILCCECGVPISPNPANICVACLRSKVDISQGIPKQVSISFCKQCQRYFQPPGTWIQCALESRELLALCLKKIKAPLSKVRLVDAGFVWTEPHSKRLKVKLTIQKEVMNGAILQQVFVVDYVVQSQMCGDCHRVEAKDFWKA

SEQ ID NO: 57379 - protein, 503 aa, Homo sapiens; identical to SEQ ID NO: 57374
  Payload ID: 11264
  Gene Symbol: NMD3
  Gene Name: NMD3 ribosome export adaptor
  Uniprot ID: Q96D46
  ENSP ID: ENSP00000419004

SEQ ID NO: 57380 - protein, 218 aa, Homo sapiens; identical to SEQ ID NO: 57377
  Payload ID: 11264
  Gene Symbol: NMD3
  Gene Name: NMD3 ribosome export adaptor
  ENSP ID: ENSP00000419030

SEQ ID NO: 57381 - protein, 162 aa, Homo sapiens
  Payload ID: 11264
  Gene Symbol: NMD3
  Gene Name: NMD3 ribosome export adaptor
  ENSP ID: ENSP00000419647
MEYMAESTDRSPGHILCCECGVPISPNPANICVACLRSKVDISQGIPKQVSISFCKQCQRYFQPPGTWIQCALESRELLALCLKKIKAPLSKVRLVDAGFVWTEPHSKRLKVKLTIQKEVMNGAILQQVFVVDYVVQSQMCGDCHRVEAKDFWKAVIQVRQK

SEQ ID NO: 57382 - protein, 528 aa, Homo sapiens
  Payload ID: 11265
  Gene Symbol: NSMF
  Gene Name: NMDA receptor synaptonuclear signaling and neuronal migration factor
  Uniprot ID: Q6X4W1
  ENSP ID: ENSP00000265663
MGAAASRRRALRSEAMSSVAAKVRAARAFGEYLSQSHPENRNGADHLLADAYSGHDGSPEMQPAPQNKRRLSLVSNGCYEGSLSEEPSIRKPAGEGPQPRVYTISGEPALLPSPEAEAIELAVVKGRRQRHPHHHSQPLRASPGGSREDVSRPCQSWAGSRQGSKECPGCAQLAPGPTPRAFGLDQPPLPETSGRRKKLERMYSVDRVSDDIPIRTWFPKENLFSFQTATTTMQAVFRGYAERKRRKRENDSASVIQRNFRKHLRMVGSRRVKAQTFAERRERSFSRSWSDPTPMKADTSHDSRDSSDLQSSHCTLDEAFEDLDWDTEKGLEAVACDTEGFVPPKVMLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 57383 - protein, 327 aa, Homo sapiens
  Payload ID: 11265
  Gene Symbol: NSMF
  Gene Name: NMDA receptor synaptonuclear signaling and neuronal migration factor
  ENSP ID: ENSP00000342966
MYSVDRVSDDIPIRTWFPKENLFSFQTATTTMQAVFRGYAERKRRKRENDSASVIQRNFRKHLRMVGSRRVKAQTFAERRERSFSRSWSDPTPMKADTSHDSRDSSDLQSSHCTLDEAFEDLDWDTEKGLEAVACDTEGFVPPKVMLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 57384 - protein, 145 aa, Homo sapiens
  Payload ID: 11265
  Gene Symbol: NSMF
  Gene Name: NMDA receptor synaptonuclear signaling and neuronal migration factor
  ENSP ID: ENSP00000360523
MVGSRRVKAQTFAERRERSFSRSWSDPTPMKADTSHDSRDSSDLQSSHCTLDEAFEDLDWDTEKGLEAVACDTEGFVPPKVMLISSKVPKAEYIPTIIRRDDPSIIPILYVSPAPGLPPTDALLRPHPGPAPAPQVPRVLWRCWL

SEQ ID NO: 57385 - protein, 528 aa, Homo sapiens; identical to SEQ ID NO: 57382
  Payload ID: 11265
  Gene Symbol: NSMF
  Gene Name: NMDA receptor synaptonuclear signaling and neuronal migration factor
  Uniprot ID: Q6X4W1
  ENSP ID: ENSP00000360527

SEQ ID NO: 57386 - protein, 500 aa, Homo sapiens
  Payload ID: 11265
  Gene Symbol: NSMF
  Gene Name: NMDA receptor synaptonuclear signaling and neuronal migration factor
  Uniprot ID: Q6X4W1
  ENSP ID: ENSP00000360528
MGAAASRRRALRSEAMSSVAAKVRAARAFGEYLSQSHPENRNGADHLLADAYSGHDGSPEMQPAPQNKRRLSLVSNGCYEGSLSEEPSIRKPAGEGPQPRVYTISGEPALLPSPEAEAIELAVVKGRRQRHPHHHSQPLRASPGGSREDVSRPCQSWAGSRQGSKECPGCAQLAPGPTPRAFGLDQPPLPETSGRRKKLERMYSVDRVSDDIPIRTWFPKENLFSFQTATTTMQAISVFRGYAERKRRKRENDSASVIQRNFRKHLRMVGSRRVKAQSSDLQSSHCTLDEAFEDLDWDTEKGLEAVACDTEGFVPPKVMLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 57387 - protein, 505 aa, Homo sapiens
  Payload ID: 11265
  Gene Symbol: NSMF
  Gene Name: NMDA receptor synaptonuclear signaling and neuronal migration factor
  Uniprot ID: Q6X4W1
  ENSP ID: ENSP00000360529
MGAAASRRRALRSEAMSSVAAKVRAARAFGEYLSQSHPENRNGADHLLADAYSGHDGSPEMQPAPQNKRRLSLVSNGCYEGSLSEEPSIRKPAGEGPQPRVYTISGEPALLPSPEAEAIELAVVKGRRQRHPHHHSQPLRASPGGSREDVSRPCQSWAGSRQGSKECPGCAQLAPGPTPRAFGLDQPPLPETSGRRKKLERMYSVDRVSDDIPIRTWFPKENLFSFQTATTTMQANFRKHLRMVGSRRVKAQTFAERRERSFSRSWSDPTPMKADTSHDSRDSSDLQSSHCTLDEAFEDLDWDTEKGLEAVACDTEGFVPPKVMLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 57388 - protein, 530 aa, Homo sapiens
  Payload ID: 11265
  Gene Symbol: NSMF
  Gene Name: NMDA receptor synaptonuclear signaling and neuronal migration factor
  Uniprot ID: Q6X4W1
  ENSP ID: ENSP00000360530
MGAAASRRRALRSEAMSSVAAKVRAARAFGEYLSQSHPENRNGADHLLADAYSGHDGSPEMQPAPQNKRRLSLVSNGCYEGSLSEEPSIRKPAGEGPQPRVYTISGEPALLPSPEAEAIELAVVKGRRQRHPHHHSQPLRASPGGSREDVSRPCQSWAGSRQGSKECPGCAQLAPGPTPRAFGLDQPPLPETSGRRKKLERMYSVDRVSDDIPIRTWFPKENLFSFQTATTTMQAISVFRGYAERKRRKRENDSASVIQRNFRKHLRMVGSRRVKAQTFAERRERSFSRSWSDPTPMKADTSHDSRDSSDLQSSHCTLDEAFEDLDWDTEKGLEAVACDTEGFVPPKVMLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 57389 - protein, 194 aa, Homo sapiens
  Payload ID: 11265
  Gene Symbol: NSMF
  Gene Name: NMDA receptor synaptonuclear signaling and neuronal migration factor
  ENSP ID: ENSP00000360537
MGLGPLSSSLSPQLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 57390 - protein, 507 aa, Homo sapiens
  Payload ID: 11265
  Gene Symbol: NSMF
  Gene Name: NMDA receptor synaptonuclear signaling and neuronal migration factor
  Uniprot ID: Q6X4W1
  ENSP ID: ENSP00000412007
MGAAASRRRALRSEAMSSVAAKVRAARAFGEYLSQSHPENRNGADHLLADAYSGHDGSPEMQPAPQNKRRLSLVSNGCYEGSLSEEPSIRKPAGEGPQPRVYTISGEPALLPSPEAEAIELAVVKGRRQRHPHHHSQPLRASPGGSREDVSRPCQSWAGSRQGSKECPGCAQLAPGPTPRAFGLDQPPLPETSGRRKKLERMYSVDRVSDDIPIRTWFPKENLFSFQTATTTMQAISNFRKHLRMVGSRRVKAQTFAERRERSFSRSWSDPTPMKADTSHDSRDSSDLQSSHCTLDEAFEDLDWDTEKGLEAVACDTEGFVPPKVMLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 57391 - protein, 212 aa, Homo sapiens
  Payload ID: 11266
  Gene Symbol: NME5
  Gene Name: NME/NM23 family member 5
  Uniprot ID: P56597
  ENSP ID: ENSP00000265191
MEISMPPPQIYVEKTLAIIKPDIVDKEEEIQDIILRSGFTIVQRRKLRLSPEQCSNFYVEKYGKMFFPNLTAYMSSGPLVAMILARHKAISYWLELLGPNNSLVAKETHPDSLRAIYGTDDLRNALHGSNDFAAAEREIRFMFPEVIVEPIPIGQAAKDYLNLHIMPTLLEGLTELCKQKPADPLIWLADWLLKNNPNKPKLCHHPIVEEPY

SEQ ID NO: 57392 - protein, 376 aa, Homo sapiens
  Payload ID: 11267
  Gene Symbol: NME7
  Gene Name: NME/NM23 family member 7
  Uniprot ID: Q9Y5B8
  ENSP ID: ENSP00000356785
MNHSERFVFIAEWYDPNASLLRRYELLFYPGDGSVEMHDVKNHRTFLKRTKYDNLHLEDLFIGNKVNVFSRQLVLIDYGDQYTARQLGSRKEKTLALIKPDAISKAGEIIEIINKAGFTITKLKMMMLSRKEALDFHVDHQSRPFFNELIQFITTGPIIAMEILRDDAICEWKRLLGPANSGVARTDASESIRALFGTDGIRNAAHGPDSFASAAREMELFFPSSGGCGPANTAKFTNCTCCIVKPHAVSEGLLGKILMAIRDAGFEISAMQMFNMDRVNVEEFYEVYKGVVTEYHDMVTEMYSGPCVAMEIQQNNATKTFREFCGPADPEIARHLRPGTLRAIFGKTKIQNAVHCTDLPEDGLLEVQYFFKILDN

SEQ ID NO: 57393 - protein, 339 aa, Homo sapiens
  Payload ID: 11267
  Gene Symbol: NME7
  Gene Name: NME/NM23 family member 7
  ENSP ID: ENSP00000431467
MNHSERFVFIAEWYDPNASLLRRYELLFYPGDGSVEMHDVKNHRTFLKRTKYDNLHLEDLFIGNKVNVFSRQLVLIDYGDQYTARQLGSRKEKTLALIKPDAISKAGEIIEIINKAGFTITKLKMMMLSRKEALDFHVDHQSRPFFNELIQFITTGPIIAMEILRDDAICEWKRLLGPANSGVARTDASESIRALFGTDGIRNAAHGPDSFASAAREMELFFPSSGGCGPANTAKFTNCTCCIVKPHAVSEGLLGKILMAIRDAGFEISAMQMFNMDRVNVEEFYEVYKGVVTEYHDMVTEMYSGPCVAMEIQQNNATKTFREFCGPADPTPKSPISHK

SEQ ID NO: 57394 - protein, 256 aa, Homo sapiens
  Payload ID: 11267
  Gene Symbol: NME7
  Gene Name: NME/NM23 family member 7
  ENSP ID: ENSP00000432753
MNHSERFVFIAEWYDPNASLLRRYELLFYPGDGSVEMHDVKNHRTFLKRTKYDNLHLEDLFIGNKVNVFSRQLVLIDYGDQYTARQLGSRKEKTLALIKPDAISKAGEIIEIINKAGFTITKLKMMMLSRKEALDFHVDHQSRPFFNELIQFITTGPIIAMEILRDDAICEWKRLLGPANSGVARTDASESIRALFGTDGIRNAAHGPDSFASAAREMELFFPSSGGCGPANTAKFTNCTCCIVKPHAVSEVRRNP

SEQ ID NO: 57395 - protein, 340 aa, Homo sapiens
  Payload ID: 11267
  Gene Symbol: NME7
  Gene Name: NME/NM23 family member 7
  Uniprot ID: Q9Y5B8
  ENSP ID: ENSP00000433341
MHDVKNHRTFLKRTKYDNLHLEDLFIGNKVNVFSRQLVLIDYGDQYTARQLGSRKEKTLALIKPDAISKAGEIIEIINKAGFTITKLKMMMLSRKEALDFHVDHQSRPFFNELIQFITTGPIIAMEILRDDAICEWKRLLGPANSGVARTDASESIRALFGTDGIRNAAHGPDSFASAAREMELFFPSSGGCGPANTAKFTNCTCCIVKPHAVSEGLLGKILMAIRDAGFEISAMQMFNMDRVNVEEFYEVYKGVVTEYHDMVTEMYSGPCVAMEIQQNNATKTFREFCGPADPEIARHLRPGTLRAIFGKTKIQNAVHCTDLPEDGLLEVQYFFKILDN

SEQ ID NO: 57396 - protein, 588 aa, Homo sapiens
  Payload ID: 11268
  Gene Symbol: NME8
  Gene Name: NME/NM23 family member 8
  Uniprot ID: Q8N427
  ENSP ID: ENSP00000199447
MASKKREVQLQTVINNQSLWDEMLQNKGLTVIDVYQAWCGPCRAMQPLFRKLKNELNEDEILHFAVAEADNIVTLQPFRDKCEPVFLFSVNGKIIEKIQGANAPLVNKKVINLIDEERKIAAGEMARPQYPEIPLVDSDSEVSEESPCESVQELYSIAIIKPDAVISKKVLEIKRKITKAGFIIEAEHKTVLTEEQVVNFYSRIADQCDFEEFVSFMTSGLSYILVVSQGSKHNPPSEETEPQTDTEPNERSEDQPEVEAQVTPGMMKNKQDSLQEYLERQHLAQLCDIEEDAANVAKFMDAFFPDFKKMKSMKLEKTLALLRPNLFHERKDDVLRIIKDEDFKILEQRQVVLSEKEAQALCKEYENEDYFNKLIENMTSGPSLALVLLRDNGLQYWKQLLGPRTVEEAIEYFPESLCAQFAMDSLPVNQLYGSDSLETAEREIQHFFPLQSTLGLIKPHATSEQREQILKIVKEAGFDLTQVKKMFLTPEQIEKIYPKVTGKDFYKDLLEMLSVGPSMVMILTKWNAVAEWRRLMGPTDPEEAKLLSPDSIRAQFGISKLKNIVHGASNAYEAKEVVNRLFEDPEEN

SEQ ID NO: 57397 - protein, 115 aa, Homo sapiens
  Payload ID: 11268
  Gene Symbol: NME8
  Gene Name: NME/NM23 family member 8
  ENSP ID: ENSP00000390047
MASKKREVQLQAEADNIVTLQPFRDKCEPVFLFSVNGKIIEKIQGANAPLVNKKVINLIDEERKIAAGEMARPQYPEIPLVDSDSEVSEESPCESVQELYSIAIIKPDAVISKKV

SEQ ID NO: 57398 - protein, 150 aa, Homo sapiens
  Payload ID: 11268
  Gene Symbol: NME8
  Gene Name: NME/NM23 family member 8
  ENSP ID: ENSP00000390596
MASKKREVQLQAEADNIVTLQPFRDKCEPVFLFSVNGKIIEKIQGANAPLVNKKVINLIDEERKIAAGEMARPQYPEIPLVDSDSEVSEESPCESVQELYSIAIIKPDAVISKKVLEIKRKITKAGFIIEAEHKTVLTEEQVVNFYSRIA

SEQ ID NO: 57399 - protein, 588 aa, Homo sapiens; identical to SEQ ID NO: 57396
  Payload ID: 11268
  Gene Symbol: NME8
  Gene Name: NME/NM23 family member 8
  Uniprot ID: Q8N427
  ENSP ID: ENSP00000397063

SEQ ID NO: 57400 - protein, 54 aa, Homo sapiens
  Payload ID: 11268
  Gene Symbol: NME8
  Gene Name: NME/NM23 family member 8
  ENSP ID: ENSP00000408841
MASKKREVQLQAEADNIVTLQPFRDKCEPVFLFSVMMFCVLLKMKTSKYWSKDK

SEQ ID NO: 57401 - protein, 263 aa, Homo sapiens
  Payload ID: 11269
  Gene Symbol: NME9
  Gene Name: NME/NM23 family member 9
  Uniprot ID: Q86XW9
  ENSP ID: ENSP00000321929
MLSSKGLTVVDVYQGWCGPCKPVVSLFQKMRIEVGLDLLHFALAEADRLDVLEKYRGKCEPTFLFYAIKDEALSDEDECVSHGKNNGEDEDMVSSERTCTLAIIKPDAVAHGKTDEIIMKIQEAGFEILTNEERTMTEAEVRLFYQHKAGEEAFEKLVHHMCSGPSHLLILTRTEGFEDVVTTWRTVMGPRDPNVARREQPESLRAQYGTEMPFNAVHGSRDREDADRELALLFPSLKFSDKDTEAPQGESSTQPRLKITDLD

SEQ ID NO: 57402 - protein, 330 aa, Homo sapiens
  Payload ID: 11269
  Gene Symbol: NME9
  Gene Name: NME/NM23 family member 9
  Uniprot ID: Q86XW9
  ENSP ID: ENSP00000335444
MGSRKKEIALQVNISTQELWEEMLSSKGLTVVDVYQGWCGPCKPVVSLFQKMRIEVGLDLLHFALAEADRLDVLEKYRGKCEPTFLFYAGGELVAVVRGANAPLLQKTILDQLEAEKKVLAEGRERKVIKDEALSDEDECVSHGKNNGEDEDMVSSERTCTLAIIKPDAVAHGKTDEIIMKIQEAGFEILTNEERTMTEAEVRLFYQHKAGEEAFEKLVHHMCSGPSHLLILTRTEGFEDVVTTWRTVMGPRDPNVARREQPESLRAQYGTEMPFNAVHGSRDREDADRELALLFPSLKFSDKDTEAPQGGEAEATAGPTEALCFPEDVD

SEQ ID NO: 57403 - protein, 263 aa, Homo sapiens; identical to SEQ ID NO: 57401
  Payload ID: 11269
  Gene Symbol: NME9
  Gene Name: NME/NM23 family member 9
  Uniprot ID: Q86XW9
  ENSP ID: ENSP00000372667

SEQ ID NO: 57404 - protein, 202 aa, Homo sapiens
  Payload ID: 11269
  Gene Symbol: NME9
  Gene Name: NME/NM23 family member 9
  ENSP ID: ENSP00000419147
MGSRKKEIALQVNISTQELWEEMLSSKGLTVVDVYQGWCGPCKPVVSLFQKMRIEVGLDLLHFALAEADRLDVLEKYRGKCEPTFLFYAGGELVAVVRGANAPLLQKTILDQLEAEKKVLAEGRERKVIKDEALSDEDECVSHGKNNGEDEDMVSSERTCTLAIIKPDAVAHGKTDEIIMKIQEAGFEILTNEERTMTEAEV

SEQ ID NO: 57405 - protein, 174 aa, Homo sapiens
  Payload ID: 11269
  Gene Symbol: NME9
  Gene Name: NME/NM23 family member 9
  ENSP ID: ENSP00000419355
MLSSKGLTVVDVYQGWCGPCKPVVSLFQKMRIEVGLDLLHFALAEADRLDVLEKYRGKCEPTFLFYAIKDEALSDEDECVSHGKNNGEDEDMVSSERTCTLAIIKPDAVAHGKTDEIIMKIQEAGFEILTNEERTMTEAEVRLFYQHKAGESPSSVRHRNALQCRPWKPGQRRC

SEQ ID NO: 57406 - protein, 261 aa, Homo sapiens
  Payload ID: 11269
  Gene Symbol: NME9
  Gene Name: NME/NM23 family member 9
  Uniprot ID: Q86XW9
  ENSP ID: ENSP00000419882
MGSRKKEIALQVNISTQELWEEMLSSKGLTVVDVYQGWCGPCKPVVSLFQKMRIEVGLDLLHFALIKDEALSDEDECVSHGKNNGEDEDMVSSERTCTLAIIKPDAVAHGKTDEIIMKIQEAGFEILTNEERTMTEAEVRLFYQHKAGEEAFEKLVHHMCSGPSHLLILTRTEGFEDVVTTWRTVMGPRDPNVARREQPESLRAQYGTEMPFNAVHGSRDREDADRELALLFPSLKFSDKDTEAPQGESSTQPRLKITDLD

SEQ ID NO: 57407 - protein, 30 aa, Homo sapiens
  Payload ID: 11269
  Gene Symbol: NME9
  Gene Name: NME/NM23 family member 9
  ENSP ID: ENSP00000420258
MGSRKKEIALQVNISTQELWEEMLSSKGLT

SEQ ID NO: 57408 - protein, 166 aa, Homo sapiens
  Payload ID: 11269
  Gene Symbol: NME9
  Gene Name: NME/NM23 family member 9
  ENSP ID: ENSP00000420435
  MOD_RES (1)..(1): Any amino acid
XVDVYQGWCGPCKPVVSLFQKMRIEVGLDLLHFALAEADRLDVLEKYRGKCEPTFLFYAIKDEALSDEDECVSHGKNNGEDEDMVSSERTCTLAIIKPDAVAHGKTDEIIMKIQEAGFEILTNEERTMTEAEVRLFYQHKAGESPSSVRHRNALQCRPWKPGQRRC

SEQ ID NO: 57409 - protein, 89 aa, Homo sapiens
  Payload ID: 11269
  Gene Symbol: NME9
  Gene Name: NME/NM23 family member 9
  ENSP ID: ENSP00000420668
MGSRKKEIALQVNISTQELWEEMLSSKGLTGTKGECIGRNTGISWNSKDGRRARHHWDLNLGLQSLGNSRPLSMGLLIPILLASVICCT

SEQ ID NO: 57410 - protein, 177 aa, Homo sapiens
  Payload ID: 11270
  Gene Symbol: NME1
  Gene Name: NME/NM23 nucleoside diphosphate kinase 1
  Uniprot ID: P15531
  ENSP ID: ENSP00000013034
MVLLSTLGIVFQGEGPPISSCDTGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 57411 - protein, 177 aa, Homo sapiens; identical to SEQ ID NO: 57410
  Payload ID: 11270
  Gene Symbol: NME1
  Gene Name: NME/NM23 nucleoside diphosphate kinase 1
  Uniprot ID: P15531
  ENSP ID: ENSP00000337060

SEQ ID NO: 57412 - protein, 152 aa, Homo sapiens
  Payload ID: 11270
  Gene Symbol: NME1
  Gene Name: NME/NM23 nucleoside diphosphate kinase 1
  Uniprot ID: P15531
  ENSP ID: ENSP00000376892
MANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRNIIHGSDSVESAEKEIGLWFHPEELVDYTSCAQNWIYE

SEQ ID NO: 57413 - protein, 60 aa, Homo sapiens
  Payload ID: 11270
  Gene Symbol: NME1
  Gene Name: NME/NM23 nucleoside diphosphate kinase 1
  ENSP ID: ENSP00000387682
MVLLSTLGIVFQGEGPPISSCDTGTMANCERTFIAIKPDGVQRGLVGEIIKRFEQKGFRL

SEQ ID NO: 57414 - protein, 82 aa, Homo sapiens
  Payload ID: 11270
  Gene Symbol: NME1
  Gene Name: NME/NM23 nucleoside diphosphate kinase 1
  ENSP ID: ENSP00000428553
MANCERTFIAIKPDGVQRGLVGEIIKRFEQKGFRLVGLKFMQASEDLLKEHYVDLKDRPFFAGLVKYMHSGPVVAMLPDFLL

SEQ ID NO: 57415 - protein, 139 aa, Homo sapiens
  Payload ID: 11270
  Gene Symbol: NME1
  Gene Name: NME/NM23 nucleoside diphosphate kinase 1
  ENSP ID: ENSP00000429318
MVLLSTLGIVFQGEGPPISSCDTGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGR

SEQ ID NO: 57416 - protein, 82 aa, Homo sapiens; identical to SEQ ID NO: 57414
  Payload ID: 11270
  Gene Symbol: NME1
  Gene Name: NME/NM23 nucleoside diphosphate kinase 1
  ENSP ID: ENSP00000435498

SEQ ID NO: 57417 - protein, 82 aa, Homo sapiens
  Payload ID: 11271
  Gene Symbol: NME2
  Gene Name: NME/NM23 nucleoside diphosphate kinase 2
  ENSP ID: ENSP00000376880
MANLERTFIAIKPDGVQRGLVGEIIKRFEQKGFRLVAMKFLRASEEHLKQHYIDLKDRPFFPGLVKYMNSGPVVAMEHHSWQ

SEQ ID NO: 57418 - protein, 152 aa, Homo sapiens
  Payload ID: 11271
  Gene Symbol: NME2
  Gene Name: NME/NM23 nucleoside diphosphate kinase 2
  ENSP ID: ENSP00000376886
MANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 57419 - protein, 152 aa, Homo sapiens; identical to SEQ ID NO: 57418
  Payload ID: 11271
  Gene Symbol: NME2
  Gene Name: NME/NM23 nucleoside diphosphate kinase 2
  ENSP ID: ENSP00000421064

SEQ ID NO: 57420 - protein, 152 aa, Homo sapiens; identical to SEQ ID NO: 57418
  Payload ID: 11271
  Gene Symbol: NME2
  Gene Name: NME/NM23 nucleoside diphosphate kinase 2
  ENSP ID: ENSP00000425581

SEQ ID NO: 57421 - protein, 152 aa, Homo sapiens; identical to SEQ ID NO: 57418
  Payload ID: 11271
  Gene Symbol: NME2
  Gene Name: NME/NM23 nucleoside diphosphate kinase 2
  ENSP ID: ENSP00000426901

SEQ ID NO: 57422 - protein, 152 aa, Homo sapiens; identical to SEQ ID NO: 57418
  Payload ID: 11271
  Gene Symbol: NME2
  Gene Name: NME/NM23 nucleoside diphosphate kinase 2
  ENSP ID: ENSP00000426976

SEQ ID NO: 57423 - protein, 169 aa, Homo sapiens
  Payload ID: 11272
  Gene Symbol: NME3
  Gene Name: NME/NM23 nucleoside diphosphate kinase 3
  Uniprot ID: Q13232
  ENSP ID: ENSP00000219302
MICLVLTIFANLFPAACTGAHERTFLAVKPDGVQRRLVGEIVRRFERKGFKLVALKLVQASEELLREHYAELRERPFYGRLVKYMASGPVVAMVWQGLDVVRTSRALIGATNPADAPPGTIRGDFCIEVGKNLIHGSDSVESARREIALWFRADELLCWEDSAGHWLYE

SEQ ID NO: 57424 - protein, 57 aa, Homo sapiens
  Payload ID: 11272
  Gene Symbol: NME3
  Gene Name: NME/NM23 nucleoside diphosphate kinase 3
  ENSP ID: ENSP00000454498
IFANLFPAACTGAHERTFLAVKPDGVQRRLVGEIVRRFERKGFKRPDPSAGLRGAAA

SEQ ID NO: 57425 - protein, 53 aa, Homo sapiens
  Payload ID: 11272
  Gene Symbol: NME3
  Gene Name: NME/NM23 nucleoside diphosphate kinase 3
  ENSP ID: ENSP00000455271
FANLFPAACTGAHERTFLAVKPDGVQRRLVGEIVRRFERKGFKLVALKLVQAA

SEQ ID NO: 57426 - protein, 85 aa, Homo sapiens
  Payload ID: 11272
  Gene Symbol: NME3
  Gene Name: NME/NM23 nucleoside diphosphate kinase 3
  ENSP ID: ENSP00000455435
MASGPVVAMVWQGLDVVRTSRALIGATNPADAPPGTIRGDFCIEVGKNLIHGSDSVESARREIALWFRADELLCWEDSAGHWLYE

SEQ ID NO: 57427 - protein, 123 aa, Homo sapiens
  Payload ID: 11272
  Gene Symbol: NME3
  Gene Name: NME/NM23 nucleoside diphosphate kinase 3
  ENSP ID: ENSP00000456160
PAACTGAHERTFLAVKPDGVQRRLVGEIVRRFERKGFKLVALKLVQVGARPPRSCCVSTTPSCVNARSTAALSSIWPPGRWWPWYGRGWTWCAPRGRSSEPRTRPTPRPAPSAGISASRLART

SEQ ID NO: 57428 - protein, 187 aa, Homo sapiens
  Payload ID: 11273
  Gene Symbol: NME4
  Gene Name: NME/NM23 nucleoside diphosphate kinase 4
  Uniprot ID: O00746
  ENSP ID: ENSP00000219479
MGGLFWRSALRGLRCGPRAPGPSLLVRHGSGGPSWTRERTLVAVKPDGVQRRLVGDVIQRFERRGFTLVGMKMLQAPESVLAEHYQDLRRKPFYPALIRYMSSGPVVAMVWEGYNVVRASRAMIGHTDSAEAAPGTIRGDFSVHISRNVIHASDSVEGAQREIQLWFQSSELVSWADGGQHSSIHPA

SEQ ID NO: 57429 - protein, 195 aa, Homo sapiens
  Payload ID: 11273
  Gene Symbol: NME4
  Gene Name: NME/NM23 nucleoside diphosphate kinase 4
  ENSP ID: ENSP00000372398
MGGLFWRSALRGLRCGPRAPGPSLLVRHGSGLPPSALKRGPSWTRERTLVAVKPDGVQRRLVGDVIQRFERRGFTLVGMKMLQAPESVLAEHYQDLRRKPFYPALIRYMSSGPVVAMVWEGYNVVRASRAMIGHTDSAEAAPGTIRGDFSVHISRNVIHASDSVEGAQREIQLWFQSSELVSWADGGQHSSIHPA

SEQ ID NO: 57430 - protein, 117 aa, Homo sapiens
  Payload ID: 11273
  Gene Symbol: NME4
  Gene Name: NME/NM23 nucleoside diphosphate kinase 4
  Uniprot ID: O00746
  ENSP ID: ENSP00000380834
MKMLQAPESVLAEHYQDLRRKPFYPALIRYMSSGPVVAMVWEGYNVVRASRAMIGHTDSAEAAPGTIRGDFSVHISRNVIHASDSVEGAQREIQLWFQSSELVSWADGGQHSSIHPA

SEQ ID NO: 57431 - protein, 117 aa, Homo sapiens; identical to SEQ ID NO: 57430
  Payload ID: 11273
  Gene Symbol: NME4
  Gene Name: NME/NM23 nucleoside diphosphate kinase 4
  Uniprot ID: O00746
  ENSP ID: ENSP00000389048

SEQ ID NO: 57432 - protein, 233 aa, Homo sapiens
  Payload ID: 11273
  Gene Symbol: NME4
  Gene Name: NME/NM23 nucleoside diphosphate kinase 4
  ENSP ID: ENSP00000395605
MGGLFWRSALRGLRCGPRAPGPSLLVRHGSGGPSWTRERTLVAVKPDGVQRRLVGDVIQRFERRGFTLVGMKMLQAPESVLAEHYQDLRRKPFYPALIRYMSSGPVVAMVWEGYNVVRASRAMIGHTDSAEAAPGTIRGDFSVHISRNVIHASDSVEGAQREIQLWFQSSELSPTGAPWPSRRPTWRGTTVSPRTATSSARTCCGTKWPSSQEAALGLGSGLLRFSCGTAAIR

SEQ ID NO: 57433 - protein, 169 aa, Homo sapiens
  Payload ID: 11273
  Gene Symbol: NME4
  Gene Name: NME/NM23 nucleoside diphosphate kinase 4
  ENSP ID: ENSP00000405925
  MOD_RES (1)..(1): Any amino acid
XWRSALRGLRCGPRAPGPSLLVRHGSGGPSWTRERTLVAVKPDGVQRRLVGDVIQRFERRGFTLVGMKMLQAPESVLAEHYQDLRRKPFYPALIRYMSSGPVVAMVWEGYNVVRASRAMIGHTDSAEAAPGTIRGDFSVHISSHRLAPLDRGQREQQMVPGIPQGAHEA

SEQ ID NO: 57434 - protein, 37 aa, Homo sapiens
  Payload ID: 11273
  Gene Symbol: NME4
  Gene Name: NME/NM23 nucleoside diphosphate kinase 4
  ENSP ID: ENSP00000406317
MKMLQAPESVLAEHYQDLRRKPFYPALIRYMSSGPVV

SEQ ID NO: 57435 - protein, 44 aa, Homo sapiens
  Payload ID: 11273
  Gene Symbol: NME4
  Gene Name: NME/NM23 nucleoside diphosphate kinase 4
  ENSP ID: ENSP00000412039
MGGLFWRSALRGLRCGPRAPGPSLLVRHGSASPPEEDGWGGAQR

SEQ ID NO: 57436 - protein, 153 aa, Homo sapiens
  Payload ID: 11273
  Gene Symbol: NME4
  Gene Name: NME/NM23 nucleoside diphosphate kinase 4
  ENSP ID: ENSP00000479681
MGGLFWRSALRGLRCGPRAPGPSLLVRHGSGGPSWTRERTLVAVKPDGVQRRLVGDVIQRFERRGFTLVGMKMLQVWEGYNVVRASRAMIGHTDSAEAAPGTIRGDFSVHISRNVIHASDSVEGAQREIQLWFQSSELVSWADGGQHSSIHPA

SEQ ID NO: 57437 - protein, 117 aa, Homo sapiens; identical to SEQ ID NO: 57430
  Payload ID: 11273
  Gene Symbol: NME4
  Gene Name: NME/NM23 nucleoside diphosphate kinase 4
  Uniprot ID: O00746
  ENSP ID: ENSP00000479996

SEQ ID NO: 57438 - protein, 186 aa, Homo sapiens
  Payload ID: 11274
  Gene Symbol: NME6
  Gene Name: NME/NM23 nucleoside diphosphate kinase 6
  Uniprot ID: O75414
  ENSP ID: ENSP00000392352
MASILRSPQALQLTLALIKPDAVAHPLILEAVHQQILSNKFLIVRMRELLWRKEDCQRFYREHEGRFFYQRLVEFMASGPIRAYILAHKDAIQLWRTLMGPTRVFRARHVAPDSIRGSFGLTDTRNTTHGSDSVVSASREIAAFFPDFSEQRWYEEEEPQLRCGPVCYSPEGGVHYVAGTGGLGPA

SEQ ID NO: 57439 - protein, 111 aa, Homo sapiens
  Payload ID: 11274
  Gene Symbol: NME6
  Gene Name: NME/NM23 nucleoside diphosphate kinase 6
  ENSP ID: ENSP00000392715
MASILRSPQALQLTLALIKPDAVAHPLILEAVHQQILSNKFLIVRMRELLWRKEDCQRFYREHEGRFFYQRLVEFMASGPIRAYILAHKDAIQLWRTLMGPTRVFRARHVA

SEQ ID NO: 57440 - protein, 163 aa, Homo sapiens
  Payload ID: 11274
  Gene Symbol: NME6
  Gene Name: NME/NM23 nucleoside diphosphate kinase 6
  Uniprot ID: O75414
  ENSP ID: ENSP00000393261
MASILRSPQALQLTLALIKPDAVAHPLILEAVHQQILSNKFLIVRMRELLWRKEDCQRFYREHEAGQSEPTSLPTRMPSSSGGRSWDPPECSEHAMWPQILSVGVSASLTPATPPMVRTLWFQPAERLQPSSLTSVNSAGMRRKSPSCAVALCAIAQREVSTM

SEQ ID NO: 57441 - protein, 82 aa, Homo sapiens
  Payload ID: 11274
  Gene Symbol: NME6
  Gene Name: NME/NM23 nucleoside diphosphate kinase 6
  ENSP ID: ENSP00000394128
MASILRSPQALQLTLALIKPDAVAHPLILEAVHQQILSNKFLIVRMRELLWRKEDCQRFYREHEGKEVEVQKVALGTRMKVS

SEQ ID NO: 57442 - protein, 119 aa, Homo sapiens
  Payload ID: 11274
  Gene Symbol: NME6
  Gene Name: NME/NM23 nucleoside diphosphate kinase 6
  Uniprot ID: O75414
  ENSP ID: ENSP00000394232
MASILRSPQALQLTLALIKPDAVAHPLILEAVHQQILSNKFLIVRMRELLWRKEDCQRFYREHEDSVVSASREIAAFFPDFSEQRWYEEEEPQLRCGPVCYSPEGGVHYVAGTGGLGPA

SEQ ID NO: 57443 - protein, 186 aa, Homo sapiens; identical to SEQ ID NO: 57438
  Payload ID: 11274
  Gene Symbol: NME6
  Gene Name: NME/NM23 nucleoside diphosphate kinase 6
  Uniprot ID: O75414
  ENSP ID: ENSP00000399582

SEQ ID NO: 57444 - protein, 61 aa, Homo sapiens
  Payload ID: 11274
  Gene Symbol: NME6
  Gene Name: NME/NM23 nucleoside diphosphate kinase 6
  ENSP ID: ENSP00000405755
MRLERSEMASILRSPQALQLTLALIKPDAVAHPLILEAVHQQILSNKFLIVRMRELLWRKE

SEQ ID NO: 57445 - protein, 186 aa, Homo sapiens; identical to SEQ ID NO: 57438
  Payload ID: 11274
  Gene Symbol: NME6
  Gene Name: NME/NM23 nucleoside diphosphate kinase 6
  Uniprot ID: O75414
  ENSP ID: ENSP00000406642

SEQ ID NO: 57446 - protein, 163 aa, Homo sapiens; identical to SEQ ID NO: 57440
  Payload ID: 11274
  Gene Symbol: NME6
  Gene Name: NME/NM23 nucleoside diphosphate kinase 6
  Uniprot ID: O75414
  ENSP ID: ENSP00000407933

SEQ ID NO: 57447 - protein, 82 aa, Homo sapiens; identical to SEQ ID NO: 57441
  Payload ID: 11274
  Gene Symbol: NME6
  Gene Name: NME/NM23 nucleoside diphosphate kinase 6
  ENSP ID: ENSP00000410435

SEQ ID NO: 57448 - protein, 174 aa, Homo sapiens
  Payload ID: 11274
  Gene Symbol: NME6
  Gene Name: NME/NM23 nucleoside diphosphate kinase 6
  ENSP ID: ENSP00000411116
MASILRSPQALQLTLALIKPDAVAHPLILEAVHQQILSNKFLIVRMRELLWRKEDCQRFYREHEGRFFYQRLVEFMASGPIRAYILAHKDAIQLWRTLMGPTRVFRARHVAPDSIRGSFGLTDTRNTTHGSDSVVSASREIAAFFPDFSEQRWYEEEEPQLRCGPVCYSPEGGV

SEQ ID NO: 57449 - protein, 141 aa, Homo sapiens
  Payload ID: 11274
  Gene Symbol: NME6
  Gene Name: NME/NM23 nucleoside diphosphate kinase 6
  ENSP ID: ENSP00000414842
MRELLWRKEDCQRFYREHEGRFFYQRLVEFMASGPIRAYILAHKDAIQLWRTLMGPTRVFRARHVAPDSIRGSFGLTDTRNTTHGSDSVVSASREIAAFFPDFSEQRWYEEEEPQLRCGPVCYSPEGGVHYVAGTGGLGPA

SEQ ID NO: 57450 - protein, 194 aa, Homo sapiens
  Payload ID: 11274
  Gene Symbol: NME6
  Gene Name: NME/NM23 nucleoside diphosphate kinase 6
  ENSP ID: ENSP00000416658
MTQNLGSEMASILRSPQALQLTLALIKPDAVAHPLILEAVHQQILSNKFLIVRMRELLWRKEDCQRFYREHEGRFFYQRLVEFMASGPIRAYILAHKDAIQLWRTLMGPTRVFRARHVAPDSIRGSFGLTDTRNTTHGSDSVVSASREIAAFFPDFSEQRWYEEEEPQLRCGPVCYSPEGGVHYVAGTGGLGPA

SEQ ID NO: 57451 - protein, 186 aa, Homo sapiens; identical to SEQ ID NO: 57438
  Payload ID: 11274
  Gene Symbol: NME6
  Gene Name: NME/NM23 nucleoside diphosphate kinase 6
  Uniprot ID: O75414
  ENSP ID: ENSP00000440286

SEQ ID NO: 57452 - protein, 197 aa, Homo sapiens
  Payload ID: 11275
  Gene Symbol: NME1-NME2
  Gene Name: NME1-NME2 readthrough
  ENSP ID: ENSP00000365572
MANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRTMANLERTFIAIKPDGVQRGLVGEIIKRFEQKGFRLVAMKFLRASEEHLKQHYIDLKDRPFFPGLVKYMNSGPVVAMEHHSWQ

SEQ ID NO: 57453 - protein, 267 aa, Homo sapiens
  Payload ID: 11275
  Gene Symbol: NME1-NME2
  Gene Name: NME1-NME2 readthrough
  Uniprot ID: P22392
  ENSP ID: ENSP00000376889
MANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRTMANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 57454 - protein, 292 aa, Homo sapiens
  Payload ID: 11275
  Gene Symbol: NME1-NME2
  Gene Name: NME1-NME2 readthrough
  ENSP ID: ENSP00000451932
MVLLSTLGIVFQGEGPPISSCDTGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRTMANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 57455 - protein, 298 aa, Homo sapiens
  Payload ID: 11276
  Gene Symbol: MPG
  Gene Name: N-methylpurine DNA glycosylase
  Uniprot ID: P29372
  ENSP ID: ENSP00000219431
MVTPALQMKKPKQFCRRMGQKKQRPARAGQPHSSSDAAQAPAEQPHSSSDAAQAPCPRERCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 57456 - protein, 293 aa, Homo sapiens
  Payload ID: 11276
  Gene Symbol: MPG
  Gene Name: N-methylpurine DNA glycosylase
  Uniprot ID: P29372
  ENSP ID: ENSP00000348809
MPARSGAQFCRRMGQKKQRPARAGQPHSSSDAAQAPAEQPHSSSDAAQAPCPRERCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 57457 - protein, 281 aa, Homo sapiens
  Payload ID: 11276
  Gene Symbol: MPG
  Gene Name: N-methylpurine DNA glycosylase
  Uniprot ID: P29372
  ENSP ID: ENSP00000380918
MGQKKQRPARAGQPHSSSDAAQAPAEQPHSSSDAAQAPCPRERCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 57458 - protein, 251 aa, Homo sapiens
  Payload ID: 11276
  Gene Symbol: MPG
  Gene Name: N-methylpurine DNA glycosylase
  ENSP ID: ENSP00000388097
MGQKKQRPARAGQPHSSSDAAQAPAEQPHSSSDAAQAPCPRERCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAG

SEQ ID NO: 57459 - protein, 299 aa, Homo sapiens
  Payload ID: 11277
  Gene Symbol: NMRAL1
  Gene Name: NmrA-like family domain containing 1
  Uniprot ID: Q9HBL8
  ENSP ID: ENSP00000283429
MVDKKLVVVFGGTGAQGGSVARTLLEDGTFKVRVVTRNPRKKAAKELRLQGAEVVQGDQDDQVIMELALNGAYATFIVTNYWESCSQEQEVKQGKLLADLARRLGLHYVVYSGLENIKKLTAGRLAAAHFDGKGEVEEYFRDIGVPMTSVRLPCYFENLLSHFLPQKAPDGKSYLLSLPTGDVPMDGMSVSDLGPVVLSLLKMPEKYVGQNIGLSTCRHTAEEYAALLTKHTRKVVHDAKMTPEDYEKLGFPGARDLANMFRFYALRPDRDIELTLRLNPKALTLDQWLEQHKGDFNLL

SEQ ID NO: 57460 - protein, 299 aa, Homo sapiens; identical to SEQ ID NO: 57459
  Payload ID: 11277
  Gene Symbol: NMRAL1
  Gene Name: NmrA-like family domain containing 1
  Uniprot ID: Q9HBL8
  ENSP ID: ENSP00000383962

SEQ ID NO: 57461 - protein, 188 aa, Homo sapiens
  Payload ID: 11277
  Gene Symbol: NMRAL1
  Gene Name: NmrA-like family domain containing 1
  ENSP ID: ENSP00000458425
MVDKKLVVVFGGTEIWFHHVAQAGLKLLSSRDLRASASQSVWITGAQGGSVARTLLEDGTFKVRVVTRNPRKKAAKELRLQGAEVVQGDQDDQVIMELALNGAYATFIVTNYWESCSQEQEVKQGKLLADLARRLGLHYVVYSGLENIKKLTAGRLAAAHFDGKGEVEEYFRDIGVPMTSVRLPCYFE

SEQ ID NO: 57462 - protein, 299 aa, Homo sapiens; identical to SEQ ID NO: 57459
  Payload ID: 11277
  Gene Symbol: NMRAL1
  Gene Name: NmrA-like family domain containing 1
  Uniprot ID: Q9HBL8
  ENSP ID: ENSP00000458762

SEQ ID NO: 57463 - protein, 57 aa, Homo sapiens
  Payload ID: 11277
  Gene Symbol: NMRAL1
  Gene Name: NmrA-like family domain containing 1
  ENSP ID: ENSP00000459022
MVDKKLVVVFGGTEIWFHHVAQAGLKLLSSRDLRASASQSVWITGMSPWAQLQRAKS

SEQ ID NO: 57464 - protein, 190 aa, Homo sapiens
  Payload ID: 11277
  Gene Symbol: NMRAL1
  Gene Name: NmrA-like family domain containing 1
  ENSP ID: ENSP00000459221
NIKKLTAGRLAAAHFDGKGEVEEYFRDIGVPMTSVRLPCYFENLLSHFLPQKAPDGKSYLLSLPTGDVPMDGMSVSDLGPVVLSLLKMPEKYVGQNIGLSTCRHTAEEYAALLTKHTRKVVHDAKVGLPPQMTPEDYEKLGFPGARDLANMFRFYALRPDRDIELTLRLNPKALTLDQWLEQHKGDFNLL

SEQ ID NO: 57465 - protein, 41 aa, Homo sapiens
  Payload ID: 11277
  Gene Symbol: NMRAL1
  Gene Name: NmrA-like family domain containing 1
  ENSP ID: ENSP00000459926
MVDKKLVVVFGGTEAGFHQAKIVPLHFSLGDRVRLHLKKIK

SEQ ID NO: 57466 - protein, 299 aa, Homo sapiens; identical to SEQ ID NO: 57459
  Payload ID: 11277
  Gene Symbol: NMRAL1
  Gene Name: NmrA-like family domain containing 1
  Uniprot ID: Q9HBL8
  ENSP ID: ENSP00000460263

SEQ ID NO: 57467 - protein, 224 aa, Homo sapiens
  Payload ID: 11277
  Gene Symbol: NMRAL1
  Gene Name: NmrA-like family domain containing 1
  ENSP ID: ENSP00000460476
  MOD_RES (1)..(1): Any amino acid
XRLQGAEVVQGDQDDQVIMELALNGAYATFIVTNYWESCSQEQEVKQGKLLADLARRLGLHYVVYSGLENIKKLTAGRLAAAHFDGKGEVEEYFRDIGVPMTSVRLPCYFENLLSHFLPQKAPDGKSYLLSLPTGDVPMDGMSVSDLGPVVLSLLKMPEKYVGQNIGLSTCRHTAEEYAALLTKHTRKVVHDAKVGLPPQVTQASLSGLSSSRREGVSRAAHTS

SEQ ID NO: 57468 - protein, 124 aa, Homo sapiens
  Payload ID: 11277
  Gene Symbol: NMRAL1
  Gene Name: NmrA-like family domain containing 1
  ENSP ID: ENSP00000460837
DGKSYLLSLPTGDVPMDGMSVSDLGPVVLSLLKMPEKYVGQNIGLSTCRHTAEEYAALLTKHTRKMTPEDYEKLGFPGARDLANMFRFYALRPDRDIELTLRLNPKALTLDQWLEQHKGDFNLL

SEQ ID NO: 57469 - protein, 159 aa, Homo sapiens
  Payload ID: 11277
  Gene Symbol: NMRAL1
  Gene Name: NmrA-like family domain containing 1
  ENSP ID: ENSP00000461763
QGKLLADLARRLGLHYVVYSGLENIKKLTAGRLAAAHFDGKGEVEEYFRDIGVPMTSVRLPCYFENLLSHFLPQKAPDGKSYLLSLPTGDVPMDGMSVSDLGPVVLSLLKMPEKYVGQNIGLSTCRHTAEEYAALLTKHTRKVVHDAKELTGHRVKFLA

SEQ ID NO: 57470 - protein, 299 aa, Homo sapiens; identical to SEQ ID NO: 57459
  Payload ID: 11277
  Gene Symbol: NMRAL1
  Gene Name: NmrA-like family domain containing 1
  Uniprot ID: Q9HBL8
  ENSP ID: ENSP00000478990

SEQ ID NO: 57471 - protein, 299 aa, Homo sapiens; identical to SEQ ID NO: 57459
  Payload ID: 11277
  Gene Symbol: NMRAL1
  Gene Name: NmrA-like family domain containing 1
  Uniprot ID: Q9HBL8
  ENSP ID: ENSP00000479569

SEQ ID NO: 57472 - protein, 124 aa, Homo sapiens; identical to SEQ ID NO: 57468
  Payload ID: 11277
  Gene Symbol: NMRAL1
  Gene Name: NmrA-like family domain containing 1
  ENSP ID: ENSP00000488058

SEQ ID NO: 57473 - protein, 57 aa, Homo sapiens; identical to SEQ ID NO: 57463
  Payload ID: 11277
  Gene Symbol: NMRAL1
  Gene Name: NmrA-like family domain containing 1
  ENSP ID: ENSP00000488151

SEQ ID NO: 57474 - protein, 224 aa, Homo sapiens; identical to SEQ ID NO: 57467
  Payload ID: 11277
  Gene Symbol: NMRAL1
  Gene Name: NmrA-like family domain containing 1
  ENSP ID: ENSP00000488163
  MOD_RES (1)..(1): Any amino acid

SEQ ID NO: 57475 - protein, 159 aa, Homo sapiens; identical to SEQ ID NO: 57469
  Payload ID: 11277
  Gene Symbol: NMRAL1
  Gene Name: NmrA-like family domain containing 1
  ENSP ID: ENSP00000488172

SEQ ID NO: 57476 - protein, 188 aa, Homo sapiens; identical to SEQ ID NO: 57461
  Payload ID: 11277
  Gene Symbol: NMRAL1
  Gene Name: NmrA-like family domain containing 1
  ENSP ID: ENSP00000488191

SEQ ID NO: 57477 - protein, 299 aa, Homo sapiens; identical to SEQ ID NO: 57459
  Payload ID: 11277
  Gene Symbol: NMRAL1
  Gene Name: NmrA-like family domain containing 1
  Uniprot ID: Q9HBL8
  ENSP ID: ENSP00000488644

SEQ ID NO: 57478 - protein, 41 aa, Homo sapiens; identical to SEQ ID NO: 57465
  Payload ID: 11277
  Gene Symbol: NMRAL1
  Gene Name: NmrA-like family domain containing 1
  ENSP ID: ENSP00000488691

SEQ ID NO: 57479 - protein, 299 aa, Homo sapiens; identical to SEQ ID NO: 57459
  Payload ID: 11277
  Gene Symbol: NMRAL1
  Gene Name: NmrA-like family domain containing 1
  Uniprot ID: Q9HBL8
  ENSP ID: ENSP00000488692

SEQ ID NO: 57480 - protein, 190 aa, Homo sapiens; identical to SEQ ID NO: 57464
  Payload ID: 11277
  Gene Symbol: NMRAL1
  Gene Name: NmrA-like family domain containing 1
  ENSP ID: ENSP00000488749

SEQ ID NO: 57481 - protein, 307 aa, Homo sapiens
  Payload ID: 11278
  Gene Symbol: NMI
  Gene Name: N-myc (and STAT) interactor
  Uniprot ID: Q13287
  ENSP ID: ENSP00000243346
MEADKDDTQQILKEHSPDEFIKDEQNKGLIDEITKKNIQLKKEIQKLETELQEATKEFQIKEDIPETKMKFLSVETPENDSQLSNISCSFQVSSKVPYEIQKGQALITFEKEEVAQNVVSMSKHHVQIKDVNLEVTAKPVPLNSGVRFQVYVEVSKMKINVTEIPDTLREDQMRDKLELSFSKSRNGGGEVDRVDYDRQSGSAVITFVEIGVADKILKKKEYPLYINQTCHRVTVSPYTEIHLKKYQIFSGTSKRTVLLTGMEGIQMDEEIVEDLINIHFQRAKNGGGEVDVVKCSLGQPHIAYFEE

SEQ ID NO: 57482 - protein, 28 aa, Homo sapiens
  Payload ID: 11278
  Gene Symbol: NMI
  Gene Name: N-myc (and STAT) interactor
  ENSP ID: ENSP00000387373
MEADKDDTQQILKEHSPDEFIKDEQNKG

SEQ ID NO: 57483 - protein, 394 aa, Homo sapiens
  Payload ID: 11279
  Gene Symbol: NDRG1
  Gene Name: N-myc downstream regulated 1
  Uniprot ID: Q92597
  ENSP ID: ENSP00000319977
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 57484 - protein, 394 aa, Homo sapiens; identical to SEQ ID NO: 57483
  Payload ID: 11279
  Gene Symbol: NDRG1
  Gene Name: N-myc downstream regulated 1
  Uniprot ID: Q92597
  ENSP ID: ENSP00000404854

SEQ ID NO: 57485 - protein, 328 aa, Homo sapiens
  Payload ID: 11279
  Gene Symbol: NDRG1
  Gene Name: N-myc downstream regulated 1
  Uniprot ID: Q92597
  ENSP ID: ENSP00000427894
MNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 57486 - protein, 193 aa, Homo sapiens
  Payload ID: 11279
  Gene Symbol: NDRG1
  Gene Name: N-myc downstream regulated 1
  ENSP ID: ENSP00000428345
MAVPPPGIMKQAGDSRDMSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWA

SEQ ID NO: 57487 - protein, 158 aa, Homo sapiens
  Payload ID: 11279
  Gene Symbol: NDRG1
  Gene Name: N-myc downstream regulated 1
  ENSP ID: ENSP00000428384
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVE

SEQ ID NO: 57488 - protein, 100 aa, Homo sapiens
  Payload ID: 11279
  Gene Symbol: NDRG1
  Gene Name: N-myc downstream regulated 1
  ENSP ID: ENSP00000428802
MNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVN

SEQ ID NO: 57489 - protein, 167 aa, Homo sapiens
  Payload ID: 11279
  Gene Symbol: NDRG1
  Gene Name: N-myc downstream regulated 1
  ENSP ID: ENSP00000428991
MSGSRESCTVGCVCVFTRMRVPVCLCVCITNLLLGLTVRLKLALCLYVAGDSRDMSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYP

SEQ ID NO: 57490 - protein, 141 aa, Homo sapiens
  Payload ID: 11279
  Gene Symbol: NDRG1
  Gene Name: N-myc downstream regulated 1
  ENSP ID: ENSP00000429007
MSREMQDVDLAEVKPLVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 57491 - protein, 95 aa, Homo sapiens
  Payload ID: 11279
  Gene Symbol: NDRG1
  Gene Name: N-myc downstream regulated 1
  ENSP ID: ENSP00000429172
MSREMQDVDLAEVKPLVEKGETITGLLQEFDVQTKPATTPSSTTRTCRRSPSTLPSATWTPLASRTAQPPSPQGTCTPPWISWLKCFLESFNSLG

SEQ ID NO: 57492 - protein, 158 aa, Homo sapiens; identical to SEQ ID NO: 57487
  Payload ID: 11279
  Gene Symbol: NDRG1
  Gene Name: N-myc downstream regulated 1
  ENSP ID: ENSP00000429272

SEQ ID NO: 57493 - protein, 216 aa, Homo sapiens
  Payload ID: 11279
  Gene Symbol: NDRG1
  Gene Name: N-myc downstream regulated 1
  ENSP ID: ENSP00000429380
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKPFDYQALVLDTVMCAVTSCSPSLDLVALKFLALPVPD

SEQ ID NO: 57494 - protein, 133 aa, Homo sapiens
  Payload ID: 11279
  Gene Symbol: NDRG1
  Gene Name: N-myc downstream regulated 1
  ENSP ID: ENSP00000429524
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKS

SEQ ID NO: 57495 - protein, 156 aa, Homo sapiens
  Payload ID: 11279
  Gene Symbol: NDRG1
  Gene Name: N-myc downstream regulated 1
  ENSP ID: ENSP00000429840
MTVPAAGDSRDMSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYI

SEQ ID NO: 57496 - protein, 165 aa, Homo sapiens
  Payload ID: 11279
  Gene Symbol: NDRG1
  Gene Name: N-myc downstream regulated 1
  ENSP ID: ENSP00000429994
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINV

SEQ ID NO: 57497 - protein, 42 aa, Homo sapiens
  Payload ID: 11279
  Gene Symbol: NDRG1
  Gene Name: N-myc downstream regulated 1
  ENSP ID: ENSP00000430171
MNHKTCYNPLFNYEDMQEITQHFAVCHVDAPGQQDGAASFPA

SEQ ID NO: 57498 - protein, 103 aa, Homo sapiens
  Payload ID: 11279
  Gene Symbol: NDRG1
  Gene Name: N-myc downstream regulated 1
  ENSP ID: ENSP00000431057
MSREMQDVDLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 57499 - protein, 313 aa, Homo sapiens
  Payload ID: 11279
  Gene Symbol: NDRG1
  Gene Name: N-myc downstream regulated 1
  Uniprot ID: Q92597
  ENSP ID: ENSP00000437443
MQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 57500 - protein, 496 aa, Homo sapiens
  Payload ID: 11280
  Gene Symbol: NMT1
  Gene Name: N-myristoyltransferase 1
  Uniprot ID: P30419
  ENSP ID: ENSP00000258960
MADESETAVKPPAPPLPQMMEGNGNGHEHCSDCENEEDNSYNRGGLSPANDTGAKKKKKKQKKKKEKGSETDSAQDQPVKMNSLPAERIQEIQKAIELFSVGQGPAKTMEEASKRSYQFWDTQPVPKLGEVVNTHGPVEPDKDNIRQEPYTLPQGFTWDALDLGDRGVLKELYTLLNENYVEDDDNMFRFDYSPEFLLWALRPPGWLPQWHCGVRVVSSRKLVGFISAIPANIHIYDTEKKMVEINFLCVHKKLRSKRVAPVLIREITRRVHLEGIFQAVYTAGVVLPKPVGTCRYWHRSLNPRKLIEVKFSHLSRNMTMQRTMKLYRLPETPKTAGLRPMETKDIPVVHQLLTRYLKQFHLTPVMSQEEVEHWFYPQENIIDTFVVENANGEVTDFLSFYTLPSTIMNHPTHKSLKAAYSFYNVHTQTPLLDLMSDALVLAKMKGFDVFNALDLMENKTFLEKLKFGIGDGNLQYYLYNWKCPSMGAEKVGLVLQ

SEQ ID NO: 57501 - protein, 137 aa, Homo sapiens
  Payload ID: 11280
  Gene Symbol: NMT1
  Gene Name: N-myristoyltransferase 1
  ENSP ID: ENSP00000439263
MADESETAVKPPAPPLPQMMEGNGNGHEHCSDCENEEDNSYNRGGLSPANDTGAKKKKKKQKKKKEKGSETDSAQDQPVKMNSLPAERIQEIQKAIELFSVGQGPAKTMEEASKRSYQFWDTQPVPKLAKRTVHPPE

SEQ ID NO: 57502 - protein, 88 aa, Homo sapiens
  Payload ID: 11280
  Gene Symbol: NMT1
  Gene Name: N-myristoyltransferase 1
  ENSP ID: ENSP00000466777
  MOD_RES (1)..(1): Any amino acid
XDESETAVKPPAPPLPQMMEGNGNGHEHCSDCENEEDNSYNRGGLSPANDTGAKKKKKKQKKKKEKGSETDSAQDQPVKVGVQKYEHG

SEQ ID NO: 57503 - protein, 72 aa, Homo sapiens
  Payload ID: 11280
  Gene Symbol: NMT1
  Gene Name: N-myristoyltransferase 1
  ENSP ID: ENSP00000466827
MNSLPAERIQEIQKAIELFSVGQGPAKTMEEASKRSYQFWDTQPVPKLGEVVNTHGPVEPDKDNIRQEPYTL

SEQ ID NO: 57504 - protein, 496 aa, Homo sapiens; identical to SEQ ID NO: 57500
  Payload ID: 11280
  Gene Symbol: NMT1
  Gene Name: N-myristoyltransferase 1
  Uniprot ID: P30419
  ENSP ID: ENSP00000468424

SEQ ID NO: 57505 - protein, 485 aa, Homo sapiens
  Payload ID: 11281
  Gene Symbol: NMT2
  Gene Name: N-myristoyltransferase 2
  ENSP ID: ENSP00000367392
MRRRRSTPKEVLEGIWEPKRKRRNRREKRRNQIPEAPSQTRHLIPRRLKFSSLRNTTPSGSRFQREQPWNPSVPMQKLQDIQRAMELLSACQGPARNIDEAAKHRYQFWDTQPVPKLDEVITSHGAIEPDKDNVRQEPYSLPQGFMWDTLDLSDAEVLKELYTLLNENYVEDDDNMFRFDYSPEFLLWALRPPGWLLQWHCGVRVSSNKKLVGFISAIPANIRIYDSVKKMVEINFLCVHKKLRSKRVAPVLIREITRRVNLEGIFQAVYTAGVVLPKPIATCRYWHRSLNPRKLVEVKFSHLSRNMTLQRTMKLYRLPDVTKTSGLRPMEPKDIKSVRELINTYLKQFHLAPVMDEEEVAHWFLPREHIIDTFVVESPNGKLTDFLSFYTLPSTVMHHPAHKSLKAAYSFYNIHTETPLLDLMSDALILAKSKGFDVFNALDLMENKTFLEKLKFGIGDGNLQYYLYNWRCPGTDSEKVGLVLQ

SEQ ID NO: 57506 - protein, 498 aa, Homo sapiens
  Payload ID: 11281
  Gene Symbol: NMT2
  Gene Name: N-myristoyltransferase 2
  Uniprot ID: O60551
  ENSP ID: ENSP00000367407
MAEDSESAASQQSLELDDQDTCGIDGDNEEETEHAKGSPGGYLGAKKKKKKQKRKKEKPNSGGTKSDSASDSQEIKIQQPSKNPSVPMQKLQDIQRAMELLSACQGPARNIDEAAKHRYQFWDTQPVPKLDEVITSHGAIEPDKDNVRQEPYSLPQGFMWDTLDLSDAEVLKELYTLLNENYVEDDDNMFRFDYSPEFLLWALRPPGWLLQWHCGVRVSSNKKLVGFISAIPANIRIYDSVKKMVEINFLCVHKKLRSKRVAPVLIREITRRVNLEGIFQAVYTAGVVLPKPIATCRYWHRSLNPRKLVEVKFSHLSRNMTLQRTMKLYRLPDVTKTSGLRPMEPKDIKSVRELINTYLKQFHLAPVMDEEEVAHWFLPREHIIDTFVVESPNGKLTDFLSFYTLPSTVMHHPAHKSLKAAYSFYNIHTETPLLDLMSDALILAKSKGFDVFNALDLMENKTFLEKLKFGIGDGNLQYYLYNWRCPGTDSEKVGLVLQ

SEQ ID NO: 57507 - protein, 691 aa, Homo sapiens
  Payload ID: 11282
  Gene Symbol: NOBOX
  Gene Name: NOBOX oogenesis homeobox
  Uniprot ID: O60393
  ENSP ID: ENSP00000419457
MALLLTLTSPDLEGTWDTRDKDGFKAQEGPPLAVPEFPVCGLYRIYGVCGSFSSFFIIRCSLCALETLKSPQHDPLEIPEQSLKLIPLVSGKRELTRGQKAGEKPLAAGPGEEELLRGSAPHAQDTQSEELPPSCTISGEKKPPAVSGEATGADAGRLCPPPRSRAPHKDRTLARSRPQTQGEDCSLPVGEVKIGKRSYSPAPGKQKKPNAMGLAPTSSPGAPNSARATHNPVPCGSGRGPCHLANLLSTLAQSNQNRDHKQGPPEVTCQIRKKTRTLYRSDQLEELEKIFQEDHYPDSDKRREIAQTVGVTPQRIMVKGAGSLVAGWSGGGPTIETLELQSERSAVAWVWFQNRRAKWRKMEKLNGKESKDNPAAPGPASSQCSSAAEILPAVPMEPKPDPFPQESPLDTFPEPPMLLTSDQTLAPTQPSEGAQRVVTPPLFSPPPVRRADLPFPLGPVHTPQLMPLLMDVAGSDSSHKDGPCGSWGTSITLPPPCSYLEELEPQDYQQSNQPGPFQFSQAPQPPLFQSPQPKLPYLPTFPFSMPSSLTLPPPEDSLFMFPCGPSGGTSQGYCPGASSGQILMQPPAGNIGTASWSDPCLPELPFPGPFCPQALGHPPGGDGYFPDLFPTPCPQALGRQPSSALSWMPEGARPGTGPLLSKAKEEPPAASLDQPSALEEARGDDKNSHVP

SEQ ID NO: 57508 - protein, 659 aa, Homo sapiens
  Payload ID: 11282
  Gene Symbol: NOBOX
  Gene Name: NOBOX oogenesis homeobox
  Uniprot ID: O60393
  ENSP ID: ENSP00000419565
MALLLTLTSPDLEGTWDTRDKDGFKAQEGPPLAVPEFPVCGLYRIYGVCGSFSSFFIIRCSLCALETLKSPQHDPLEIPEQSLKLIPLVSGKRELTRGQKAGEKPLAAGPGEEELLRGSAPHAQDTQSEELPPSCTISGEKKPPAVSGEATGADAGRLCPPPRSRAPHKDRTLARSRPQTQGEDCSLPVGEVKIGKRSYSPAPGKQKKPNAMGLAPTSSPGAPNSARATHNPVPCGSGRGPCHLANLLSTLAQSNQNRDHKQGPPEVTCQIRKKTRTLYRSDQLEELEKIFQEDHYPDSDKRREIAQTVGVTPQRIMVWFQNRRAKWRKMEKLNGKESKDNPAAPGPASSQCSSAAEILPAVPMEPKPDPFPQESPLDTFPEPPMLLTSDQTLAPTQPSEGAQRVVTPPLFSPPPVRRADLPFPLGPVHTPQLMPLLMDVAGSDSSHKDGPCGSWGTSITLPPPCSYLEELEPQDYQQSNQPGPFQFSQAPQPPLFQSPQPKLPYLPTFPFSMPSSLTLPPPEDSLFMFPCGPSGGTSQGYCPGASSGQILMQPPAGNIGTASWSDPCLPELPFPGPFCPQALGHPPGGDGYFPDLFPTPCPQALGRQPSSALSWMPEGARPGTGPLLSKAKEEPPAASLDQPSALEEARGDDKNSHVP

SEQ ID NO: 57509 - protein, 749 aa, Homo sapiens [sequence omitted]

SEQ ID NO: 57510 - protein, 800 aa, Homo sapiens
  Payload ID: 11284
  Gene Symbol: NOC3L
  Gene Name: NOC3-like DNA replication regulator
  Uniprot ID: Q8WTT2
  ENSP ID: ENSP00000360412
MKARRNKKQIPSFRKLIKTSKVKLENKLKNKQFKQQSTLKKYRKEQRKLRQAVKDAVSKKPIPLENPKEKRPGKRIEREEEEEEEALPLDMMDEDDLQLMKDLGQRVSFLTRDLSSSEPVHAKKRKHERIIDKYEKIPRTLQTAPEKELIHLLPIKDKSGIIPQTREKPVTDSNKDEEDQEEERELEEEIIEDPIQELTIEEHLIERKKKLQEKKMHIAALASAILSDPENNIKKLKELRSMLMEQDPDVAVTVRKLVIVSLMELFKDITPSYKIRPLTEAEKSTKTRKETQKLREFEEGLVSQYKFYLENLEQMVKDWKQRKLKKSNVVSLKAYKGLAEVAVKSLCELLVALPHFNFHNNIIVLIVPLMNDMSKLISEMCCEAVKKLFKQDKLGQASLGVIKVISGFVKGRNYEVRPEMLKTFLCLRIKEVEVKKDTEDINKPKKFMTFKEKRKSLSRMQRKWKKAEEKLERELREAEASESTEKKLKLHTETLNIVFVTYFRILKKAQRSPLLPAVLEGLAKFAHLINVEFFDDLLVVLHTLIESGDLSYQESLHCVQTAFHILSGQGDVLNIDPLKFYTHLYKTLFKLHAGATNEGVEIVLQCLDVMLTKRRKQVSQQRALAFIKRLCTLALHVLPNSSIGILATTRILMHTFPKTDLLLDSESQGSGVFLPELDEPEYCNAQNTALWELHALRRHYHPIVQRFAAHLIAGAPSEGSGALKPELSRRSATELFEAYSMAEMTFNPPVESSNPKIKGKFLQGDSFLNEDLNQLIKRYSSEVATESPLDFTKYLKTSLH

SEQ ID NO: 57511 - protein, 431 aa, Homo sapiens
  Payload ID: 11285
  Gene Symbol: NOCT
  Gene Name: nocturnin
  Uniprot ID: Q9UK39
  ENSP ID: ENSP00000280614
MFHSPRRLCSALLQRDAPGLRRLPAPGLRRPLSPPAAVPRPASPRLLAAASAASGAARSCSRTVCSMGTGTSRLYSALAKTLNSSAASQHPEYLVSPDPEHLEPIDPKELLEECRAVLHTRPPRFQRDFVDLRTDCPSTHPPIRVMQWNILAQALGEGKDNFVQCPVEALKWEERKCLILEEILAYQPDILCLQEVDHYFDTFQPLLSRLGYQGTFFPKPWSPCLDVEHNNGPDGCALFFLQNRFKLVNSANIRLTAMTLKTNQVAIAQTLECKESGRQFCIAVTHLKARTGWERFRSAQGCDLLQNLQNITQGAKIPLIVCGDFNAEPTEEVYKHFASSSLNLNSAYKLLSADGQSEPPYTTWKIRTSGECRHTLDYIWYSKHALNVRSALDLLTEEQIGPNRLPSFNYPSDHLSLVCDFSFTEESDGLS

SEQ ID NO: 57512 - protein, 167 aa, Homo sapiens
  Payload ID: 11285
  Gene Symbol: NOCT
  Gene Name: nocturnin
  ENSP ID: ENSP00000486546
MFHSPRRLCSALLQRDAPGLRRLPAPGLRRPLSPPAAVPRPASPRLLAAASAASGAARSCSRTVCSMGTGTSRLYSALAKTLNSSAASQHPEYLVSPDPEHLEPIDPKELLEECRAVLHTRPPRFQRDFVDLRTDCPSTHPPIRVMQWNILAQGMLDAFVPLQSSLL

SEQ ID NO: 57513 - protein, 347 aa, Homo sapiens
  Payload ID: 11286
  Gene Symbol: NODAL
  Gene Name: nodal growth differentiation factor
  Uniprot ID: Q96S42
  ENSP ID: ENSP00000287139
MHAHCLPFLLHAWWALLQAGAATVATALLRTRGQPSSPSPLAYMLSLYRDPLPRADIIRSLQAEDVAVDGQNWTFAFDFSFLSQQEDLAWAELRLQLSSPVDLPTEGSLAIEIFHQPKPDTEQASDSCLERFQMDLFTVTLSQVTFSLGSMVLEVTRPLSKWLKHPGALEKQMSRVAGECWPRPPTPPATNVLLMLYSNLSQEQRQLGGSTLLWEAESSWRAQEGQLSWEWGKRHRRHHLPDRSQLCRKVKFQVDFNLIGWGSWIIYPKQYNAYRCEGECPNPVGEEFHPTNHAYIQSLLKRYQPHRVPSTCCAPVKTKPLSMLYVDNGRVLLDHHKDMIVEECGCL

SEQ ID NO: 57514 - protein, 292 aa, Homo sapiens
  Payload ID: 11286
  Gene Symbol: NODAL
  Gene Name: nodal growth differentiation factor
  ENSP ID: ENSP00000394468
DQQLGIQTKDVAVDGQNWTFAFDFSFLSQQEDLAWAELRLQLSSPVDLPTEGSLAIEIFHQPKPDTEQASDSCLERFQMDLFTVTLSQVTFSLGSMVLEVTRPLSKWLKHPGALEKQMSRVAGECWPRPPTPPATNVLLMLYSNLSQEQRQLGGSTLLWEAESSWRAQEGQLSWEWGKRHRRHHLPDRSQLCRKVKFQVDFNLIGWGSWIIYPKQYNAYRCEGECPNPVGEEFHPTNHAYIQSLLKRYQPHRVPSTCCAPVKTKPLSMLYVDNGRVLLDHHKDMIVEECGCL

SEQ ID NO: 57515 - protein, 1222 aa, Homo sapiens
  Payload ID: 11287
  Gene Symbol: NOMO1
  Gene Name: NODAL modulator 1
  Uniprot ID: Q15155
  ENSP ID: ENSP00000287667
MLVGQGAGPLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIIATGFSVCGQISIIRFPDTVKQMNKYKVVLSSQDKDKSLVTVETDAHGSFCFKAKPGTYKVQVMVPEAETRAGLTLKPQTFPLTVTNRPMMDVAFVQFLASVSGKVSCLDTCGDLLVTLQSLSRQGEKRSLQLSGKVNAMTFTFDNVLPGKYKISIMHEDWCWKNKSLEVEVLEDDMSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVRALGQAASDNSGPEDAKRQAKKQKTRRT

SEQ ID NO: 57516 - protein, 144 aa, Homo sapiens
  Payload ID: 11287
  Gene Symbol: NOMO1
  Gene Name: NODAL modulator 1
  ENSP ID: ENSP00000457581
  MOD_RES (1)..(1): Any amino acid
XSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVRALGQAASDNSGPEDAKRQAKKQKTRRT

SEQ ID NO: 57517 - protein, 1100 aa, Homo sapiens
  Payload ID: 11287
  Gene Symbol: NOMO1
  Gene Name: NODAL modulator 1
  ENSP ID: ENSP00000479933
MARFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIIATGFSVCGQISIIRFPDTVKQMNKYKVVLSSQDKDKSLVTVETDAHGSFCFKAKPGTYKVQVMVPEAETRAGLTLKPQTFPLTVTNRPMMDVAFVQFLASVSGKVSCLDTCGDLLVTLQSLSRQGEKRSLQLSGKVNAMTFTFDNVLPGKYKISIMHEDWCWKNKSLEVEVLEDDMSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVRALGQAASDNSGPEDAKRQAKKQKTRRTLRLQGEFQLTWCLVPWRGTLGIHLFSSLPFASEILLETTATCIHY

SEQ ID NO: 57518 - protein, 1267 aa, Homo sapiens
  Payload ID: 11287
  Gene Symbol: NOMO1
  Gene Name: NODAL modulator 1
  ENSP ID: ENSP00000480539
MLVGQGAGPLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIIATGFSVCGQISIIRFPDTVKQMNKYKVVLSSQDKDKSLVTVETDAHGSFCFKAKPGTYKVQVMVPEAETRAGLTLKPQTFPLTVTNRPMMDVAFVQFLASVSGKVSCLDTCGDLLVTLQSLSRQGEKRSLQLSGKVNAMTFTFDNVLPGKYKISIMHEDWCWKNKSLEVEVLEDDMSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVRALGQAASDNSGPEDAKRQAKKQKTRRTLRLQEEFQLTWCLVPWRGTLGIHLFSSLPFASEILLETTATCIHY

SEQ ID NO: 57519 - protein, 1222 aa, Homo sapiens; identical to SEQ ID NO: 57515
  Payload ID: 11287
  Gene Symbol: NOMO1
  Gene Name: NODAL modulator 1
  Uniprot ID: Q15155
  ENSP ID: ENSP00000482008

SEQ ID NO: 57520 - protein, 1100 aa, Homo sapiens
  Payload ID: 11287
  Gene Symbol: NOMO1
  Gene Name: NODAL modulator 1
  ENSP ID: ENSP00000483204
MARFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIIATGFSVCGQISIIRFPDTVKQMNKYKVVLSSQDKDKSLVTVETDAHGSFCFKAKPGTYKVQVMVPEAETRAGLTLKPQTFPLTVTNRPMMDVAFVQFLASVSGKVSCLDTCGDLLVTLQSLSRQGEKRSLQLSGKVNAMTFTFDNVLPGKYKISIMHEDWCWKNKSLEVEVLEDDMSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVRALGQAASDNSGPEDAKRQAKKQKTRRTLRLQEEFQLTWCLVPWRGTLGIHLFSSLPFASEILLETTATCIHY

SEQ ID NO: 57521 - protein, 1267 aa, Homo sapiens
  Payload ID: 11287
  Gene Symbol: NOMO1
  Gene Name: NODAL modulator 1
  ENSP ID: ENSP00000483827
MLVGQGAGPLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIIATGFSVCGQISIIRFPDTVKQMNKYKVVLSSQDKDKSLVTVETDAHGSFCFKAKPGTYKVQVMVPEAETRAGLTLKPQTFPLTVTNRPMMDVAFVQFLASVSGKVSCLDTCGDLLVTLQSLSRQGEKRSLQLSGKVNAMTFTFDNVLPGKYKISIMHEDWCWKNKSLEVEVLEDDMSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVRALGQAASDNSGPEDAKRQAKKQKTRRTLRLQGEFQLTWCLVPWRGTLGIHLFSSLPFASEILLETTATCIHY

SEQ ID NO: 57522 - protein, 144 aa, Homo sapiens; identical to SEQ ID NO: 57516
  Payload ID: 11287
  Gene Symbol: NOMO1
  Gene Name: NODAL modulator 1
  ENSP ID: ENSP00000487843
  MOD_RES (1)..(1): Any amino acid

SEQ ID NO: 57523 - protein, 1222 aa, Homo sapiens
  Payload ID: 11288
  Gene Symbol: NOMO2
  Gene Name: NODAL modulator 2
  Uniprot ID: Q5JPE7
  ENSP ID: ENSP00000331851
MLVGQGAGLLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGRISIIRFPDTVKQMNKYKVVLSSQDKDKSLVTVETDAHGSFCFKAKPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 57524 - protein, 1267 aa, Homo sapiens
  Payload ID: 11288
  Gene Symbol: NOMO2
  Gene Name: NODAL modulator 2
  Uniprot ID: Q5JPE7
  ENSP ID: ENSP00000370883
MLVGQGAGLLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGRISIIRFPDTVKQMNKYKVVLSSQDKDKSLVTVETDAHGSFCFKAKPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRTLRLQEEFQLMWCLVPWRGTLGIHLFSSLPFASEILLETTATCIHY

SEQ ID NO: 57525 - protein, 1100 aa, Homo sapiens
  Payload ID: 11288
  Gene Symbol: NOMO2
  Gene Name: NODAL modulator 2
  Uniprot ID: Q5JPE7
  ENSP ID: ENSP00000439970
MARFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGRISIIRFPDTVKQMNKYKVVLSSQDKDKSLVTVETDAHGSFCFKAKPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRTLRLQEEFQLMWCLVPWRGTLGIHLFSSLPFASEILLETTATCIHY

SEQ ID NO: 57526 - protein, 61 aa, Homo sapiens
  Payload ID: 11288
  Gene Symbol: NOMO2
  Gene Name: NODAL modulator 2
  ENSP ID: ENSP00000454412
MLVGQGAGLLGPAVVTAAVVLLLSGVGPAHGSEDIVVGCGGFVKSDVEINYSLIEQVLNMH

SEQ ID NO: 57527 - protein, 80 aa, Homo sapiens
  Payload ID: 11288
  Gene Symbol: NOMO2
  Gene Name: NODAL modulator 2
  ENSP ID: ENSP00000454780
  MOD_RES (1)..(1): Any amino acid
XTGYMLRCSLSHAITLVCTAYGVSYLEKRSPCGCQERLTSQEYCKRRNFIRMEMGVRMWGFITSPKESTDSACPSLVCTK

SEQ ID NO: 57528 - protein, 223 aa, Homo sapiens
  Payload ID: 11288
  Gene Symbol: NOMO2
  Gene Name: NODAL modulator 2
  ENSP ID: ENSP00000455456
  MOD_RES (1)..(1): Any amino acid
XSSQDKDKSLVTVETDAHGSFCFKAKPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLAQPYCSGEMCPGTSELKTPRNFIRMEMGVRMWGFITSPKESTDSACPSLVCTK

SEQ ID NO: 57529 - protein, 138 aa, Homo sapiens
  Payload ID: 11288
  Gene Symbol: NOMO2
  Gene Name: NODAL modulator 2
  ENSP ID: ENSP00000457351
MLVGQGAGLLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVCIF

SEQ ID NO: 57530 - protein, 1267 aa, Homo sapiens; identical to SEQ ID NO: 57524
  Payload ID: 11288
  Gene Symbol: NOMO2
  Gene Name: NODAL modulator 2
  Uniprot ID: Q5JPE7
  ENSP ID: ENSP00000477502

SEQ ID NO: 57531 - protein, 282 aa, Homo sapiens
  Payload ID: 11288
  Gene Symbol: NOMO2
  Gene Name: NODAL modulator 2
  ENSP ID: ENSP00000477774
MIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 57532 - protein, 1222 aa, Homo sapiens; identical to SEQ ID NO: 57523
  Payload ID: 11288
  Gene Symbol: NOMO2
  Gene Name: NODAL modulator 2
  Uniprot ID: Q5JPE7
  ENSP ID: ENSP00000478653

SEQ ID NO: 57533 - protein, 1267 aa, Homo sapiens
  Payload ID: 11289
  Gene Symbol: NOMO3
  Gene Name: NODAL modulator 3
  ENSP ID: ENSP00000263012
MLVGQGAGPLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRTLRLQEEFQLMWCLVPWRGTLGIHLFSSLPFASEILLETTATCIHY

SEQ ID NO: 57534 - protein, 1222 aa, Homo sapiens
  Payload ID: 11289
  Gene Symbol: NOMO3
  Gene Name: NODAL modulator 3
  Uniprot ID: P69849
  ENSP ID: ENSP00000382274
MLVGQGAGPLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVLSKGQPLGPAGVQVSLRNTGTEAKIQSTVTQPGGKFAFFKVLPGDYEILATHPTWALKEASTTVRVTNSNANAASPLIVAGYNVSGSVRSDGEPMKGVKFLLFSSLVTKEDVLGCNVSPVPGFQPQDESLVYLCYTVSREDGSFSFYSLPSGGYTVIPFYRGERITFDVAPSRLDFTVEHDSLKIEPVFHVMGFSVTGRVLNGPEGDGVPEAVVTLNNQIKVKTKADGSFRLENITTGTYTIHAQKEHLYFETVTIKIAPNTPQLADIVATGFSVCGQISIIRFPDTVKQMNKYKVVLSSQDKDKSLVTVETDAHGSFCFKANPGTYKVQVMVPEAETRAGLTLKPQTFPLTVTDRPVMDVAFVQFLASVSGKVSCLDTCGDLLVTLQSLSRQGEKRSLQLSGKVNAMTFTFDNVLPGKYKISIMHEDWCWKNKSLEVEVLEDDVSAVEFRQTGYMLRCSLSHAITLEFYQDGNGRENVGIYNLSKGVNRFCLSKPGVYKVTPRSCHRFEQAFYTYDTSSPSILTLTAIRHHVLGTITTDKMMDVTVTIKSSIDSEPALVLGPLKSVQELRREQQLAEIEARRQEREKNGNEEGEERMTKPPVQEMVDELQGPFSYDFSYWARSGEKITVTPSSKELLFYPPSMEAVVSGESCPGKLIEIHGKAGLFLEGQIHPELEGVEIVISEKGASSPLITVFTDDKGAYSVGPLHSDLEYTVTSQKEGYVLTAVEGTIGDFKAYALAGVSFEIKAEDDQPLPGVLLSLSGGLFRSNLLTQDNGILTFSNLSPGQYYFKPMMKEFRFEPSSQMIEVQEGQNLKITITGYRTAYSCYGTVSSLNGEPEQGVAMEAVGQNDCSIYGEDTVTDEEGKFRLRGLLPGCVYHVQLKAEGNDHIERALPHHRVIEVGNNDIDDVNIIVFRQINQFDLSGNVITSSEYLPTLWVKLYKSENLDNPIQTVSLGQSLFFHFPPLLRDGENYVVLLDSTLPRSQYDYILPQVSFTAVGYHKHITLIFNPTRKLPEQDIAQGSYIALPLTLLVLLAGYNHDKLIPLLLQLTSRLQGVGALGQAASDNSGPEDAKRQAKKQKTRRT

SEQ ID NO: 57535 - protein, 138 aa, Homo sapiens
  Payload ID: 11289
  Gene Symbol: NOMO3
  Gene Name: NODAL modulator 3
  ENSP ID: ENSP00000458267
MLVGQGAGPLGPAVVTAAVVLLLSGVGPAHGSEDIVVGCGGFVKSDVEINYSLIEIKLYTKHGTLKYQTDCAPNNGYFMIPLYDKGDFILKIEPPLGWSFEPTTVELHVDGVSDICTKGGDINFVFTGFSVNGKVCIF

SEQ ID NO: 57536 - protein, 95 aa, Homo sapiens
  Payload ID: 11289
  Gene Symbol: NOMO3
  Gene Name: NODAL modulator 3
  ENSP ID: ENSP00000458821
  MOD_RES (1)..(1): Any amino acid
XEDWCWKNKSLEVEVLEDDVSAVEFRQTGYMLRCSLSHAITLVQPYCSGEMCPGTSELKTPRNFIRMEMGVRMWGFITSPKESTDSACPSLVCTK

SEQ ID NO: 57537 - protein, 50 aa, Homo sapiens
  Payload ID: 11289
  Gene Symbol: NOMO3
  Gene Name: NODAL modulator 3
  ENSP ID: ENSP00000459996
  MOD_RES (1)..(1): Any amino acid
XSYIALPLTLLVLLAGYNHDKGHIRPGERPAHPWGLISKRPASFELKPTH

SEQ ID NO: 57538 - protein, 61 aa, Homo sapiens
  Payload ID: 11289
  Gene Symbol: NOMO3
  Gene Name: NODAL modulator 3
  ENSP ID: ENSP00000461721
MLVGQGAGPLGPAVVTAAVVLLLSGVGPAHGSEDIVVGCGGFVKSDVEINYSLIEQVLNMH

SEQ ID NO: 57539 - protein, 80 aa, Homo sapiens
  Payload ID: 11289
  Gene Symbol: NOMO3
  Gene Name: NODAL modulator 3
  ENSP ID: ENSP00000461870
  MOD_RES (1)..(1): Any amino acid
XTGYMLRCSLSHAITLVCTAYGVSYLEKRLPCGCQERLTSQEYCKRRNFIRMEMGVRMWGFITSPKESTDSACPSLVCTK

SEQ ID NO: 57540 - protein, 138 aa, Homo sapiens; identical to SEQ ID NO: 57535
  Payload ID: 11289
  Gene Symbol: NOMO3
  Gene Name: NODAL modulator 3
  ENSP ID: ENSP00000478494

SEQ ID NO: 57541 - protein, 1222 aa, Homo sapiens; identical to SEQ ID NO: 57534
  Payload ID: 11289
  Gene Symbol: NOMO3
  Gene Name: NODAL modulator 3
  Uniprot ID: P69849
  ENSP ID: ENSP00000483234

SEQ ID NO: 57542 - protein, 1267 aa, Homo sapiens; identical to SEQ ID NO: 57533
  Payload ID: 11289
  Gene Symbol: NOMO3
  Gene Name: NODAL modulator 3
  ENSP ID: ENSP00000484978

SEQ ID NO: 57543 - protein, 95 aa, Homo sapiens; identical to SEQ ID NO: 57536
  Payload ID: 11289
  Gene Symbol: NOMO3
  Gene Name: NODAL modulator 3
  ENSP ID: ENSP00000487733
  MOD_RES (1)..(1): Any amino acid

SEQ ID NO: 57544 - protein, 80 aa, Homo sapiens; identical to SEQ ID NO: 57539
  Payload ID: 11289
  Gene Symbol: NOMO3
  Gene Name: NODAL modulator 3
  ENSP ID: ENSP00000487889
  MOD_RES (1)..(1): Any amino acid

SEQ ID NO: 57545 - protein, 50 aa, Homo sapiens; identical to SEQ ID NO: 57537
  Payload ID: 11289
  Gene Symbol: NOMO3
  Gene Name: NODAL modulator 3
  ENSP ID: ENSP00000487910
  MOD_RES (1)..(1): Any amino acid

SEQ ID NO: 57546 - protein, 61 aa, Homo sapiens; identical to SEQ ID NO: 57538
  Payload ID: 11289
  Gene Symbol: NOMO3
  Gene Name: NODAL modulator 3
  ENSP ID: ENSP00000488449

SEQ ID NO: 57547 - protein, 232 aa, Homo sapiens
  Payload ID: 11290
  Gene Symbol: NOG
  Gene Name: noggin
  Uniprot ID: Q13253
  ENSP ID: ENSP00000328181
MERCPSLGVTLYALVVVLGLRATPAGGQHYLHIRPAPSDNLPLVDLIEHPDPIFDPKEKDLNETLLRSLLGGHYDPGFMATSPPEDRPGGGGGAAGGAEDLAELDQLLRQRPSGAMPSEIKGLEFSEGLAQGKKQRLSKKLRRKLQMWLWSQTFCPVLYAWNDLGSRFWPRYVKVGSCFSKRSCSVPEGMVCKPSKSVHLTVLRWRCQRRGGQRCGWIPIQYPIISECKCSC

SEQ ID NO: 57548 - protein, 329 aa, Homo sapiens
  Payload ID: 11291
  Gene Symbol: NIPA1
  Gene Name: non imprinted in Prader-Willi/Angelman syndrome 1
  Uniprot ID: Q7RTP0
  ENSP ID: ENSP00000337452
MGTAAAAAAAAAAAAAGEGARSPSPAAVSLGLGVAVVSSLVNGSTFVLQKKGIVRAKRRGTSYLTDIVWWAGTIAMAVGQIGNFLAYTAVPTVLVTPLGALGVPFGSILASYLLKEKLNILGKLGCLLSCAGSVVLIIHSPKSESVTTQAELEEKLTNPVFVGYLCIVLLMLLLLIFWIAPAHGPTNIMVYISICSLLGSFTVPSTKGIGLAAQDILHNNPSSQRALCLCLVLLAVLGCSIIVQFRYINKALECFDSSVFGAIYYVVFTTLVLLASAILFREWSNVGLVDFLGMACGFTTVSVGIVLIQVFKEFNFNLGEMNKSNMKTD

SEQ ID NO: 57549 - protein, 254 aa, Homo sapiens
  Payload ID: 11291
  Gene Symbol: NIPA1
  Gene Name: non imprinted in Prader-Willi/Angelman syndrome 1
  Uniprot ID: Q7RTP0
  ENSP ID: ENSP00000393962
MAVGQIGNFLAYTAVPTVLVTPLGALGVPFGSILASYLLKEKLNILGKLGCLLSCAGSVVLIIHSPKSESVTTQAELEEKLTNPVFVGYLCIVLLMLLLLIFWIAPAHGPTNIMVYISICSLLGSFTVPSTKGIGLAAQDILHNNPSSQRALCLCLVLLAVLGCSIIVQFRYINKALECFDSSVFGAIYYVVFTTLVLLASAILFREWSNVGLVDFLGMACGFTTVSVGIVLIQVFKEFNFNLGEMNKSNMKTD

SEQ ID NO: 57550 - protein, 90 aa, Homo sapiens
  Payload ID: 11291
  Gene Symbol: NIPA1
  Gene Name: non imprinted in Prader-Willi/Angelman syndrome 1
  ENSP ID: ENSP00000453286
  MOD_RES (1)..(1): Any amino acid
XSSLVNGSTFVLQKKGIVRAKRRGTSYLTDIVWWAGTIAMAVGQIGNFLAYTAVPTVLVTPLGALGVPFGQMPKSLQRSVSMMGVLKFTP

SEQ ID NO: 57551 - protein, 254 aa, Homo sapiens; identical to SEQ ID NO: 57549
  Payload ID: 11291
  Gene Symbol: NIPA1
  Gene Name: non imprinted in Prader-Willi/Angelman syndrome 1
  Uniprot ID: Q7RTP0
  ENSP ID: ENSP00000453722

SEQ ID NO: 57552 - protein, 58 aa, Homo sapiens
  Payload ID: 11291
  Gene Symbol: NIPA1
  Gene Name: non imprinted in Prader-Willi/Angelman syndrome 1
  ENSP ID: ENSP00000453797
IVRAKRRGTSYLTDIVWWAGTIAMAVGQIGNFLAYTAVPTVLVTPLGALGVPFGCYSL

SEQ ID NO: 57553 - protein, 360 aa, Homo sapiens
  Payload ID: 11292
  Gene Symbol: NIPA2
  Gene Name: non imprinted in Prader-Willi/Angelman syndrome 2
  Uniprot ID: Q8N8Q9
  ENSP ID: ENSP00000337618
MSQGRGKYDFYIGLGLAMSSSIFIGGSFILKKKGLLRLARKGSMRAGQGGHAYLKEWLWWAGLLSMGAGEVANFAAYAFAPATLVTPLGALSVLVSAILSSYFLNERLNLHGKIGCLLSILGSTVMVIHAPKEEEIETLNEMSHKLGDPGFVVFATLVVIVALILIFVVGPRHGQTNILVYITICSVIGAFSVSCVKGLGIAIKELFAGKPVLRHPLAWILLLSLIVCVSTQINYLNRALDIFNTSIVTPIYYVFFTTSVLTCSAILFKEWQDMPVDDVIGTLSGFFTIIVGIFLLHAFKDVSFSLASLPVSFRKDEKAMNGNLSNMYEVLNNNEESLTCGIEQHTGENVSRRNGNLTAF

SEQ ID NO: 57554 - protein, 341 aa, Homo sapiens
  Payload ID: 11292
  Gene Symbol: NIPA2
  Gene Name: non imprinted in Prader-Willi/Angelman syndrome 2
  Uniprot ID: Q8N8Q9
  ENSP ID: ENSP00000352762
MSQGRGKYDFYIGLGLAMSSSIFIGGSFILKKKGLLRLARKGSMRAVGAGEVANFAAYAFAPATLVTPLGALSVLVSAILSSYFLNERLNLHGKIGCLLSILGSTVMVIHAPKEEEIETLNEMSHKLGDPGFVVFATLVVIVALILIFVVGPRHGQTNILVYITICSVIGAFSVSCVKGLGIAIKELFAGKPVLRHPLAWILLLSLIVCVSTQINYLNRALDIFNTSIVTPIYYVFFTTSVLTCSAILFKEWQDMPVDDVIGTLSGFFTIIVGIFLLHAFKDVSFSLASLPVSFRKDEKAMNGNLSNMYEVLNNNEESLTCGIEQHTGENVSRRNGNLTAF

SEQ ID NO: 57555 - protein, 360 aa, Homo sapiens; identical to SEQ ID NO: 57553
  Payload ID: 11292
  Gene Symbol: NIPA2
  Gene Name: non imprinted in Prader-Willi/Angelman syndrome 2
  Uniprot ID: Q8N8Q9
  ENSP ID: ENSP00000381095

SEQ ID NO: 57556 - protein, 360 aa, Homo sapiens; identical to SEQ ID NO: 57553
  Payload ID: 11292
  Gene Symbol: NIPA2
  Gene Name: non imprinted in Prader-Willi/Angelman syndrome 2
  Uniprot ID: Q8N8Q9
  ENSP ID: ENSP00000381096

SEQ ID NO: 57557 - protein, 341 aa, Homo sapiens; identical to SEQ ID NO: 57554
  Payload ID: 11292
  Gene Symbol: NIPA2
  Gene Name: non imprinted in Prader-Willi/Angelman syndrome 2
  Uniprot ID: Q8N8Q9
  ENSP ID: ENSP00000437746

SEQ ID NO: 57558 - protein, 59 aa, Homo sapiens
  Payload ID: 11292
  Gene Symbol: NIPA2
  Gene Name: non imprinted in Prader-Willi/Angelman syndrome 2
  ENSP ID: ENSP00000453700
MSQGRGKYDFYIGLGLAMSSSIFIGGSFILKKKGLLRLARKGSMRAGQGGHAYLKEWLW

SEQ ID NO: 57559 - protein, 102 aa, Homo sapiens
  Payload ID: 11293
  Gene Symbol: NCMAP
  Gene Name: noncompact myelin associated protein
  Uniprot ID: Q5T1S8
  ENSP ID: ENSP00000363513
MTTATPLGDTTFFSLNMTTRGEDFLYKSSGAIVAAVVVVVIIIFTVVLILLKMYNRKMRTRRELEPKGPKPTAPSAVGPNSNGSQHPATVTFSPVDVQVETR

SEQ ID NO: 57560 - protein, 299 aa, Homo sapiens
  Payload ID: 11294
  Gene Symbol: NHEJ1
  Gene Name: nonhomologous end-joining factor 1
  Uniprot ID: Q9H9Q4
  ENSP ID: ENSP00000349313
MEELEQGLLMQPWAWLQLAENSLLAKVFITKQGYALLVSDLQQVWHEQVDTSVVSQRAKELNKRLTAPPAAFLCHLDNLLRPLLKDAAHPSEATFSCDCVADALILRVRSELSGLPFYWNFHCMLASPSLVSQHLIRPLMGMSLALQCQVRELATLLHMKDLEIQDYQESGATLIRDRLKTEPFEENSFLEQFMIEKLPEACSIGDGKPFVMNLQDLYMAVTTQEVQVGQKHQGAGDPHTSNSASLQGIDSQCVNQPEQLVSSAPTLSAPEKESTGTSGPLQRPQLSKVKRKKPRGLFS

SEQ ID NO: 57561 - protein, 316 aa, Homo sapiens
  Payload ID: 11294
  Gene Symbol: NHEJ1
  Gene Name: nonhomologous end-joining factor 1
  Uniprot ID: Q9H9Q4
  ENSP ID: ENSP00000387290
MEELEQGLLMQPWAWLQLAENSLLAKVFITKQGYALLVSDLQQVWHEQVDTSVVSQRAKELNKRLTAPPAAFLCHLDNLLRPLLKDAAHPSEATFSCDCVADALILRVRSELSGLPFYWNFHCMLASPSLVSQHLIRPLMGMSLALQCQVRELATLLHMKDLEIQDYQESGATLIRDRLKTEPFEENSFLEQFMIEKLPEACSIGDGKPFVMNLQDLYMAVTTQEVQVGQKHQGAGDPHTSNSASLQGIDSQCVNQPEQLVSSAPTLSAPEKESTALCRDLSCQRSRGRSQGVSSVNLLWPQLLRMDLENSFQASP

SEQ ID NO: 57562 - protein, 224 aa, Homo sapiens
  Payload ID: 11294
  Gene Symbol: NHEJ1
  Gene Name: nonhomologous end-joining factor 1
  ENSP ID: ENSP00000394896
RPLLKDAAHPSEATFSCDCVADALILRVRSELSGLPFYWNFHCMLASPSLVSQHLIRPLMGMSLALQCQVRELATLLHMKDLEIQDYQESGATLIRDRLKTEPFEENSFLEQFMIEKLPEACSIGDGKPFVMNLQDLYMAVTTQEVQVGQKHQGAGEPSRGDPHTSNSASLQGIDSQCVNQPEQLVSSAPTLSAPEKESTGTSGPLQRPQLSKVKRKKPRGLFS

SEQ ID NO: 57563 - protein, 229 aa, Homo sapiens
  Payload ID: 11294
  Gene Symbol: NHEJ1
  Gene Name: nonhomologous end-joining factor 1
  ENSP ID: ENSP00000407201
MEELEQGLLMQPWAWLQLAENSLLAKVFITKQGYALLVSDLQQVWHEQVDTSVVSQRAKELNKRLTAPPAAFLCHLDNLLRPLLKDAAHPSEATFSCDCVADALILRVRSELSGLPFYWNFHCMLASPSLVSQHLIRPLMGMSLALQCQVRELATLLHMKDLEIQDYQESGATLIRDRLKTEPFEENSFLEQFMIEKLPEACSIGDGKPFVMNLQDLYMAVTTQEVQVG

SEQ ID NO: 57564 - protein, 50 aa, Homo sapiens
  Payload ID: 11294
  Gene Symbol: NHEJ1
  Gene Name: nonhomologous end-joining factor 1
  ENSP ID: ENSP00000408421
MEELEQGLLMQPWAWLQLAENSLLAKVFITKQGYALLVSDLQQVWHEQMH

SEQ ID NO: 57565 - protein, 232 aa, Homo sapiens
  Payload ID: 11294
  Gene Symbol: NHEJ1
  Gene Name: nonhomologous end-joining factor 1
  ENSP ID: ENSP00000408966
MEELEQGLLMQPWAWLQLAENSLLAKVFITKQGYALLVSDLQQVWHEQVDTSVVSQRAKELNKRLTAPPAAFLCHLDNLLRPLLKDAAHPSEATFSCDCVADALILRVRSELSGLPFYWNFHCMLASPSLVSQHLIRPLMGMSLALQCQVRELATLLHMKDLEIQDYQESGATLIRDRLKTEPFEENSFLEQFMIELKDIPIKTGDPAYWPRTLHAASVSFYHETARGMQHW

SEQ ID NO: 57566 - protein, 471 aa, Homo sapiens
  Payload ID: 11295
  Gene Symbol: NONO
  Gene Name: non-POU domain containing, octamer-binding
  Uniprot ID: Q15233
  ENSP ID: ENSP00000276079
MQSNKTFNLEKQNHTPRKHHQHHHQQQHHQQQQQQPPPPPIPANGQQASSQNEGLTIDLKNFRKPGEKTFTQRSRLFVGNLPPDITEEEMRKLFEKYGKAGEVFIHKDKGFGFIRLETRTLAEIAKVELDNMPLRGKQLRVRFACHSASLTVRNLPQYVSNELLEEAFSVFGQVERAVVIVDDRGRPSGKGIVEFSGKPAARKALDRCSEGSFLLTTFPRPVTVEPMDQLDDEEGLPEKLVIKNQQFHKEREQPPRFAQPGSFEYEYAMRWKALIEMEKQQQDQVDRNIKEAREKLEMEMEAARHEHQVMLMRQDLMRRQEELRRMEELHNQEVQKRKQLELRQEEERRRREEEMRRQQEEMMRRQQEGFKGTFPDAREQEIRMGQMAMGGAMGINNRGAMPPAPVPAGTPAPPGPATMMPDGTLGLTPPTTERFGQAATMEGIGAIGGTPPAFNRAAPGAEFAPNKRRRY

SEQ ID NO: 57567 - protein, 471 aa, Homo sapiens; identical to SEQ ID NO: 57566
  Payload ID: 11295
  Gene Symbol: NONO
  Gene Name: non-POU domain containing, octamer-binding
  Uniprot ID: Q15233
  ENSP ID: ENSP00000362947

SEQ ID NO: 57568 - protein, 471 aa, Homo sapiens; identical to SEQ ID NO: 57566
  Payload ID: 11295
  Gene Symbol: NONO
  Gene Name: non-POU domain containing, octamer-binding
  Uniprot ID: Q15233
  ENSP ID: ENSP00000362963

SEQ ID NO: 57569 - protein, 207 aa, Homo sapiens
  Payload ID: 11295
  Gene Symbol: NONO
  Gene Name: non-POU domain containing, octamer-binding
  ENSP ID: ENSP00000406673
MQSNKTFNLEKQNHTPRKHHQHHHQQQHHQQQQQQPPPPPIPANGQQASSQNEGLTIDLKNFRKPGEKTFTQRSRLFVGNLPPDITEEEMRKLFEKYGKAGEVFIHKDKGFGFIRLETRTLAEIAKVELDNMPLRGKQLRVRFACHSASLTVRNLPQYVSNELLEEAFSVFGQVERAVVIVDDRGRPSGKGIVEFSGKPAARKALDR

SEQ ID NO: 57570 - protein, 234 aa, Homo sapiens
  Payload ID: 11295
  Gene Symbol: NONO
  Gene Name: non-POU domain containing, octamer-binding
  ENSP ID: ENSP00000409773
  MOD_RES (1)..(1): Any amino acid
XPDITEEEMRKLFEKYGKAGEVFIHKDKGFGFIRLVERAVVIVDDRGRPSGKGIVEFSGKPAARKALDRCSEGSFLLTTFPRPVTVEPMDQLDDEEGLPEKLVIKNQQFHKEREQPPRFAQPGSFEYEYAMRWKALIEMEKQQQDQVDRNIKEAREKLEMEMEAARHEHQVMLMRQDLMRRQEELRRMEELHNQEVQKRKQLELRQEEERRRREEEMRRQQEEMMRRQQEGFKG

SEQ ID NO: 57571 - protein, 124 aa, Homo sapiens
  Payload ID: 11295
  Gene Symbol: NONO
  Gene Name: non-POU domain containing, octamer-binding
  ENSP ID: ENSP00000410299
MQSNKTFNLEKQNHTPRKHHQHHHQQQHHQQQQQQPPPPPIPANGQQASSQNEGLTIDLKNFRKPGEKTFTQRSRLFVGNLPPDITEEEMRKLFEKYGKETRTLAEIAKVELDNMPLRGKQLRV

SEQ ID NO: 57572 - protein, 247 aa, Homo sapiens
  Payload ID: 11295
  Gene Symbol: NONO
  Gene Name: non-POU domain containing, octamer-binding
  ENSP ID: ENSP00000413350
MQSNKTFNLEKQNHTPRKHHQHHHQQQHHQQQQQQPPPPPIPANGQQASSQNEGLTIDLKNFRKPGEKTFTQRSRLFVGNLPPDITEEEMRKLFEKYGKAGEVFIHKDKGFGFIRLETRTLAEIAKVELDNMPLRGKQLRVRFACHSASLTVRNLPQEREQPPRFAQPGSFEYEYAMRWKALIEMEKQQQDQVDRNIKEAREKLEMEMEAARHEHQVMLMRQDLMRRQEELRRMEELHNQEVQKRKQ

SEQ ID NO: 57573 - protein, 65 aa, Homo sapiens
  Payload ID: 11295
  Gene Symbol: NONO
  Gene Name: non-POU domain containing, octamer-binding
  ENSP ID: ENSP00000415777
MQSNKTFNLEKQNHTPRKHHQHHHQQQHHQQQQQQPPPPPIPANGQQASSQNEGLTIDLKNFRKP

SEQ ID NO: 57574 - protein, 382 aa, Homo sapiens
  Payload ID: 11295
  Gene Symbol: NONO
  Gene Name: non-POU domain containing, octamer-binding
  Uniprot ID: Q15233
  ENSP ID: ENSP00000441364
MRKLFEKYGKAGEVFIHKDKGFGFIRLETRTLAEIAKVELDNMPLRGKQLRVRFACHSASLTVRNLPQYVSNELLEEAFSVFGQVERAVVIVDDRGRPSGKGIVEFSGKPAARKALDRCSEGSFLLTTFPRPVTVEPMDQLDDEEGLPEKLVIKNQQFHKEREQPPRFAQPGSFEYEYAMRWKALIEMEKQQQDQVDRNIKEAREKLEMEMEAARHEHQVMLMRQDLMRRQEELRRMEELHNQEVQKRKQLELRQEEERRRREEEMRRQQEEMMRRQQEGFKGTFPDAREQEIRMGQMAMGGAMGINNRGAMPPAPVPAGTPAPPGPATMMPDGTLGLTPPTTERFGQAATMEGIGAIGGTPPAFNRAAPGAEFAPNKRRRY

SEQ ID NO: 57575 - protein, 1401 aa, Homo sapiens
  Payload ID: 11296
  Gene Symbol: NCAPD2
  Gene Name: non-SMC condensin I complex, subunit D2
  Uniprot ID: Q15021
  ENSP ID: ENSP00000325017
MAPQMYEFHLPLSPEELLKSGGVNQYVVQEVLSIKHLPPQLRAFQAAFRAQGPLAMLQHFDTIYSILHHFRSIDPGLKEDTLQFLIKVVSRHSQELPAILDDTTLSGSDRNAHLNALKMNCYALIRLLESFETMASQTNLVDLDLGGKGKKARTKAAHGFDWEEERQPILQLLTQLLQLDIRHLWNHSIIEEEFVSLVTGCCYRLLENPTINHQKNRPTREAITHLLGVALTRYNHMLSATVKIIQMLQHFEHLAPVLVAAVSLWATDYGMKSIVGEIVREIGQKCPQELSRDPSGTKGFAAFLTELAERVPAILMSSMCILLDHLDGENYMMRNAVLAAMAEMVLQVLSGDQLEAAARDTRDQFLDTLQAHGHDVNSFVRSRVLQLFTRIVQQKALPLTRFQAVVALAVGRLADKSVLVCKNAIQLLASFLANNPFSCKLSDADLAGPLQKETQKLQEMRAQRRTAAASAVLDPEEEWEAMLPELKSTLQQLLQLPQGEEEIPEQIANTETTEDVKGRIYQLLAKASYKKAIILTREATGHFQESEPFSHIDPEESEETRLLNILGLIFKGPAASTQEKNPRESTGNMVTGQTVCKNKPNMSDPEESRGNDELVKQEMLVQYLQDAYSFSRKITEAIGIISKMMYENTTTVVQEVIEFFVMVFQFGVPQALFGVRRMLPLIWSKEPGVREAVLNAYRQLYLNPKGDSARAKAQALIQNLSLLLVDASVGTIQCLEEILCEFVQKDELKPAVTQLLWERATEKVACCPLERCSSVMLLGMMARGKPEIVGSNLDTLVSIGLDEKFPQDYRLAQQVCHAIANISDRRKPSLGKRHPPFRLPQEHRLFERLRETVTKGFVHPDPLWIPFKEVAVTLIYQLAEGPEVICAQILQGCAKQALEKLEEKRTSQEDPKESPAMLPTFLLMNLLSLAGDVALQQLVHLEQAVSGELCRRRVLREEQEHKTKDPKEKNTSSETTMEEELGLVGATADDTEAELIRGICEMELLDGKQTLAAFVPLLLKVCNNPGLYSNPDLSAAASLALGKFCMISATFCDSQLRLLFTMLEKSPLPIVRSNLMVATGDLAIRFPNLVDPWTPHLYARLRDPAQQVRKTAGLVMTHLILKDMVKVKGQVSEMAVLLIDPEPQIAALAKNFFNELSHKGNAIYNLLPDIISRLSDPELGVEEEPFHTIMKQLLSYITKDKQTESLVEKLCQRFRTSRTERQQRDLAYCVSQLPLTERGLRKMLDNFDCFGDKLSDESIFSAFLSVVGKLRRGAKPEGKAIIDEFEQKLRACHTRGLDGIKELEIGQAGSQRAPSAKKPSTGSRYQPLASTASDNDFVTPEPRRTTRRHPNTQQRASKKKPKVVFSSDESSEEDLSAEMTEDETPKKTTPILRASARRHRS

SEQ ID NO: 57576 - protein, 919 aa, Homo sapiens
  Payload ID: 11296
  Gene Symbol: NCAPD2
  Gene Name: non-SMC condensin I complex, subunit D2
  ENSP ID: ENSP00000371895
MAPQMYEFHLPLSPEELLKSGGVNQYVVQEVLSIKHLPPQLRAFQAAFRAQGPLAMLQHFDTIYSILHLVTGCCYRLLENPTINHQKNRPTREAITHLLGVALTRYNHMLSATVKIIQMLQHFEHLAPVLVAAVSLWATDYGMKSIVGEIVREIGQKCPQELSRDPSGTKGFAAFLTELAERVPAILMSSMCILLDHLDGENYMMRNAVLAAMAEMVLQVLSGDQLEAAARDTRDQFLDTLQAHGHDVNSFVRSRVLQLFTRIVQQKALPLTRFQAVVALAVGRLADKSVLVCKNAIQLLASFLANNPFSCKLSDADLAGPLQKETQKLQEMRAQRRTAAASAVLDPEEEWEAMLPELKSTLQQLLQLPQGEEEIPEQIANTETTEDVKGRIYQLLAKASYKKAIILTREATGHFQESEPFSHIDPEESEETRLLNILGLIFKGPAASTQEKNPRESTGNMVTGQTVCKNKPNMSDPEESRGNDELVKQEMLVQYLQDAYSFSRKITEAIGIISKMMYENTTTVVQEVIEFFVMVFQFGVPQALFGVRRMLPLIWSKEPGVREAVLNAYRQLYLNPKGDSARAKAQALIQNLSLLLVDASVGTIQCLEEILCEFVQKDELKPAVTQLLWERATEKVACCPLERCSSVMLLGMMARGKPEIVGSNLDTLVSIGLDEKFPQDYRLAQQVCHAIANISDRRKPSLGKRHPPFRLPQEHRLFERLRETVTKGFVHPDPLWIPFKEVAVTLIYQLAEGPEVICAQILQGCAKQALEKLEEKRTSQEDPKESPAMLPTFLLMNLLSLAGDVALQQLVHLEQAVSGELCRRRVLREEQEHKTKDPKEKNTSSETTMEEELGLVGATADDTEAELIRGICEMELLDGKQTLAAFVPLLLKVCNNPGLYSNPDLSAAASLALGKFCMI

SEQ ID NO: 57577 - protein, 81 aa, Homo sapiens
  Payload ID: 11296
  Gene Symbol: NCAPD2
  Gene Name: non-SMC condensin I complex, subunit D2
  ENSP ID: ENSP00000438495
MAPQMYEFHLPLSPEELLKSGGVNQYVVQEVLSIKHLPPQLRAFQAAFRAQGPLAMLQHFDTIYSILHGIPPLPGASSYPG

SEQ ID NO: 57578 - protein, 118 aa, Homo sapiens
  Payload ID: 11296
  Gene Symbol: NCAPD2
  Gene Name: non-SMC condensin I complex, subunit D2
  ENSP ID: ENSP00000444377
MAPQMYEFHLPLSPEELLKSGGVNQYVVQEVLSIKHLPPQLRAFQAAFRAQGPLAMLQHFDTIYSILHHFRSIDPGLKEDTLQFLIKVVSRHSQELPAILDDTTLSGSDRNAHLNALK

SEQ ID NO: 57579 - protein, 1015 aa, Homo sapiens
  Payload ID: 11297
  Gene Symbol: NCAPG
  Gene Name: non-SMC condensin I complex, subunit G
  Uniprot ID: Q9BPX3
  ENSP ID: ENSP00000251496
MGAERRLLSIKEAFRLAQQPHQNQAKLVVALSRTYRTMDDKTVFHEEFIHYLKYVMVVYKREPAVERVIEFAAKFVTSFHQSDMEDDEEEEDGGLLNYLFTFLLKSHEANSNAVRFRVCLLINKLLGSMPENAQIDDDVFDKINKAMLIRLKDKIPNVRIQAVLALSRLQDPKDDECPVVNAYATLIENDSNPEVRRAVLSCIAPSAKTLPKIVGRTKDVKEAVRKLAYQVLAEKVHMRAMSIAQRVMLLQQGLNDRSDAVKQAMQKHLLQGWLRFSEGNILELLHRLDVENSSEVAVSVLNALFSITPLSELVGLCKNNDGRKLIPVETLTPEIALYWCALCEYLKSKGDEGEEFLEQILPEPVVYADYLLSYIQSIPVVNEEHRGDFSYIGNLMTKEFIGQQLILIIKSLDTSEEGGRKKLLAVLQEILILPTIPISLVSFLVERLLHIIIDDNKRTQIVTEIISEIRAPIVTVGVNNDPADVRKKELKMAEIKVKLIEAKEALENCITLQDFNRASELKEEIKALEDARINLLKETEQLEIKEVHIEKNDAETLQKCLILCYELLKQMSISTGLSATMNGIIESLILPGIISIHPVVRNLAVLCLGCCGLQNQDFARKHFVLLLQVLQIDDVTIKISALKAIFDQLMTFGIEPFKTKKIKTLHCEGTEINSDDEQESKEVEETATAKNVLKLLSDFLDSEVSELRTGAAEGLAKLMFSGLLVSSRILSRLILLWYNPVTEEDVQLRHCLGVFFPVFAYASRTNQECFEEAFLPTLQTLANAPASSPLAEIDITNVAELLVDLTRPSGLNPQAKTSQDYQALTVHDNLAMKICNEILTSPCSPEIRVYTKALSSLELSSHLAKDLLVLLNEILEQVKDRTCLRALEKIKIQLEKGNKEFGDQAEAAQDATLTTTTFQNEDEKNKEVYMTPLRGVKATQASKSTQLKTNRGQRKVTVSARTNRRCQTAEADSESDHEVPEPESEMKMRLPRRAKTAALEKSKLNLAQFLNEDLS

SEQ ID NO: 57580 - protein, 232 aa, Homo sapiens
  Payload ID: 11297
  Gene Symbol: NCAPG
  Gene Name: non-SMC condensin I complex, subunit G
  ENSP ID: ENSP00000423042
MGAERRLLSIKEAFRLAQQPHQNQAKLVVALSRTYRTMDDKTVFHEEFIHYLKYVMVVYKREPAVERVIEFAAKFVTSFHQSDMEDDEEEEDGGLLNYLFTFLLKSHEANSNAVRFRVCLLINKLLGSMPENAQIDDDVFDKINKAMLIRLKDKIPNVRIQAVLALSRLQDPKDDECPVVNAYATLIENDSNPEVRRAVLSCIAPSAKTLPKIVGRTKDVKEAVRKLAYQML

SEQ ID NO: 57581 - protein, 269 aa, Homo sapiens
  Payload ID: 11297
  Gene Symbol: NCAPG
  Gene Name: non-SMC condensin I complex, subunit G
  ENSP ID: ENSP00000425625
ISLVSFLVERLLHIIIDDNKRTQIVTEIISEIRAPIVTVGVNNDPADVRKKELKMAEIKVKLIEAKEALENCITLQDFNRASELKEEIKALEDARINLLKETEQLEIKEVHIEKVQNDAETLQKCLILCYELLKQMSISTGLSATMNGIIESLILPGIISIHPVVRNLAVLCLGCCGLQNQDFARKHFVLLLQVLQIDDVTIKISALKAIFDQLMTFGIEPFKTKKIKTLHCEGTEINSDDEQESKEVEETATAKNVLKLLSDFLDSEV

SEQ ID NO: 57582 - protein, 741 aa, Homo sapiens
  Payload ID: 11298
  Gene Symbol: NCAPH
  Gene Name: non-SMC condensin I complex, subunit H
  Uniprot ID: Q15003
  ENSP ID: ENSP00000240423
MGPPGPALPATMNNSSSETRGHPHSASSPSERVFPMPLPRKAPLNIPGTPVLEDFPQNDDEKERLQRRRSRVFDLQFSTDSPRLLASPSSRSIDISATIPKFTNTQITEHYSTCIKLSTENKITTKNAFGLHLIDFMSEILKQKDTEPTNFKVAAGTLDASTKIYAVRVDAVHADVYRVLGGLGKDAPSLEEVEGHVADGSATEMGTTKKAVKPKKKHLHRTIEQNINNLNVSEADRKCEIDPMFQKTAASFDECSTAGVFLSTLHCQDYRSELLFPSDVQTLSTGEPLELPELGCVEMTDLKAPLQQCAEDRQICPSLAGFQFTQWDSETHNESVSALVDKFKKNDQVFDINAEVDESDCGDFPDGSLGDDFDANDEPDHTAVGDHEEFRSWKEPCQVQSCQEEMISLGDGDIRTMCPLLSMKPGEYSYFSPRTMSMWAGPDHWRFRPRRKQDAPSQSENKKKSTKKDFEIDFEDDIDFDVYFRKTKAATILTKSTLENQNWRATTLPTDFNYNVDTLVQLHLKPGTRLLKMAQGHRVETEHYEEIEDYDYNNPNDTSNFCPGLQAADSDDEDLDDLFVGPVGNSDLSPYPCHPPKTAQQNGDTPEAQGLDITTYGESNLVAEPQKVNKIEIHYAKTAKKMDMKKLKQSMWSLLTALSGKEADAEANHREAGKEAALAEVADEKMLSGLTKDLQRSLPPVMAQNLSIPLAFACLLHLANEKNLKLEGTEDLSDVLVRQGD

SEQ ID NO: 57583 - protein, 605 aa, Homo sapiens
  Payload ID: 11298
  Gene Symbol: NCAPH
  Gene Name: non-SMC condensin I complex, subunit H
  Uniprot ID: Q15003
  ENSP ID: ENSP00000400774
MSEILKQKDTEPTNFKVAAGTLDASTKIYAVRVDAVHADVYRVLGGLGKDAPSLEEVEGHVADGSATEMGTTKKAVKPKKKHLHRTIEQNINNLNVSEADRKCEIDPMFQKTAASFDECSTAGVFLSTLHCQDYRSELLFPSDVQTLSTGEPLELPELGCVEMTDLKAPLQQCAEDRQICPSLAGFQFTQWDSETHNESVSALVDKFKKNDQVFDINAEVDESDCGDFPDGSLGDDFDANDEPDHTAVGDHEEFRSWKEPCQVQSCQEEMISLGDGDIRTMCPLLSMKPGEYSYFSPRTMSMWAGPDHWRFRPRRKQDAPSQSENKKKSTKKDFEIDFEDDIDFDVYFRKTKAATILTKSTLENQNWRATTLPTDFNYNVDTLVQLHLKPGTRLLKMAQGHRVETEHYEEIEDYDYNNPNDTSNFCPGLQAADSDDEDLDDLFVGPVGNSDLSPYPCHPPKTAQQNGDTPEAQGLDITTYGESNLVAEPQKVNKIEIHYAKTAKKMDMKKLKQSMWSLLTALSGKEADAEANHREAGKEAALAEVADEKMLSGLTKDLQRSLPPVMAQNLSIPLAFACLLHLANEKNLKLEGTEDLSDVLVRQGD

SEQ ID NO: 57584 - protein, 216 aa, Homo sapiens
  Payload ID: 11298
  Gene Symbol: NCAPH
  Gene Name: non-SMC condensin I complex, subunit H
  ENSP ID: ENSP00000401227
MGPPGPALPATMNNSSSETRGHPHSASSPSERVFPMPLPRKAPLNIPGTPVLEDFPQNDDEKERLQRRRSRVFDLQFSTDSPRLLASPSSRSIDISATIPKFTNTQITEHYSTCIKLSTENIDPMFQKTAASFDECSTAGVFLSTLHCQDYRSELLFPSDVQTLSTGEPLELPELGCVEMTDLKAPLQQCAEDRQICPSLAGFQFTQWDSETHNEV

SEQ ID NO: 57585 - protein, 607 aa, Homo sapiens
  Payload ID: 11298
  Gene Symbol: NCAPH
  Gene Name: non-SMC condensin I complex, subunit H
  ENSP ID: ENSP00000405237
MGPPGPETRGHPHSASSPSERVFPMPLPRKAPLNIPGTPVLEDFPQNDDEKERLQRRRSRVFDLQFSTDSPRLLASPSSRSIDISATIPKFTNTQITEHYSTCIKLSTENKITTKNAFGLHLIDFMSEILKQKDTEPTNFKVAAGTLDASTKIYAVRVDAVHADVYRVLGGLGKDAPSLEEVEGHVADGSATEMGTTKKAVKPKKKHLHRTIEQNINNLNVSEADRKCEIDPMFQKTAASFDECSTAGVFLSTLHCQDYRSELLFPSDVQTLSTGEPLELPELGCVEMTDLKAPLQQCAEDRQICPSLAGFQFTQWDSETHNESVSALVDKFKKNDQVFDINAEVDESDCGDFPDGSLGDDFDANDEPDHTAVGDHEEFRSWKEPCQVQSCQEEMISLGDGDIRTMCPLLSMKPGEYSYFSPRTMSMWAGPDHWRFRPRRKQDAPSQSENKKKSTKKDFEIDFEDDIDFDVYFRKTKAATILTKSTLENQNWRATTLPTDFNYNVDTLVQLHLKPGTRLLKMAQGHRVETEHYEEIEDYDYNNPNDTSNFCPGLQAADSDDEDLDDLFVGPVGNSDLSPYPCHPPKTAQQNGDTPEAQGLDITTYGE

SEQ ID NO: 57586 - protein, 730 aa, Homo sapiens
  Payload ID: 11298
  Gene Symbol: NCAPH
  Gene Name: non-SMC condensin I complex, subunit H
  ENSP ID: ENSP00000407308
MNNSSSETRGHPHSASSPSERVFPMPLPRKAPLNIPGTPVLEDFPQNDDEKERLQRRRSRVFDLQFSTDSPRLLASPSSRSIDISATIPKFTNTQITEHYSTCIKLSTENKITTKNAFGLHLIDFMSEILKQKDTEPTNFKVAAGTLDASTKIYAVRVDAVHADVYRVLGGLGKDAPSLEEVEGHVADGSATEMGTTKKAVKPKKKHLHRTIEQNINNLNVSEADRKCEIDPMFQKTAASFDECSTAGVFLSTLHCQDYRSELLFPSDVQTLSTGEPLELPELGCVEMTDLKAPLQQCAEDRQICPSLAGFQFTQWDSETHNESVSALVDKFKKNDQVFDINAEVDESDCGDFPDGSLGDDFDANDEPDHTAVGDHEEFRSWKEPCQVQSCQEEMISLGDGDIRTMCPLLSMKPGEYSYFSPRTMSMWAGPDHWRFRPRRKQDAPSQSENKKKSTKKDFEIDFEDDIDFDVYFRKTKAATILTKSTLENQNWRATTLPTDFNYNVDTLVQLHLKPGTRLLKMAQGHRVETEHYEEIEDYDYNNPNDTSNFCPGLQAADSDDEDLDDLFVGPVGNSDLSPYPCHPPKTAQQNGDTPEAQGLDITTYGESNLVAEPQKVNKIEIHYAKTAKKMDMKKLKQSMWSLLTALSGKEADAEANHREAGKEAALAEVADEKMLSGLTKDLQRSLPPVMAQNLSIPLAFACLLHLANEKNLKLEGTEDLSDVLVRQGD

SEQ ID NO: 57587 - protein, 182 aa, Homo sapiens
  Payload ID: 11298
  Gene Symbol: NCAPH
  Gene Name: non-SMC condensin I complex, subunit H
  ENSP ID: ENSP00000415162
  MOD_RES (1)..(1): Any amino acid
XLLKMAQGHRVETEHYEEIEDYDYNNPNDTSNFCPGLQTAQQNGDTPEAQGLDITTYGESNLVAEPQKVNKIEIHYAKTAKKMDMKKLKQSMWSLLTALSGKEADAEANHREAGKEAALAEVADEKMLSGLTKDLQRSLPPVMAQNLSIPLAFACLLHLANEKNLKLEGTEDLSDVLVRQGD

SEQ ID NO: 57588 - protein, 75 aa, Homo sapiens
  Payload ID: 11299
  Gene Symbol: NCAPD3
  Gene Name: non-SMC condensin II complex, subunit D3
  ENSP ID: ENSP00000431413
MVALRGLGSGLQPWCPLDLRLEWVDTVWELDFTETEPLDPSIEAEIIETGLAAFTKLYESLLPFATGEHGSMEAV

SEQ ID NO: 57589 - protein, 35 aa, Homo sapiens
  Payload ID: 11299
  Gene Symbol: NCAPD3
  Gene Name: non-SMC condensin II complex, subunit D3
  ENSP ID: ENSP00000431436
MVALRGLGSGLQPWCPLDLRLEWVDTVWELDFTET

SEQ ID NO: 57590 - protein, 832 aa, Homo sapiens
  Payload ID: 11299
  Gene Symbol: NCAPD3
  Gene Name: non-SMC condensin II complex, subunit D3
  ENSP ID: ENSP00000431612
MVALRGLGSGLQPWCPLDLRLEWVDTVWELDFTETEPLDPSIEAEIIETGLAAFTKLYESLLPFATGEHGSMESIWTFFIENNVSHSTLVALFYHFVQIVHKKNVSVQYREYGLHAAGLYFLLLEVPGSVANQVFHPVMFDKCIQTLKKSWPQESNLNRKRKKEQPKSSQANPGRHRKRGKPPRREDIEMDEIIEEQEDENICFSARDLSQIRNAIFHLLKNFLRLLPKFSLKEKPQCVQNCIEVFVSLTNFEPVLHECHVTQARALNQAKYIPELAYYGLYLLCSPIHGEGDKVISCVFHQMLSVILMLEVGEGSHRAPLAVTSQVINCRNQAVQFISALVDELKESIFPVVRILLQHICAKVVDKSEYRTFAAQSLVQLLSKLPCGEYAMFIAWLYKYSRSSKIPHRVFTLDVVLALLELPEREVDNTLSLEHQKFLKHKFLVQEIMFDRCLDKAPTVRSKALSSFAHCLELTVTSASESILELLINSPTFSVIESHPGTLLRNSSAFSYQRQTSNRSEPSGEINIDSSGETVGSGERCVMAMLRRRIRDEKTNVRKSALQVLVSILKHCDVSGMKEDLWILQDQCRDPAVSVRKQALQSLTELLMAQPRCVQIQKAWLRGVVPVVMDCESTVQEKALEFLDQLLLQNIRHHSHFHSGDDSQVLAWALLTLLTTESQELSRYLNKAFHIWSKKEKFSPTFINNVISHTGTEHSAPAWMLLSKIAGSSPRLDYSRIIQSWEKISSQQNPNSNTLGHILCVIGHIAKHLPKSTRDKVTDAVKCKLNGFQWSLEVISSAVDALQRLCRASAETPAEEQHWLEKESCVQRAVRA

SEQ ID NO: 57591 - protein, 194 aa, Homo sapiens
  Payload ID: 11299
  Gene Symbol: NCAPD3
  Gene Name: non-SMC condensin II complex, subunit D3
  ENSP ID: ENSP00000432532
MAPQLWELHLLSGPEHFSEAHVFLSLCLSACFADGILPLDLDASELLSDTFEVLSSKEIKLLAMRSKPDKDLLMEEDDMALANVVMQEAQKKLISQVQKRNFIENIIPIIISLKTVLEKNKIPALRELMHYLREVMQDYRDELKDFFAVDKQLASELEYDMKKYQEQLVQEQELAKHADVAGTAGGAEVAPVAQ

SEQ ID NO: 57592 - protein, 1498 aa, Homo sapiens
  Payload ID: 11299
  Gene Symbol: NCAPD3
  Gene Name: non-SMC condensin II complex, subunit D3
  Uniprot ID: P42695
  ENSP ID: ENSP00000433681
MVALRGLGSGLQPWCPLDLRLEWVDTVWELDFTETEPLDPSIEAEIIETGLAAFTKLYESLLPFATGEHGSMESIWTFFIENNVSHSTLVALFYHFVQIVHKKNVSVQYREYGLHAAGLYFLLLEVPGSVANQVFHPVMFDKCIQTLKKSWPQESNLNRKRKKEQPKSSQANPGRHRKRGKPPRREDIEMDEIIEEQEDENICFSARDLSQIRNAIFHLLKNFLRLLPKFSLKEKPQCVQNCIEVFVSLTNFEPVLHECHVTQARALNQAKYIPELAYYGLYLLCSPIHGEGDKVISCVFHQMLSVILMLEVGEGSHRAPLAVTSQVINCRNQAVQFISALVDELKESIFPVVRILLQHICAKVVDKSEYRTFAAQSLVQLLSKLPCGEYAMFIAWLYKYSRSSKIPHRVFTLDVVLALLELPEREVDNTLSLEHQKFLKHKFLVQEIMFDRCLDKAPTVRSKALSSFAHCLELTVTSASESILELLINSPTFSVIESHPGTLLRNSSAFSYQRQTSNRSEPSGEINIDSSGETVGSGERCVMAMLRRRIRDEKTNVRKSALQVLVSILKHCDVSGMKEDLWILQDQCRDPAVSVRKQALQSLTELLMAQPRCVQIQKAWLRGVVPVVMDCESTVQEKALEFLDQLLLQNIRHHSHFHSGDDSQVLAWALLTLLTTESQELSRYLNKAFHIWSKKEKFSPTFINNVISHTGTEHSAPAWMLLSKIAGSSPRLDYSRIIQSWEKISSQQNPNSNTLGHILCVIGHIAKHLPKSTRDKVTDAVKCKLNGFQWSLEVISSAVDALQRLCRASAETPAEEQELLTQVCGDVLSTCEHRLSNIVLKENGTGNMDEDLLVKYIFTLGDIAQLCPARVEKRIFLLIQSVLASSADADHSPSSQGSSEAPASQPPPQVRGSVMPSVIRAHAIITLGKLCLQHEDLAKKSIPALVRELEVCEDVAVRNNVIIVMCDLCIRYTIMVDKYIPNISMCLKDSDPFIRKQTLILLTNLLQEEFVKWKGSLFFRFVSTLIDSHPDIASFGEFCLAHLLLKRNPVMFFQHFIECIFHFNNYEKHEKYNKFPQSEREKRLFSLKGKSNKERRMKIYKFLLEHFTDEQRFNITSKICLSILACFADGILPLDLDASELLSDTFEVLSSKEIKLLAMRSKPDKDLLMEEDDMALANVVMQEAQKKLISQVQKRNFIENIIPIIISLKTVLEKNKIPALRELMHYLREVMQDYRDELKDFFAVDKQLASELEYDMKKYQEQLVQEQELAKHADVAGTAGGAEVAPVAQVALCLETVPVPAGQENPAMSPAVSQPCTPRASAGHVAVSSPTPETGPLQRLLPKARPMSLSTIAILNSVKKAVESKSRHRSRSLGVLPFTLNSGSPEKTCSQVSSYSLEQESNGEIEHVTKRAISTPEKSISDVTFGAGVSYIGTPRTPSSAKEKIEGRSQGNDILCLSLPDKPPPQPQQWNVRSPARNKDTPACSRRSLRKTPLKTAN

SEQ ID NO: 57593 - protein, 1084 aa, Homo sapiens
  Payload ID: 11299
  Gene Symbol: NCAPD3
  Gene Name: non-SMC condensin II complex, subunit D3
  ENSP ID: ENSP00000434168
MVALRGLGSGLQPWCPLDLRLEWVDTVWELDFTETEPLDPSIEAEIIETGLAAFTKLYESLLPFATGEHGSMESIWTFFIENNVSHSTLVALFYHFVQIVHKKNVSVQYREYGLHAAGLYFLLLEVPGSVANQVFHPVMFDKCIQTLKKSWPQESNLNRKRKKEQPKSSQANPGRHRKRGKPPRREDIEMDEIIEEQEDENICFSARDLSQIRNAIFHLLKNFLRLLPKFSLKEKPQCVQNCIEVFVSLTNFEPVLHECHVTQARALNQAKYIPELAYYGLYLLCSPIHGEGDKVISCVFHQMLSVILMLEVGEGSHRAPLAVTSQVINCRNQAVQFISALVDELKESIFPVVRILLQHICAKVVDKSEYRTFAAQSLVQLLSKLPCGEYAMFIAWLYKYSRSSKIPHRVFTLDVVLALLELPEREVDNTLSLEHQKFLKHKFLVQEIMFDRCLDKAPTVRSKALSSFAHCLELTVTSASESILELLINSPTFSVIESHPGTLLRNSSAFSYQRQTSNRSEPSGEINIDSSGETVGSGERCVMAMLRRRIRDEKTNVRKSALQVLVSILKHCDVSGMKEDLWILQDQCRDPAVSVRKQALQSLTELLMAQPRCVQIQKAWLRGVVPVVMDCESTVQEKALEFLDQLLLQNIRHHSHFHSGDDSQVLAWALLTLLTTESQELSRYLNKAFHIWSKKEKFSPTFINNVISHTGTEHSAPAWMLLSKIAGSSPRLDYSRIIQSWEKISSQQNPNSNTLGHILCVIGHIAKHLPKSTRDKVTDAVKCKLNGFQWSLEVISSAVDALQRLCRASAETPAEEQELLTQVCGDVLSTCEHRLSNIVLKENGTGNMDEDLLVKYIFTLGDIAQLCPARVEKRIFLLIQSVLASSADADHSPSSQGSSEAPASQPPPQVRGSVMPSVIRAHAIITLGKLCLQHEDLAKKSIPALVRELEVCEDVAVRNNVIIVMCDLCIRYTIMVDKYIPNISMCLKDSDPFIRKQTLILLTNLLQEEFVKWKGSLFFRFVSTLIDSHPDIASFGEFCLAHLLLKRNPVMFFQHFIECIFHFNNYEKHEKYNKFPQSERALHR

SEQ ID NO: 57594 - protein, 264 aa, Homo sapiens
  Payload ID: 11299
  Gene Symbol: NCAPD3
  Gene Name: non-SMC condensin II complex, subunit D3
  ENSP ID: ENSP00000435173
MCDLCIRYTIMVDKYIPNISMCLKDSDPFIRKQTLILLTNLLQEEFVKWKGSLFFRFVSTLIDSHPDIASFGEFCLAHLLLKRNPVMFFQHFIECIFHFNNYEKHEKYNKFPQSEREKRLFSLKGKSNKERRMKIYKFLLEHFTDEQRFNITSKICLSILACFADGILPLDLDASELLSDTFEVLSSKEIKLLAMRSKPDKDLLMEEDDMALANVVMQEAQKKLISQVQKRNFIENIIPIIISLKTVLEKNKIPALRELMHYLR

SEQ ID NO: 57595 - protein, 37 aa, Homo sapiens
  Payload ID: 11299
  Gene Symbol: NCAPD3
  Gene Name: non-SMC condensin II complex, subunit D3
  ENSP ID: ENSP00000435586
MVALRGLGSGLQPWCPLDLRLGSTGCLTCRHHQTSHE

SEQ ID NO: 57596 - protein, 33 aa, Homo sapiens
  Payload ID: 11299
  Gene Symbol: NCAPD3
  Gene Name: non-SMC condensin II complex, subunit D3
  ENSP ID: ENSP00000435655
MVALRGLGSGLQPWCPLDLRLGSTGCLTCRHHQ

SEQ ID NO: 57597 - protein, 74 aa, Homo sapiens [sequence omitted]

SEQ ID NO: 57598 - protein, 1143 aa, Homo sapiens
  Payload ID: 11300
  Gene Symbol: NCAPG2
  Gene Name: non-SMC condensin II complex, subunit G2
  Uniprot ID: Q86XI2
  ENSP ID: ENSP00000348657
MEKRETFVQAVSKELVGEFLQFVQLDKEASDPFSLNELLDELSRKQKEELWQRLKNLLTDVLLESPVDGWQVVEAQGEDNMETEHGSKMRKSIEIIYAITSVILASVSVINESENYEALLECVIILNGILYALPESERKLQSSIQDLCVTWWEKGLPAKEDTGKTAFVMLLRRSLETKTGADVCRLWRIHQALYCFDYDLEESGEIKDMLLECFININYIKKEEGRRFLSCLFNWNINFIKMIHGTIKNQLQGLQKSLMVYIAEIYFRAWKKASGKILEAIENDCIQDFMFHGIHLPRRSPVHSKVREVLSYFHHQKKVRQGVEEMLYRLYKPILWRGLKARNSEVRSNAALLFVEAFPIRDPNLHAIEMDSEIQKQFEELYSLLEDPYPMVRSTGILGVCKITSKYWEMMPPTILIDLLKKVTGELAFDTSSADVRCSVFKCLPMILDNKLSHPLLEQLLPALRYSLHDNSEKVRVAFVDMLLKIKAVRAAKFWKICPMEHILVRLETDSRPVSRRLVSLIFNSFLPVNQPEEVWCERCVTLVQMNHAAARRFYQYAHEHTACTNIAKLIHVIRHCLNACIQRAVREPPEDEEEEDGREKENVTVLDKTLSVNDVACMAGLLEIIVILWKSIDRSMENNKEAKLYTINKFASVLPEYLKVFKDDRCKIPLFMLMSFMPASAVPPFSCGVISTLRSREEGAVDKSYCTLLDCLCSWGQVGHILELVDNWLPTEHAQAKSNTASKGRVQIHDTRPVKPELALVYIEYLLTHPKNRECLLSAPRKKLNHLLKALETSKADLESLLQTPGGKPRGFSEAAAPRAFGLHCRLSIHLQHKFCSEGKVYLSMLEDTGFWLESKILSFIQDQEEDYLKLHRVIYQQIIQTYLTVCKDVVMVGLGDHQFQMQLLQRSLGIMQTVKGFFYVSLLLDILKEITGSSLIQKTDSDEEVAMLLDTVQKVFQKMLECIARSFRKQPEEGLRLLYSVQRPLHEFITAVQSRHTDTPVHRGVLSTLIAGPVVEISHQLRKVSDVEELTPPEHLSDLPPFSRCLIGIIIKSSNVVRSFLDELKACVASNDIEGIVCLTAAVHIILVINAGKHKSSKVREVAATVHRKLKTFMEITLEEDSIERFLYESSSRTLGELLNS

SEQ ID NO: 57599 - protein, 1143 aa, Homo sapiens; identical to SEQ ID NO: 57598
  Payload ID: 11300
  Gene Symbol: NCAPG2
  Gene Name: non-SMC condensin II complex, subunit G2
  Uniprot ID: Q86XI2
  ENSP ID: ENSP00000386569

SEQ ID NO: 57600 - protein, 1156 aa, Homo sapiens
  Payload ID: 11300
  Gene Symbol: NCAPG2
  Gene Name: non-SMC condensin II complex, subunit G2
  Uniprot ID: Q86XI2
  ENSP ID: ENSP00000387007
MEKRETFVQAVSKELVGEFLQFVQLDKEASDPFSLNELLDELSRKQKEELWQRLKNLLTDVLLESPVDGWQVVEAQGEDNMETEHGSKMRKSIEIIYAITSVILASVSVINESENYEALLECVIILNGILYALPESERKLQSSIQDLCVTWWEKGLPAKEDTGKTAFVMLLRRSLETKTGADVCRLWRIHQALYCFDYDLEESGEIKDMLLECFININYIKKEEGRRFLSCLFNWNINFIKMIHGTIKNQLQGLQKSLMVYIAEIYFRAWKKASGKILEAIENDCIQDFMFHGIHLPRRSPVHSKVREVLSYFHHQKKVRQGVEEMLYRLYKPILWRGLKARNSEVRSNAALLFVEAFPIRDPNLHAIEMDSEIQKQFEELYSLLEDPYPMVRSTGILGVCKITSKYWEMMPPTILIDLLKKVTGELAFDTSSADVRCSVFKCLPMILDNKLSHPLLEQLLPALRYSLHDNSEKVRVAFVDMLLKIKAVRAAKFWKICPMEHILVRLETDSRPVSRRLVSLIFNSFLPVNQPEEVWCERCVTLVQMNHAAARRFYQYAHEHTACTNIAKLIHVIRHCLNACIQRAVREPPEDEEEEDGREKENVTVLDKTLSVNDVACMAGLLEIIVILWKSIDRSMENNKEAKLYTINKFASVLPEYLKVFKDDRCKIPLFMLMSFMPASAVPPFSCGVISTLRSREEGAVDKSYCTLLDCLCSWGQVGHILELVDNWLPTEHAQAKSNTASKGRVQIHDTRPVKPELALVYIEYLLTHPKNRECLLSAPRKKLNHLLKALETSKADLESLLQTPGGKPRGFSEAAAPRAFGLHCRLSIHLQHKFCSEGKVYLSMLEDTGFWLESKILSFIQDQEEDYLKLHRVIYQQIIQTYLTVCKDVVMVGLGDHQFQMQLLQRSLGIMQTVKGFFYVSLLLDILKEITGSSLIQKTDSDEEVAMLLDTVQKVFQKMLECIARSFRKQPEEGLRLLYSVQRPLHEFITAVQSRHTDTPVHRGVLSTLIAGPVVEISHQLRKVSDVEELTPPEHLSDLPPFSRCLIGIIIKSSNVVRSFLDELKACVASNDIEGIVCLTAAVHIILVINAGKHKSSKVREVAATVHRKLKTFMEITLEEDSIERYEDLLCCPGWALTPGLLDSIYPSASVPIG

SEQ ID NO: 57601 - protein, 898 aa, Homo sapiens
  Payload ID: 11300
  Gene Symbol: NCAPG2
  Gene Name: non-SMC condensin II complex, subunit G2
  ENSP ID: ENSP00000408080
  MOD_RES (1)..(1): Any amino acid
XLEESGEIKDMLLECFININYIKKEEGRRFLSCLFNWNINFIKMIHGTIKNQLQGLQKSLMVYIAEIYFRAWKKASGKILEAIENDCIQDFMFHGIHLPRRSPVHSKVREVLSYFHHQKKVRQGVEEMLYRLYKPILWRGLKARNSEVRSNAALLFVEAFPIRDPNLHAIEMDSEIQKQFEELYSLLEDPYPMVRSTGILGVCKITSKYWEMMPPTILIDLLKKVTGELAFDTSSADVRCSVFKCLPMILDNKLSHPLLEQLLPALRYSLHDNSEKVRVAFVDMLLKIKAVRAAKFWKICPMEHILVRLETDSRPVSRRLVSLIFNSFLPVNQPEEVWCERCVTLVQMNHAAARRFYQYAHEHTACTNIAKLIHVIRHCLNACIQRAVREPPEDEEEEDGREKENVTVLDKTLSVNDVACMAGLLEIIVILWKSIDRSMENNKEAKLYTINKFASVLPEYLKVFKDDRCKIPLFMLMSFMPASAVPPFSCGVISTLRSREEGAVDKSYCTLLDCLCSWGQVGHILELVDNWLPTEHAQAKSNTASKGRVQIHDTRPVKPELALVYIEYLLTHPKNRECLLSAPRKKLNHLLKALETSKADLESLLQTPGGKPRGFSEAAAPRAFGLHCRLSIHLQHKFCSEGKVYLSMLEDTGFWLESKILSFIQDQEEDYLKLHRVIYQQIIQTYLTVCKDVVMVGLGDHQFQMQLLQRSLGIMQTVKGFFYVSLLLDILKEITGSSLIQKTDSDEEVAMLLDTVQKVFQKMLECIARSFRKQPEEGLRVSDVEELTPPEHLSDLPPFSRCLIGIIIKSSNVVRSFLDELKACVASNDIEGIVCLTAAVHIILVINAGKHKSSKVREVAATVHRKLKTFMEITLEEDSIERFLYESSSRTLGELLNS

SEQ ID NO: 57602 - protein, 389 aa, Homo sapiens
  Payload ID: 11300
  Gene Symbol: NCAPG2
  Gene Name: non-SMC condensin II complex, subunit G2
  ENSP ID: ENSP00000414337
MEKRETFVQAVSKELVGEFLQFVQLDKEASDPFSLNELLDELSRKQKEELWQRLKNLLTDVLLESPVDGWQVVEAQGEDNMETEHGSKMRKSIEIIYAITSVILASVSVINESENYEALLECVIILNGILYALPESERKLQSSIQDLCVTWWEKGLPAKEDTGKTAFVMLLRRSLETKTGADVCRLWRIHQALYCFDYDLEESGEIKDMLLECFININYIKKEEGRRFLSCLFNWNINFIKMIHGTIKNQLQGLQKSLMVYIAEIYFRAWKKASGKILEAIENDCIQDFMFHGIHLPRRSPVHSKVREVLSYFHHQKKVRQGVEEMLYRLYKPILWRGLKARNSEVRSNAALLFVEAFPIRDPNLHAIEMDSEIQKQFEELYGSLVFVK

SEQ ID NO: 57603 - protein, 606 aa, Homo sapiens
  Payload ID: 11301
  Gene Symbol: NCAPH2
  Gene Name: non-SMC condensin II complex, subunit H2
  Uniprot ID: Q6IBW4
  ENSP ID: ENSP00000299821
MEDVEARFAHLLQPIRDLTKNWEVDVAAQLGEYLEELDQICISFDEGKTTMNFIEAALLIQGSACVYSKKVEYLYSLVYQALDFISGKRRAKQLSSVQEDRANGVASSGVPQEAENEFLSLDDFPDSRTNVDLKNDQTPSEVLIIPLLPMALVAPDEMEKNNNPLYSRQGEVLASRKDFRMNTCVPHPRGAFMLEPEGMSPMEPAGVSPMPGTQKDTGRTEEQPMEVSVCRSPVPALGFSQEPGPSPEGPMPLGGGEDEDAEEAVELPEASAPKAALEPKESRSPQQSAALPRRYMLREREGAPEPASCVKETPDPWQSLDPFDSLESKPFKKGRPYSVPPCVEEALGQKRKRKGAAKLQDFHQWYLAAYADHADSRRLRRKGPSFADMEVLYWTHVKEQLETLRKLQRREVAEQWLRPAEEDHLEDSLEDLGAAADDFLEPEEYMEPEGADPREAADLDAVPMSLSYEELVRRNVELFIATSQKFVQETELSQRIRDWEDTVQPLLQEQEQHVPFDIHTYGDQLVSRFPQLNEWCPFAELVAGQPAFEVCRSMLASLQLANDYTVEITQQPGLEMAVDTMSLRLLTHQRAHKRFQTYAAPSMAQP

SEQ ID NO: 57604 - protein, 299 aa, Homo sapiens
  Payload ID: 11301
  Gene Symbol: NCAPH2
  Gene Name: non-SMC condensin II complex, subunit H2
  Uniprot ID: Q6IBW4
  ENSP ID: ENSP00000379050
MEDVEARFAHLLQPIRDLTKNWEVDVAAQLGEYLEELDQICISFDEGKTTMNFIEAALLIQGSACVYSKKVEYLYSLVYQALDFISGKRRAKQLSSVQEDRANGVASSGVPQEAENEFLSLDDFPDSRTNVDLKNDQTPSEVLIIPLLPMALVAPDEMEKNNNPLYSRQGEVLASRKDFRMNTCVPHPRGAFMLEPEGMSPMEPAGVSPMPGTQKDTGRTEEQPMEVSVCRSPVPALGFSQEPGPSPEGPMPLGGGEDEDAEEAVELPEASAPKAALEPKESRSPQQVGPTWRPAEPEL

SEQ ID NO: 57605 - protein, 589 aa, Homo sapiens
  Payload ID: 11301
  Gene Symbol: NCAPH2
  Gene Name: non-SMC condensin II complex, subunit H2
  ENSP ID: ENSP00000379053
MEDVEARFAHLLQPIRDLTKNWEVDVAAQLGEYLEELDQICISFDEGKTTMNFIEAALLIQGSACVYSKKVEYLYSLVYQALDFISGKRRAKQLSSVQEDRANGVASSGVPQEAENEFLSLDDFPDSRTNVDLKNDQTPSEVLIIPLLPMALVAPDEMEKNNNPLYSRQGEVLASRKDFRMNTCVPHPRGAFMLEPEGMSPMEPAGVSPMPGTQKDTGRTEEQPMEVSVCRSPVPALGFSQEPGPSPEGPMPLGGGEDEDAEEAVELPEASAPKAALEPKESRSPQQSAALPRRYMLREREGAPEPASCVKETPDPWQSLDPFDSLESKPFKKGRPYSVPPCVEEALGQKRKRKGAAKLQDFHQWYLAAYADHADSRRLRRKGPSFADMEVLYWTHVKEQLETLRKLQRREVAEQWLRPAEEDHLEDSLEDLGAADDFLEPEEYMEPEGADPREAADLDAVPMSLSYEELVRRNVELFIATSQKFVQETELSQRIRDWEDTVQPLLQEQEQHVPFDIHTYGDQLVSRFPQLNEWCPFAELVAGQPAFEVCRSMLASLQLVSSLGYVGGGDGPQTLLMCHPCRPMTTQWR

SEQ ID NO: 57606 - protein, 605 aa, Homo sapiens
  Payload ID: 11301
  Gene Symbol: NCAPH2
  Gene Name: non-SMC condensin II complex, subunit H2
  Uniprot ID: Q6IBW4
  ENSP ID: ENSP00000410088
MEDVEARFAHLLQPIRDLTKNWEVDVAAQLGEYLEELDQICISFDEGKTTMNFIEAALLIQGSACVYSKKVEYLYSLVYQALDFISGKRRAKQLSSVQEDRANGVASSGVPQEAENEFLSLDDFPDSRTNVDLKNDQTPSEVLIIPLLPMALVAPDEMEKNNNPLYSRQGEVLASRKDFRMNTCVPHPRGAFMLEPEGMSPMEPAGVSPMPGTQKDTGRTEEQPMEVSVCRSPVPALGFSQEPGPSPEGPMPLGGGEDEDAEEAVELPEASAPKAALEPKESRSPQQSAALPRRYMLREREGAPEPASCVKETPDPWQSLDPFDSLESKPFKKGRPYSVPPCVEEALGQKRKRKGAAKLQDFHQWYLAAYADHADSRRLRRKGPSFADMEVLYWTHVKEQLETLRKLQRREVAEQWLRPAEEDHLEDSLEDLGAADDFLEPEEYMEPEGADPREAADLDAVPMSLSYEELVRRNVELFIATSQKFVQETELSQRIRDWEDTVQPLLQEQEQHVPFDIHTYGDQLVSRFPQLNEWCPFAELVAGQPAFEVCRSMLASLQLANDYTVEITQQPGLEMAVDTMSLRLLTHQRAHKRFQTYAAPSMAQP

SEQ ID NO: 57607 - protein, 62 aa, Homo sapiens
  Payload ID: 11301
  Gene Symbol: NCAPH2
  Gene Name: non-SMC condensin II complex, subunit H2
  ENSP ID: ENSP00000410480
MEDVEARFAHLLQPIRDLTKNWEVDVAAQLGEYLEECHLLRRNTGDEPALGKMLAGSDLHFF

SEQ ID NO: 57608 - protein, 292 aa, Homo sapiens
  Payload ID: 11301
  Gene Symbol: NCAPH2
  Gene Name: non-SMC condensin II complex, subunit H2
  ENSP ID: ENSP00000429025
MEDVEARFAHLLQPIRDLTKNWEVDVAAQLGEYLEEVEYLYSLVYQALDFISGKRRAKQLSSVQEDRANGVASSGVPQEAENEFLSLDDFPDSRTNVDLKNDQTPSEVLIIPLLPMALVAPDEMEKNNNPLYSRQGEVLASRKDFRMNTCVPHPRGAFMLEPEGMSPMEPAGVSPMPGTQKDTGRTEEQPMEVSVCRSPVPALGFSQEPGPSPEGPMPLGGGEDEDAEEAVELPEASAPKAALEPKESRSPQQSAALPRRYMLREREGAPEPASCVKETPDPWQSLDPFDSL

SEQ ID NO: 57609 - protein, 38 aa, Homo sapiens
  Payload ID: 11301
  Gene Symbol: NCAPH2
  Gene Name: non-SMC condensin II complex, subunit H2
  ENSP ID: ENSP00000429060
MEDVEARFAHLLQPIRDLTKNWEVDVAAQLAGSDLHFF

SEQ ID NO: 57610 - protein, 141 aa, Homo sapiens
  Payload ID: 11301
  Gene Symbol: NCAPH2
  Gene Name: non-SMC condensin II complex, subunit H2
  ENSP ID: ENSP00000430944
  MOD_RES (1)..(1): Any amino acid
XMEPEGADPREAADLDAVPMSLSYEELVRRNVELFIATSQKFVQETELSQRIRDWEDTVQPLLQEQLNEWCPFAELVAGQPAFEVCRSMLASLQLANDYTVEITQQPGLEMAVDTMSLRLLTHQRAHKRFQTYAAPSMAQP

SEQ ID NO: 57611 - protein, 275 aa, Homo sapiens
  Payload ID: 11302
  Gene Symbol: NCCRP1
  Gene Name: non-specific cytotoxic cell receptor protein 1 homolog (zebrafish)
  Uniprot ID: Q6ZVX7
  ENSP ID: ENSP00000342137
MEEVREGHALGGGMEADGPASLQELPPSPRSPSPPPSPPPLPSPPSLPSPAAPEAPELPEPAQPSEAHARQLLLEEWGPLSGGLELPQRLTWKLLLLRRPLYRNLLRSPNPEGINIYEPAPPTGPTQRPLETLGNFRGWYIRTEKLQQNQSWTVKQQCVDLLAEGLWEELLDDEQPAITVMDWFEDSRLDACVYELHVWLLAADRRTVIAQHHVAPRTSGRGPPGRWVQVSHVFRHYGPGVRFIHFLHKAKNRMEPGGLRRTRVTDSSVSVQLRE

SEQ ID NO: 57612 - protein, 64 aa, Homo sapiens
  Payload ID: 11303
  Gene Symbol: NOP10
  Gene Name: NOP10 ribonucleoprotein
  Uniprot ID: Q9NPE3
  ENSP ID: ENSP00000332198
MFLQYYLNEQGDRVYTLKKFDPMGQQTCSAHPARFSPDDKYSRHRITIKKRFKVLMTQQPRPVL

SEQ ID NO: 57613 - protein, 36 aa, Homo sapiens
  Payload ID: 11303
  Gene Symbol: NOP10
  Gene Name: NOP10 ribonucleoprotein
  ENSP ID: ENSP00000453475
MFLQYYLNEQGDRVYTLKMTNTLDTESPSRNASRCS

SEQ ID NO: 57614 - protein, 857 aa, Homo sapiens
  Payload ID: 11304
  Gene Symbol: NOP14
  Gene Name: NOP14 nucleolar protein
  Uniprot ID: P78316
  ENSP ID: ENSP00000315674
MAKAKKVGARRKASGAPAGARGGPAKANSNPFEVKVNRQKFQILGRKTRHDVGLPGVSRARALRKRTQTLLKEYKERDKSNVFRDKRFGEYNSNMSPEEKMMKRFALEQQRHHEKKSIYNLNEDEELTHYGQSLADIEKHNDIVDSDSDAEDRGTLSAELTAAHFGGGGGLLHKKTQQEGEEREKPKSRKELIEELIAKSKQEKRERQAQREDALELTEKLDQDWKEIQTLLSHKTPKSENRDKKEKPKPDAYDMMVRELGFEMKAQPSNRMKTEAELAKEEQEHLRKLEAERLRRMLGKDEDENVKKPKHMSADDLNDGFVLDKDDRRLLSYKDGKMNVEEDVQEEQSKEASDPESNEEEGDSSGGEDTEESDSPDSHLDLESNVESEEENEKPAKEQRQTPGKGLISGKERAGKATRDELPYTFAAPESYEELRSLLLGRSMEEQLLVVERIQKCNHPSLAEGNKAKLEKLFGFLLEYVGDLATDDPPDLTVIDKLVVHLYHLCQMFPESASDAIKFVLRDAMHEMEEMIETKGRAALPGLDVLIYLKITGLLFPTSDFWHPVVTPALVCLSQLLTKCPILSLQDVVKGLFVCCLFLEYVALSQRFIPELINFLLGILYIATPNKASQGSTLVHPFRALGKNSELLVVSAREDVATWQQSSLSLRWASRLRAPTSTEANHIRLSCLAVGLALLKRCVLMYGSLPSFHAIMGPLQALLTDHLADCSHPQELQELCQSTLTEMESQKQLCRPLTCEKSKPVPLKLFTPRLVKVLEFGRKQGSSKEEQERKRLIHKHKREFKGAVREIRKDNQFLARMQLSEIMERDAERKRKVKQLFNSLATQEGEWKALKRKKFKK

SEQ ID NO: 57615 - protein, 806 aa, Homo sapiens
  Payload ID: 11304
  Gene Symbol: NOP14
  Gene Name: NOP14 nucleolar protein
  Uniprot ID: P78316
  ENSP ID: ENSP00000381146
MAKAKKVGARRKASGAPAGARGGPAKANSNPFEVKVNRQKFQILGRKTRHDVGLPGVSRARALRKRTQTLLKEYKERDKSNVFRDKRFGEYNSNMSPEEKMMKRFALEQQRHHEKKSIYNLNEDEELTHYGQSLADIEKHNDIVDSDSDAEDRGTLSAELTAAHFGGGGGLLHKKTQQEGEEREKPKSRKELIEELIAKSKQEKRERQAQREDALELTEKLDQDWKEIQTLLSHKTPKSENRDKKEKPKPDAYDMMVRELGFEMKAQPSNRMKTEAELAKEEQEHLRKLEAERLRRMLGKDEDENVKKPKHMSADDLNDGFVLDKDDRRLLSYKDGKMNVEEDVQEEQSKEASDPESNEEEGDSSGGEDTEESDSPDSHLDLESNVESEEENEKPAKEQRQTPGKGLISGKERAGKATRDELPYTFAAPESYEELRSLLLGRSMEEQLLVVERIQKCNHPSLAEGNKAKLEKLFGFLLEYVGDLATDDPPDLTVIDKLVVHLYHLCQMFPESASDAIKFVLRDAMHEMEEMIETKGRAALPGLDVLIYLKITGLLFPTSDFWHPVVTPALVCLSQLLTKCPILSLQDVVKGLFVCCLFLEYVALSQRFIPELINFLLGILYIATPNKASQGSTLVHPFRALGKNSELLVVSAREDVATWQQSSLSLRWASRLRAPTSTEANHIRLSCLAVGLALLKRCVLMYGSLPSFHAIMGPLQALLTDHLADCSHPQELQELCQSTLTEMESQKQLCRPLTCEKSKPVPLKLFTPRLVSNSRPQVIHLPWPPNYRCEPQHPAKKVIFFRVIML

SEQ ID NO: 57616 - protein, 857 aa, Homo sapiens; identical to SEQ ID NO: 57614
  Payload ID: 11304
  Gene Symbol: NOP14
  Gene Name: NOP14 nucleolar protein
  Uniprot ID: P78316
  ENSP ID: ENSP00000405068

SEQ ID NO: 57617 - protein, 788 aa, Homo sapiens
  Payload ID: 11304
  Gene Symbol: NOP14
  Gene Name: NOP14 nucleolar protein
  ENSP ID: ENSP00000427415
MAKAKKVGARRKASGAPAGARGGPAKANSNPFEVKVNRQKFQILGRKTRHDVGLPGVSRARALRKRTQTLLKEYKERDKSNVFRDKRFGEYNSNMSPEEKMMKRFALEQQRHHEKKSIYNLNEDEELTHYGQSLADIEKHNDIVDSDSDAEDRGTLSAELTAAHFGGGGGLLHKKTQQEGEEREKPKSRKELIEELIAKSKQEKRERQAQREDALELTEKLDQDWKEIQTLLSHKTPKSENRDKKEKPKPDAYDMMVRELGFEMKAQPSNRMKTEAELAKEEQEHLRKLEAERLRRMLGKDEDENVKKPKHMSADDLNDGFVLDKDDRRLLSYKDGKMNVEEDVQEEQSKEASDPESNEEEGDSSGGEDTEESDSPDSHLDLESNVESEEENEKPAKEQRQTPGKGLISGKERAGKATRDELPYTFAAPESYEELRSLLLGRSMEEQLLVVERIQKCNHPSLAEGNKAKLEKLFGFLLEYVGDLATDDPPDLTVIDKLVVHLYHLCQMFPESASDAIKFVLRDAMHEMEEMIETKGRAALPGLDVLIYLKITGLLFPTSDFWHPVVTPALVCLSQLLTKCPILSLQDVVKGLFVCCLFLEYVALSQRFIPELINFLLGILYIATPNKASQGSTLVHPFRALGKNSELLVVSAREDVATWQQSSLSLRWASRLRAPTSTEANHIRLSCLAVGLALLKRCVLMYGSLPSFHAIMGPLQALLTDHLADCSHPQELQELCQSTLTEMESQKQLCRPLTCEKSKPVPLKLFTPRLAGLEFPTSGNPPALAPQL

SEQ ID NO: 57618 - protein, 95 aa, Homo sapiens
  Payload ID: 11305
  Gene Symbol: NOP16
  Gene Name: NOP16 nucleolar protein
  ENSP ID: ENSP00000423835
MPKAKGKTRRQKFGYSVNRKRLNRNARRKAAPRIECSHIRHAWDHAKSVRQNLAEMGLAVDPNRAVPLRKRKILLVSRALFSAGEGHGGGHRGEA

SEQ ID NO: 57619 - protein, 150 aa, Homo sapiens
  Payload ID: 11305
  Gene Symbol: NOP16
  Gene Name: NOP16 nucleolar protein
  ENSP ID: ENSP00000427489
MPKAKGKTRRQKFGYSVNRKRLNRNARRKAAPRIECSHIRHAWDHAKSVRQNLAEMGLAVDPNRAVPLRKRKVKAMEVDIEERPKELVRKPYVLNDLEAEASLPEKKGNTLSRDLIDYVRYMVENHGEDYKVSGSGPVGWLGRRPGPFAA

SEQ ID NO: 57620 - protein, 70 aa, Homo sapiens
  Payload ID: 11305
  Gene Symbol: NOP16
  Gene Name: NOP16 nucleolar protein
  ENSP ID: ENSP00000478283
MPKAKGKTRRQKFGYSVNRKRLNRNARRKAAPRIECRVARLPRFFAEEEDGGGVTGLHHSCPRLRRPPDQ

SEQ ID NO: 57621 - protein, 231 aa, Homo sapiens
  Payload ID: 11305
  Gene Symbol: NOP16
  Gene Name: NOP16 nucleolar protein
  ENSP ID: ENSP00000479445
MPKAKGKTRRQKFGYSVNRKRLNRNARRKAAPRIECSHIRHAWDHAKSVRQNLAEMGLAVDPNRAVPLRKRKVKAMEVDIEERPKELVRKPYVLNDLEAEASLPEKKGNTLSRDLIDYVRYMVENHGEDYKSGKTSSILCRRGRWRWSDWFTSQLPQAEASPGPVKLEPGCKARRCCVAPEELARSHGIRRLHTHVHTPRSGEGTVLRGSNLYSSGGSRKSQNLLFSGWVM

SEQ ID NO: 57622 - protein, 178 aa, Homo sapiens
  Payload ID: 11305
  Gene Symbol: NOP16
  Gene Name: NOP16 nucleolar protein
  Uniprot ID: Q9Y3C1
  ENSP ID: ENSP00000480832
MPKAKGKTRRQKFGYSVNRKRLNRNARRKAAPRIECSHIRHAWDHAKSVRQNLAEMGLAVDPNRAVPLRKRKVKAMEVDIEERPKELVRKPYVLNDLEAEASLPEKKGNTLSRDLIDYVRYMVENHGEDYKAMARDEKNYYQDTPKQIRSKINVYKRFYPAEWQDFLDSLQKRKMEVE

SEQ ID NO: 57623 - protein, 232 aa, Homo sapiens
  Payload ID: 11305
  Gene Symbol: NOP16
  Gene Name: NOP16 nucleolar protein
  Uniprot ID: Q9Y3C1
  ENSP ID: ENSP00000483001
MPKAKGKTRRQKFGYSVNRKRLNRNARRKAAPRIECSHIRHAWDHAKSVRQNLAEMGLAVDPNRAVPLRKRKVKAMEVDIEERPKELVRKPYVLNDLEAEASLPEKKGNTLSRDLIDYVRYMVENHGEDYKQSGKTSSILCRRGRWRWSDWFTSQLPQAEASPGPVKLEPGCKARRCCVAPEELARSHGIRRLHTHVHTPRSGEGTVLRGSNLYSSGGSRKSQNLLFSGWVM

SEQ ID NO: 57624 - protein, 236 aa, Homo sapiens
  Payload ID: 11305
  Gene Symbol: NOP16
  Gene Name: NOP16 nucleolar protein
  ENSP ID: ENSP00000484440
MLDGRQRRGSNAPTSDMPGTTLNRYGRTWPRWGWLWTPTGGALRKRKVKAMEVDIEERPKELVRKPYVLNDLEAEASLPEKKGNTLSRDLIDYVRYMVENHGEDYKAMAVMRRITIKIPQNRFGVRSTSINAFTQQSGKTSSILCRRGRWRWSDWFTSQLPQAEASPGPVKLEPGCKARRCCVAPEELARSHGIRRLHTHVHTPRSGEGTVLRGSNLYSSGGSRKSQNLLFSGWVM

SEQ ID NO: 57625 - protein, 237 aa, Homo sapiens
  Payload ID: 11305
  Gene Symbol: NOP16
  Gene Name: NOP16 nucleolar protein
  ENSP ID: ENSP00000484969
MPKAKGKTRRQKFGYSVNRKRLNRNARRKAAPRIECSHIRHAWDHAKSVRQNLAEMGLAVDPNRAVPLRKRKVKAMEVDIEERPKELVRKPYVLNDLEAEASLPEKKGNTLSRDLIDYVRYMVENHGEDYKQSGKTSSILCRRGRWRWSDWFTSQLPQAEASPGPVKLEPGCKARRCCVAPEELARSHGIRRLHTRAHSPLWGRNCSQRLQFIFIWGFTEKPEPAVFRVGDVNIVCT

SEQ ID NO: 57626 - protein, 812 aa, Homo sapiens
  Payload ID: 11306
  Gene Symbol: NOP2
  Gene Name: NOP2 nucleolar protein
  Uniprot ID: P46087
  ENSP ID: ENSP00000313272
MGRKLDPTKEKRGPGRKARKQKGAETELVRFLPAVSDENSKRLSSRARKRAAKRRLGSVEAPKTNKSPEAKPLPGKLPKGISAGAVQTAGKKGPQSLFNAPRGKKRPAPGSDEEEEEEDSEEDGMVNHGDLWGSEDDADTVDDYGADSNSEDEEEGEALLPIERAARKQKAREAAAGIQWSEEETEDEEEEKEVTPESGPPKVEEADGGLQINVDEEPFVLPPAGEMEQDAQAPDLQRVHKRIQDIVGILRDFGAQREEGRSRSEYLNRLKKDLAIYYSYGDFLLGKLMDLFPLSELVEFLEANEVPRPVTLRTNTLKTRRRDLAQALINRGVNLDPLGKWSKTGLVVYDSSVPIGATPEYLAGHYMLQGASSMLPVMALAPQEHERILDMCCAPGGKTSYMAQLMKNTGVILANDANAERLKSVVGNLHRLGVTNTIISHYDGRQFPKVVGGFDRVLLDAPCSGTGVISKDPAVKTNKDEKDILRCAHLQKELLLSAIDSVNATSKTGGYLVYCTCSITVEENEWVVDYALKKRNVRLVPTGLDFGQEGFTRFRERRFHPSLRSTRRFYPHTHNMDGFFIAKFKKFSNSIPQSQTGNSETATPTNVDLPQVIPKSENSSQPAKKAKGAAKTKQQLQKQQHPKKASFQKLNGISKGADSELSTVPSVTKTQASSSFQDSSQPAGKAEGIREPKVTGKLKQRSPKLQSSKKVAFLRQNAPPKGTDTQTPAVLSPSKTQATLKPKDHHQPLGRAKGVEKQQLPEQPFEKAAFQKQNDTPKGPQPPTVSPIRSSRPPPAKRKKSQSRGNSQLLLS

SEQ ID NO: 57627 - protein, 845 aa, Homo sapiens
  Payload ID: 11306
  Gene Symbol: NOP2
  Gene Name: NOP2 nucleolar protein
  Uniprot ID: P46087
  ENSP ID: ENSP00000371858
MGRKLDPTKEKRGPGRKARKQKGAETELVRFLPAVSDENSKRLSSRARKRAAKRRLGSVEAPKTNKSPEAKPLPGKLPKGISAGAVQTAGKKGPQSLFNAPRGKKRPAPGSDEEEEEEDSEEDGMVNHGDLWGSEDDADTVDDYGADSNSEDEEEGEAAGVQWLGLGSLQPPPPGFKQFSCLSFPSSWDLQLLPIERAARKQKAREAAAGIQWSEEETEDEEEEKEVTPESGPPKVEEADGGLQINVDEEPFVLPPAGEMEQDAQAPDLQRVHKRIQDIVGILRDFGAQREEGRSRSEYLNRLKKDLAIYYSYGDFLLGKLMDLFPLSELVEFLEANEVPRPVTLRTNTLKTRRRDLAQALINRGVNLDPLGKWSKTGLVVYDSSVPIGATPEYLAGHYMLQGASSMLPVMALAPQEHERILDMCCAPGGKTSYMAQLMKNTGVILANDANAERLKSVVGNLHRLGVTNTIISHYDGRQFPKVVGGFDRVLLDAPCSGTGVISKDPAVKTNKDEKDILRCAHLQKELLLSAIDSVNATSKTGGYLVYCTCSITVEENEWVVDYALKKRNVRLVPTGLDFGQEGFTRFRERRFHPSLRSTRRFYPHTHNMDGFFIAKFKKFSNSIPQSQTGNSETATPTNVDLPQVIPKSENSSQPAKKAKGAAKTKQQLQKQQHPKKASFQKLNGISKGADSELSTVPSVTKTQASSSFQDSSQPAGKAEGIREPKVTGKLKQRSPKLQSSKKVAFLRQNAPPKGTDTQTPAVLSPSKTQATLKPKDHHQPLGRAKGVEKQQLPEQPFEKAAFQKQNDTPKGPQPPTVSPIRSSRPPPAKRKKSQSRGNSQLLLS

SEQ ID NO: 57628 - protein, 808 aa, Homo sapiens
  Payload ID: 11306
  Gene Symbol: NOP2
  Gene Name: NOP2 nucleolar protein
  Uniprot ID: P46087
  ENSP ID: ENSP00000382392
MGRKLDPTKEKRGPGRKARKQKGAETELVRFLPAVSDENSKRLSSRARKRAAKRRLGSVEAPKTNKSPEAKPLPGKLPKGAVQTAGKKGPQSLFNAPRGKKRPAPGSDEEEEEEDSEEDGMVNHGDLWGSEDDADTVDDYGADSNSEDEEEGEALLPIERAARKQKAREAAAGIQWSEEETEDEEEEKEVTPESGPPKVEEADGGLQINVDEEPFVLPPAGEMEQDAQAPDLQRVHKRIQDIVGILRDFGAQREEGRSRSEYLNRLKKDLAIYYSYGDFLLGKLMDLFPLSELVEFLEANEVPRPVTLRTNTLKTRRRDLAQALINRGVNLDPLGKWSKTGLVVYDSSVPIGATPEYLAGHYMLQGASSMLPVMALAPQEHERILDMCCAPGGKTSYMAQLMKNTGVILANDANAERLKSVVGNLHRLGVTNTIISHYDGRQFPKVVGGFDRVLLDAPCSGTGVISKDPAVKTNKDEKDILRCAHLQKELLLSAIDSVNATSKTGGYLVYCTCSITVEENEWVVDYALKKRNVRLVPTGLDFGQEGFTRFRERRFHPSLRSTRRFYPHTHNMDGFFIAKFKKFSNSIPQSQTGNSETATPTNVDLPQVIPKSENSSQPAKKAKGAAKTKQQLQKQQHPKKASFQKLNGISKGADSELSTVPSVTKTQASSSFQDSSQPAGKAEGIREPKVTGKLKQRSPKLQSSKKVAFLRQNAPPKGTDTQTPAVLSPSKTQATLKPKDHHQPLGRAKGVEKQQLPEQPFEKAAFQKQNDTPKGPQPPTVSPIRSSRPPPAKRKKSQSRGNSQLLLS

SEQ ID NO: 57629 - protein, 628 aa, Homo sapiens
  Payload ID: 11306
  Gene Symbol: NOP2
  Gene Name: NOP2 nucleolar protein
  Uniprot ID: P46087
  ENSP ID: ENSP00000439422
MGRKLDPTKEKRGPGRKARKQKGAETELVRFLPAVSDENSKRLSSRARKRAAKRRLGSVEAPKTNKSPEAKPLPGKLPKGAVQTAGKKGPQSLFNAPRGKKRPAPGSDEEEEEEDSEEDGMVNHGDLWGSEDDADTVDDYGADSNSEDEEEGEALLPIERAARKQKAREAAAGIQWSEEETEDEEEEKEVTPESGPPKVEEADGGLQINVDEEPFVLPPAGEMEQDAQAPDLQRVHKRIQDIVGILRDFGAQREEGRSRSEYLNRLKKDLAIYYSYGDFLLGKLMDLFPLSELVEFLEANEVPRPVTLRTNTLKTRRRDLAQALINRGVNLDPLGKWSKTGLVVYDSSVPIGATPEYLAGHYMLQGASSMLPVMALAPQEHERILDMCCAPGGKTSYMAQLMKNTGVILANDANAERLKSVVGNLHRLGVTNTIISHYDGRQFPKVVGGFDRVLLDAPCSGTGVISKDPAVKTNKDEKDILRCAHLQKELLLSAIDSVNATSKTGGYLVYCTCSITVEENEWVVDYALKKRNVRLVPTGLDFGQEGFTRFRERRFHPSLRSTRRFYPHTHNMDGFFIAKFKKFSNSIPQSQTDGVLLCRSGWTAVVQSQLIATSTFQVQAILVPQTPK

SEQ ID NO: 57630 - protein, 275 aa, Homo sapiens
  Payload ID: 11306
  Gene Symbol: NOP2
  Gene Name: NOP2 nucleolar protein
  ENSP ID: ENSP00000440754
MVNHGDLWGSEDDADTVDDYGADSNSEDEEEGEALLPIERAARKQKAREAAAGIQWSEEETEDEEEEKEVTPESGPPKVEEADGGLQINVDEEPFVLPPAGEMEQDAQAPDLQRVHKRIQDIVGILRDFGAQREEGRSRSEYLNRLKKDLAIYYSYGDFLLGKLMDLFPLSELVEFLEANEVPRPVTLRTNTLKTRRRDLAQALINRGVNLDPLGKWSKTGLVVYDSSVPIGATPEYLAGHYMLQGASSMLPVMALAPQEHERILDMCCAPGGKT

SEQ ID NO: 57631 - protein, 159 aa, Homo sapiens
  Payload ID: 11306
  Gene Symbol: NOP2
  Gene Name: NOP2 nucleolar protein
  ENSP ID: ENSP00000441923
MGRKLDPTKEKRGPGRKARKQKGAETELVRFLPAVSDENSKRLSSRARKRAAKRRLGSVEAPKTNKSPEAKPLPGKLPKGISAGAVQTAGKKGPQSLFNAPRGKKRPAPGSDEEEEEEDSEEDGMVNHGDLWGSEDDADTVDDYGADSNSEDEEEGEAV

SEQ ID NO: 57632 - protein, 81 aa, Homo sapiens
  Payload ID: 11306
  Gene Symbol: NOP2
  Gene Name: NOP2 nucleolar protein
  ENSP ID: ENSP00000442742
MGRKLDPTKEKRGPGRKARKQKGAETELVRFLPAVSDENSKRLSSRARKRAAKRRLGSVEAPKTNKSPEAKPLPGKLPKGP

SEQ ID NO: 57633 - protein, 176 aa, Homo sapiens
  Payload ID: 11306
  Gene Symbol: NOP2
  Gene Name: NOP2 nucleolar protein
  ENSP ID: ENSP00000442895
MGRKLDPTKEKRGPGRKARKQKGAETELVRFLPAVSDENSKRLSSRARKRAAKRRLGSVEAPKTNKSPEAKPLPGKLPKGISAGAVQTAGKKGPQSLFNAPRGKKRPAPGSDEEEEEEDSEEDGMVNHGDLWGSEDDADTVDDYGADSNSEDEEEGEALLPIERAARKQKAREAAA

SEQ ID NO: 57634 - protein, 250 aa, Homo sapiens
  Payload ID: 11306
  Gene Symbol: NOP2
  Gene Name: NOP2 nucleolar protein
  ENSP ID: ENSP00000443035
MGRKLDPTKEKRGPGRKARKQKGAETELVRFLPAVSDENSKRLSSRARKRAAKRRLGSVEAPKTNKSPEAKPLPGKLPKGAVQTAGKKGPQSLFNAPRGKKRPAPGSDEEEEEEDSEEDGMVNHGDLWGSEDDADTVDDYGADSNSEDEEEGEALLPIERAARKQKAREAAAGIQWSEEETEDEEEEKEVTPESGPPKVEEADGGLQINVDEEPFVLPPAGEMEQDAQAPDLQRVHKRIQDIVGILRDFG

SEQ ID NO: 57635 - protein, 808 aa, Homo sapiens; identical to SEQ ID NO: 57628
  Payload ID: 11306
  Gene Symbol: NOP2
  Gene Name: NOP2 nucleolar protein
  Uniprot ID: P46087
  ENSP ID: ENSP00000443150

SEQ ID NO: 57636 - protein, 98 aa, Homo sapiens
  Payload ID: 11306
  Gene Symbol: NOP2
  Gene Name: NOP2 nucleolar protein
  ENSP ID: ENSP00000443585
MGRKLDPTKEKRGPGRKARKQKGAETELVRFLPAVSDENSKRPNHCLESYQKGSLQELSRQLVRRDPSPYLMLLEARSAQHLAVMRKRRRKTLKKMVW

SEQ ID NO: 57637 - protein, 812 aa, Homo sapiens; identical to SEQ ID NO: 57626
  Payload ID: 11306
  Gene Symbol: NOP2
  Gene Name: NOP2 nucleolar protein
  Uniprot ID: P46087
  ENSP ID: ENSP00000444437

SEQ ID NO: 57638 - protein, 81 aa, Homo sapiens; identical to SEQ ID NO: 57632
  Payload ID: 11306
  Gene Symbol: NOP2
  Gene Name: NOP2 nucleolar protein
  ENSP ID: ENSP00000445402

SEQ ID NO: 57639 - protein, 855 aa, Homo sapiens
  Payload ID: 11306
  Gene Symbol: NOP2
  Gene Name: NOP2 nucleolar protein
  ENSP ID: ENSP00000479236
MGRKLDPTKEKRGPGRKARKQKGAETELVRFLPAVSDENSKRLSSRARKRAAKRRLGSVEAPKTNKSPEAKPLPGKLPKGISAGAVQTAGKKGPQSLFNAPRGKKRPAPGSDEEEEEEDSEEDGMVNHGDLWGSEDDADTVDDYGADSNSEDEEEGEALLPIERAARKQKAREAAAGIQWSEEETEDEEEEKEVTPESGPPKVEEADGGLQINVDEEPFVLPPAGEMEQDAQAPDLQRVHKRIQDIVGILRDFGAQREEGRSRSEYLNRLKKDLAIYYSYGDFLLGKLMDLFPLSELVEFLEANEVPRPVTLRTNTLKTRRRDLAQALINRGVNLDPLGKWSKTGLVVYDSSVPIGATPEYLAGHYMLQGASSMLPVMALAPQEHERILDMCCAPGGKTSYMAQLMKNTGVILANDANAERLKSVVGNLHRLGVTNTIISHYDGRQFPKVVGGFDRVLLDAPCSGTGVISKDPAVKTNKDEKDILRCAHLQKELLLSAIDSVNATSKTGGYLVYCTCSITVEENEWVVDYALKKRNVRLVPTGLDFGQEGFTRFRERRFHPSLRSTRRFYPHTHNMDGFFIAKFKKFSNSIPQSQTGNSETATPTNVDLPQVIPKSENSSQPAKKAKGAAKTKQQLQKQQHPKKASFQKLNGISKGADSELSTVPSVTKTQASSSFQDSSQPAGKAEGIREPKVTGKLKQRSPKLQSSKKVAFLRQNAPPKGTDTQTPAVLSPSKTQATLKPKDHHQPLGRAKGVEKQQLPEQPFEKAAFQKQNDTPKGLSLPLCLPSVPAAPHQQRGRNLSPGATASCCYLRWLKTRRVAHCHCHQVGTLASVRMPSLLCIPMKFNTHFKTSGH

SEQ ID NO: 57640 - protein, 845 aa, Homo sapiens; identical to SEQ ID NO: 57627
  Payload ID: 11306
  Gene Symbol: NOP2
  Gene Name: NOP2 nucleolar protein
  Uniprot ID: P46087
  ENSP ID: ENSP00000479320

SEQ ID NO: 57641 - protein, 628 aa, Homo sapiens; identical to SEQ ID NO: 57629
  Payload ID: 11306
  Gene Symbol: NOP2
  Gene Name: NOP2 nucleolar protein
  Uniprot ID: P46087
  ENSP ID: ENSP00000484384

SEQ ID NO: 57642 - protein, 340 aa, Homo sapiens
  Payload ID: 11307
  Gene Symbol: NSUN3
  Gene Name: NOP2/Sun domain family, member 3
  Uniprot ID: Q9H649
  ENSP ID: ENSP00000318986
MLTQLKAKSEGKLAKQICKVVLDHFEKQYSKELGDAWNTVREILTSPSCWQYAVLLNRFNYPFELEKDLHLKGYHTLSQGSLPNYPKSVKCYLSRTPGRIPSERHQIGNLKKYYLLNAASLLPVLALELRDGEKVLDLCAAPGGKSIALLQCACPGYLHCNEYDSLRLRWLRQTLESFIPQPLINVIKVSELDGRKMGDAQPEMFDKVLVDAPCSNDRSWLFSSDSQKASCRISQRRNLPLLQIELLRSAIKALRPGGILVYSTCTLSKAENQDVISEILNSHGNIMPMDIKGIARTCSHDFTFAPTGQECGLLVIPDKGKAWGPMYVAKLKKSWSTGKW

SEQ ID NO: 57643 - protein, 77 aa, Homo sapiens
  Payload ID: 11307
  Gene Symbol: NSUN3
  Gene Name: NOP2/Sun domain family, member 3
  ENSP ID: ENSP00000419297
MLTQLKAKSEGKLAKQICKVVLDHFEKQYSKELGDAWNTVSVGSGIKGWGEGSGSLCCSWREINSSAAVCLSRLSSL

SEQ ID NO: 57644 - protein, 384 aa, Homo sapiens
  Payload ID: 11308
  Gene Symbol: NSUN4
  Gene Name: NOP2/Sun domain family, member 4
  Uniprot ID: Q96CB9
  ENSP ID: ENSP00000419740
MAALTLRGVRELLKRVDLATVPRRHRYKKKWAATEPKFPAVRLALQNFDMTYSVQFGDLWPSIRVSLLSEQKYGALVNNFAAWDHVSAKLEQLSAKDFVNEAISHWELQSEGGQSAAPSPASWACSPNLRCFTFDRGDISRFPPARPGSLGVMEYYLMDAASLLPVLALGLQPGDIVLDLCAAPGGKTLALLQTGCCRNLAANDLSPSRIARLQKILHSYVPEEIRDGNQVRVTSWDGRKWGELEGDTYDRVLVDVPCTTDRHSLHEEENNIFKRSRKKERQILPVLQVQLLAAGLLATKPGGHVVYSTCSLSHLQNEYVVQGAIELLANQYSIQVQVEDLTHFRRVFMDTFCFFSSCQVGELVIPNLMANFGPMYFCKMRRLT

SEQ ID NO: 57645 - protein, 335 aa, Homo sapiens
  Payload ID: 11308
  Gene Symbol: NSUN4
  Gene Name: NOP2/Sun domain family, member 4
  Uniprot ID: Q96CB9
  ENSP ID: ENSP00000437758
MTYSVQFGDLWPSIRVSLLSEQKYGALVNNFAAWDHVSAKLEQLSAKDFVNEAISHWELQSEGGQSAAPSPASWACSPNLRCFTFDRGDISRFPPARPGSLGVMEYYLMDAASLLPVLALGLQPGDIVLDLCAAPGGKTLALLQTGCCRNLAANDLSPSRIARLQKILHSYVPEEIRDGNQVRVTSWDGRKWGELEGDTYDRVLVDVPCTTDRHSLHEEENNIFKRSRKKERQILPVLQVQLLAAGLLATKPGGHVVYSTCSLSHLQNEYVVQGAIELLANQYSIQVQVEDLTHFRRVFMDTFCFFSSCQVGELVIPNLMANFGPMYFCKMRRLT

SEQ ID NO: 57646 - protein, 151 aa, Homo sapiens
  Payload ID: 11308
  Gene Symbol: NSUN4
  Gene Name: NOP2/Sun domain family, member 4
  ENSP ID: ENSP00000471937
MAALTLRGVRELLKRVDLATVPRRHRYKKKWAATEPKFPAVRLALQNFDMTYSVQFGDLWPSIRVSLLSEQKYGALVNNFAAWDHVSAKLEQLSAKDFVNEAISHWELQSEGGQSAAPSPASWACSPNLRCFTFDRGDISRFPPARQSCCQ

SEQ ID NO: 57647 - protein, 136 aa, Homo sapiens
  Payload ID: 11308
  Gene Symbol: NSUN4
  Gene Name: NOP2/Sun domain family, member 4
  ENSP ID: ENSP00000477553
  MOD_RES (1)..(1): Any amino acid
XVASQGPCKEPLQIPYSCPLPSSKDSSCSTNPSCSSTIISKCQSSDSESRSSHQSQSRSQSKSPHDGRSQSWSKRHHLSRSPSQKSSPYPSRSWGRSSNPQQNTSQGQSESPQLSINEHQGESPQISRGQGKSKSL

SEQ ID NO: 57648 - protein, 652 aa, Homo sapiens
  Payload ID: 11308
  Gene Symbol: NSUN4
  Gene Name: NOP2/Sun domain family, member 4
  ENSP ID: ENSP00000478740
MRRPCLQGTYCDQHTNLCYSSGWPSAFGTSPATSFPLAHQSPGTSPVTSPQLTHVPLETGPMISPPPTHRTPGTCLTISPPLARRPVETSPMASPTLSHRVLETGLMISLPSHWFSGRSYNDPLLSPASSPPTGSFYHGSLKPLDSCEPKPQLDLPLEKNCCGFPLSSQAGMPGSPSSPQEGSYHYSHLSSEAYIPTPGSPCYAICLCPGSTDSPCSPQSQAPRKACIESLLSWEATGNSYLILTPDTTTSGPPCSQEPSRPHGPHSVLSFPSPLGNQFISPPQSLPRRSYNEPPLPTPVSPQPKSPKSPELRQSHTPHKCLSLVNTPQHTPSGQPKPAKAHTCPPPPSCLSGPSCMQPYITTPSNSSPKELPPGTTLLTVVPRALKSVIPTSFPLCLPCDPVSANSYAQSSRHGPSIGPPCNTHICSVVPSTPHPCPLSGSLNHSTGPPPIVPLCDTYSTPRGPPQPRCQPVMPPCSTHIYSFIPLRTPFDPQSLPIVPRVRAYPDTVPCGLHIYPVASQGPCKEPLQIPYSCPLPSSKDSSCSTNPSCSSTIISKCQSSDSESRSSHQSQSRSQSKSPHDGRSQSWSKRHHLSRSPSQKSSPYPSRSWGRSSNPQQNTSQGQSESPQLSINEHQGESPQISRGQGKSKSL

SEQ ID NO: 57649 - protein, 106 aa, Homo sapiens
  Payload ID: 11308
  Gene Symbol: NSUN4
  Gene Name: NOP2/Sun domain family, member 4
  ENSP ID: ENSP00000478949
MAALTLRGVRELLKRVDLATVPRRHRYKKKWPGRPHPSENTIATLPALLGLRRLAGKDSAPSSTSSCLWRPGKVTATTLSILPAQTLAKGCHRAQIPCCSTGFAEF

SEQ ID NO: 57650 - protein, 54 aa, Homo sapiens
  Payload ID: 11308
  Gene Symbol: NSUN4
  Gene Name: NOP2/Sun domain family, member 4
  ENSP ID: ENSP00000483680
MAALTLRGVRELLKRVDLATVPRRHRYKKKWPVLSLLGCHRAQIPCCSTGFAEF

SEQ ID NO: 57651 - protein, 429 aa, Homo sapiens
  Payload ID: 11309
  Gene Symbol: NSUN5
  Gene Name: NOP2/Sun domain family, member 5
  Uniprot ID: Q96P11
  ENSP ID: ENSP00000252594
MGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPR

SEQ ID NO: 57652 - protein, 470 aa, Homo sapiens
  Payload ID: 11309
  Gene Symbol: NSUN5
  Gene Name: NOP2/Sun domain family, member 5
  Uniprot ID: Q96P11
  ENSP ID: ENSP00000309126
MGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPSLTGQSISTRTHTQPSPKEKEETAKSRSRCLHTALHIAEAPG

SEQ ID NO: 57653 - protein, 466 aa, Homo sapiens
  Payload ID: 11309
  Gene Symbol: NSUN5
  Gene Name: NOP2/Sun domain family, member 5
  Uniprot ID: Q96P11
  ENSP ID: ENSP00000388464
MGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPSSASQAKASAPERTPSPAPKRKKRQQRAAAGACTPPCT

SEQ ID NO: 57654 - protein, 391 aa, Homo sapiens
  Payload ID: 11309
  Gene Symbol: NSUN5
  Gene Name: NOP2/Sun domain family, member 5
  Uniprot ID: Q96P11
  ENSP ID: ENSP00000393081
MGLYAAAAGVLAGVESRQGSIKGLVYSSNFQNVKQLYALVCETQRYSAVLDAVIASAGLLRAEKKLRPHLAKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIFAFDLDAKRLASMATLLARAGVSCCELAEEDFLAVSPSDPRYHEVHYILLDPSCSGSGMPSRQLEEPGAGTPSPVRLHALAGFQQRALCHALTFPSLQRLVYSTCSLCQEENEDVVRDALQQNPGAFRLAPALPAWPHRGLSTFPGAEHCLRASPETTLSSGFFVAVIERVEVPR

SEQ ID NO: 57655 - protein, 58 aa, Homo sapiens
  Payload ID: 11309
  Gene Symbol: NSUN5
  Gene Name: NOP2/Sun domain family, member 5
  ENSP ID: ENSP00000405757
  MOD_RES (1)..(1): Any amino acid
XREAAVRAGVRNAALLRRAGCCDRQRRPPPCGEEAAAAPGQASMTYEPSRGSIFSWTP

SEQ ID NO: 57656 - protein, 469 aa, Homo sapiens
  Payload ID: 11310
  Gene Symbol: NSUN6
  Gene Name: NOP2/Sun domain family, member 6
  Uniprot ID: Q8TEA1
  ENSP ID: ENSP00000366519
MSIFPKISLRPEVENYLKEGFMNKEIVTALGKQEAERKFETLLKHLSHPPSFTTVRVNTHLASVQHVKNLLLDELQKQFNGLSVPILQHPDLQDVLLIPVIGPRKNIKKQQCEAIVGAQCGNAVLRGAHVYAPGIVSASQFMKAGDVISVYSDIKGKCKKGAKEFDGTKVFLGNGISELSRKEIFSGLPELKGMGIRMTEPVYLSPSFDSVLPRYLFLQNLPSALVSHVLNPQPGEKILDLCAAPGGKTTHIAALMHDQGEVIALDKIFNKVEKIKQNALLLGLNSIRAFCFDGTKAVKLDMVEDTEGEPPFLPESFDRILLDAPCSGMGQRPNMACTWSVKEVASYQPLQRKLFTAAVQLLKPEGVLVYSTCTITLAENEEQVAWALTKFPCLQLQPQEPQIGGEGMRGAGLSCEQLKQLQRFDPSAVPLPDTDMDSLREARREDMLRLANKDSIGFFIAKFVKCKST

SEQ ID NO: 57657 - protein, 149 aa, Homo sapiens
  Payload ID: 11310
  Gene Symbol: NSUN6
  Gene Name: NOP2/Sun domain family, member 6
  ENSP ID: ENSP00000476221
MFHKRGKKNGKFSIVTALGKQEAERKFETLLKHLSHPPSFTTVRVNTHLASVQHVKNLLLDELQKQFNGLSVPILQHPDLQDVLLIPVIGPRKNIKKQQCEAIVGAQCGNAVLRGAHVYAPGIVSASQFMKAGDVISVYSDIKGKCKKG

SEQ ID NO: 57658 - protein, 35 aa, Homo sapiens
  Payload ID: 11310
  Gene Symbol: NSUN6
  Gene Name: NOP2/Sun domain family, member 6
  ENSP ID: ENSP00000486203
MFHKRGKKNGKFSVRYIVLFLEIKMNQSKIDFLFV

SEQ ID NO: 57659 - protein, 475 aa, Homo sapiens
  Payload ID: 11311
  Gene Symbol: NSUN7
  Gene Name: NOP2/Sun domain family, member 7
  Uniprot ID: Q8NE18
  ENSP ID: ENSP00000319127
MLNSTGELEFSNEEDPEIISQLTSLPLSGGKSSAGVPEKTGYPDSVYVMAANIFQGIRIEKSAQKVLIKYGNEPLRSLSESEDQSFQRLSYELAFSALKYQDILETILIDSCIFPSTTIPDHLSSLIIVMLYDFQDRKFQTRVLSDNEEPISEVQEVENLLNSFKIKLAAALARCRIKHDALSIYHILPETVRKQELRASTLPLYAWINTCKISPEEVYNNLKRRGYNKVKSVLHIDDKVFAVDQHCYDVLIFPSHLKNDLINIDLFKDYKLIFQDKSRSLAVHSVKALLNMDDDVLMVNTGSWYTVSHMSILTNNNTSKVFVCGVQSQAKDPDLKTLFTKIGCKNIEILHEKFINIESKDHRLQKVKVILLLPRCSGLGVSNPVEFILNEHEDTEFLKDHSQGGISVDKLHVLAQQQYEQLTHAMKFTKAQAVVYCTCSVFPEENEAVVKKALEFQDLGNKGQPYSGTLLRQCL

SEQ ID NO: 57660 - protein, 718 aa, Homo sapiens
  Payload ID: 11311
  Gene Symbol: NSUN7
  Gene Name: NOP2/Sun domain family, member 7
  Uniprot ID: Q8NE18
  ENSP ID: ENSP00000371201
MLNSTGELEFSNEEDPEIISQLTSLPLSGGKSSAGVPEKTGYPDSVYVMAANIFQGIRIEKSAQKVLIKYGNEPLRSLSESEDQSFQRLSYELAFSALKYQDILETILIDSCIFPSTTIPDHLSSLIIVMLYDFQDRKFQTRVLSDNEEPISEVQEVENLLNSFKIKLAAALARCRIKHDALSIYHILPETVRKQELRASTLPLYAWINTCKISPEEVYNNLKRRGYNKVKSVLHIDDKVFAVDQHCYDVLIFPSHLKNDLINIDLFKDYKLIFQDKSRSLAVHSVKALLNMDDDVLMVNTGSWYTVSHMSILTNNNTSKVFVCGVQSQAKDPDLKTLFTKIGCKNIEILHEKFINIESKDHRLQKVKVILLLPRCSGLGVSNPVEFILNEHEDTEFLKDHSQGGISVDKLHVLAQQQYEQLTHAMKFTKAQAVVYCTCSVFPEENEAVVKKALEFQDLGNKGQPYRLSPPVLPLCSLKEIQLSTDKFFRMEPSEITNGCFLSILTRERDPSETVSVNDVLARAAAKGLLDGIELGKSSKREKKKKKSKTSLTKGATTDNGIQMKIAEFLNRETKASANLSETVTKPPLPQKNTAQVGASSQTRKPNKLAPHPAVPAFVKNTCPSRPRERQTHFLRPRPEDRMVALKPIKIVLPPVFMPFSSPQGIRSRMPTQHLYCRWVAPKALVPTCLPTHSLSRKEEKPKDDTPSSLLRPPRRWL

SEQ ID NO: 57661 - protein, 767 aa, Homo sapiens
  Payload ID: 11312
  Gene Symbol: NSUN2
  Gene Name: NOP2/Sun RNA methyltransferase family, member 2
  Uniprot ID: Q08J23
  ENSP ID: ENSP00000264670
MGRRSRGRRLQQQQRPEDAEDGAEGGGKRGEAGWEGGYPEIVKENKLFEHYYQELKIVPEGEWGQFMDALREPLPATLRITGYKSHAKEILHCLKNKYFKELEDLEVDGQKVEVPQPLSWYPEELAWHTNLSRKILRKSPHLEKFHQFLVSETESGNISRQEAVSMIPPLLLNVRPHHKILDMCAAPGSKTTQLIEMLHADMNVPFPEGFVIANDVDNKRCYLLVHQAKRLSSPCIMVVNHDASSIPRLQIDVDGRKEILFYDRILCDVPCSGDGTMRKNIDVWKKWTTLNSLQLHGLQLRIATRGAEQLAEGGRMVYSTCSLNPIEDEAVIASLLEKSEGALELADVSNELPGLKWMPGITQWKVMTKDGQWFTDWDAVPHSRHTQIRPTMFPPKDPEKLQAMHLERCLRILPHHQNTGGFFVAVLVKKSSMPWNKRQPKLQGKSAETRESTQLSPADLTEGKPTDPSKLESPSFTGTGDTEIAHATEDLENNGSKKDGVCGPPPSKKMKLFGFKEDPFVFIPEDDPLFPPIEKFYALDPSFPRMNLLTRTTEGKKRQLYMVSKELRNVLLNNSEKMKVINTGIKVWCRNNSGEEFDCAFRLAQEGIYTLYPFINSRIITVSMEDVKILLTQENPFFRKLSSETYSQAKDLAKGSIVLKYEPDSANPDALQCPIVLCGWRGKASIRTFVPKNERLHYLRMMGLEVLGEKKKEGVILTNESAASTGQPDNDVTEGQRAGEPNSPDAEEANSPDVTAGCDPAGVHPPR

SEQ ID NO: 57662 - protein, 732 aa, Homo sapiens
  Payload ID: 11312
  Gene Symbol: NSUN2
  Gene Name: NOP2/Sun RNA methyltransferase family, member 2
  Uniprot ID: Q08J23
  ENSP ID: ENSP00000420957
MGRRSRGRRLQQQQRPEDAEDGAEGGGKRGEAGWEGGYPEIVKENKLFEHYYQELKIVPEGEWGQFMDALREPLPATLRITGYKRYPEELAWHTNLSRKILRKSPHLEKFHQFLVSETESGNISRQEAVSMIPPLLLNVRPHHKILDMCAAPGSKTTQLIEMLHADMNVPFPEGFVIANDVDNKRCYLLVHQAKRLSSPCIMVVNHDASSIPRLQIDVDGRKEILFYDRILCDVPCSGDGTMRKNIDVWKKWTTLNSLQLHGLQLRIATRGAEQLAEGGRMVYSTCSLNPIEDEAVIASLLEKSEGALELADVSNELPGLKWMPGITQWKVMTKDGQWFTDWDAVPHSRHTQIRPTMFPPKDPEKLQAMHLERCLRILPHHQNTGGFFVAVLVKKSSMPWNKRQPKLQGKSAETRESTQLSPADLTEGKPTDPSKLESPSFTGTGDTEIAHATEDLENNGSKKDGVCGPPPSKKMKLFGFKEDPFVFIPEDDPLFPPIEKFYALDPSFPRMNLLTRTTEGKKRQLYMVSKELRNVLLNNSEKMKVINTGIKVWCRNNSGEEFDCAFRLAQEGIYTLYPFINSRIITVSMEDVKILLTQENPFFRKLSSETYSQAKDLAKGSIVLKYEPDSANPDALQCPIVLCGWRGKASIRTFVPKNERLHYLRMMGLEVLGEKKKEGVILTNESAASTGQPDNDVTEGQRAGEPNSPDAEEANSPDVTAGCDPAGVHPPR

SEQ ID NO: 57663 - protein, 202 aa, Homo sapiens
  Payload ID: 11312
  Gene Symbol: NSUN2
  Gene Name: NOP2/Sun RNA methyltransferase family, member 2
  ENSP ID: ENSP00000421783
MGRRSRGRRLQQQQRPEDAEDGAEGGGKRGEAGWEGGYPEIVKENKLFEHYYQELKIVPEGEWGQFMDALREPLPATLRITGYKSHAKEILHCLKNKYFKELEDLEVDGQKVEVPQPLSWYPEELAWHTNLSRKILRKSPHLEKFHQFLVSETESGNISRQEAVSMIPPLLLNVRPHHKRDLLLRMMWTTSAATCSSIKPRG

SEQ ID NO: 57664 - protein, 102 aa, Homo sapiens
  Payload ID: 11312
  Gene Symbol: NSUN2
  Gene Name: NOP2/Sun RNA methyltransferase family, member 2
  ENSP ID: ENSP00000426459
  MOD_RES (1)..(1): Any amino acid
XAHATEDLENNGSKKDGVCGPPPSKKMKLFGFKEDPFVFIPEDDPLFPPIELLTRGSKSGVEITAVKSLTVLSGWHRREYIHCIHLLTQELLLYQWKMLRYC

SEQ ID NO: 57665 - protein, 594 aa, Homo sapiens
  Payload ID: 11313
  Gene Symbol: NOP56
  Gene Name: NOP56 ribonucleoprotein
  Uniprot ID: O00567
  ENSP ID: ENSP00000370589
MVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMGMDISAIDLINIESFSSRVVSLSEYRQSLHTYLRSKMSQVAPSLSALIGEAVGARLIAHAGSLTNLAKYPASTVQILGAEKALFRALKTRGNTPKYGLIFHSTFIGRAAAKNKGRISRYLANKCSIASRIDCFSEVPTSVFGEKLREQVEERLSFYETGEIPRKNLDVMKEAMVQAEEAAAEITRKLEKQEKKRLKKEKKRLAALALASSENSSSTPEECEEMSEKPKKKKKQKPQEVPQENGMEDPSISFSKPKKKKSFSKEELMSSDLEETAGSTSIPKRKKSTPKEETVNDPEEAGHRSGSKKKRKFSKEEPVSSGPEEAVGKSSSKKKKKFHKASQED

SEQ ID NO: 57666 - protein, 281 aa, Homo sapiens
  Payload ID: 11313
  Gene Symbol: NOP56
  Gene Name: NOP56 ribonucleoprotein
  ENSP ID: ENSP00000388497
MVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVRQSRCGEGKAVALWFLMKQLGQGVTVALCREWYGYHFPELVKIINDNATYCRLAQFIGNRRELNEDKLEKLEELTMDGAKAKAILDASRSSM

SEQ ID NO: 57667 - protein, 219 aa, Homo sapiens
  Payload ID: 11313
  Gene Symbol: NOP56
  Gene Name: NOP56 ribonucleoprotein
  ENSP ID: ENSP00000403199
  MOD_RES (1)..(1): Any amino acid
XLINIESFSSRVVSLSEYRQSLHTYLRSKMSQVAPSLSALIGEAVGARLIAHAGSLTNLAKYPASTVQILGAEKALFRALKTRGNTPKYGLIFHSTFIGRAAAKNKGRISRYLANKCSIASRIDCFSEVPTSVFGEKLREQVEERLSFYETGEIPRKNLDVMKEAMVQAEEAAAEITRKLEKQEKKRLKKEKKRLAALALASSENSSSTPEECEEGDRC

SEQ ID NO: 57668 - protein, 252 aa, Homo sapiens
  Payload ID: 11313
  Gene Symbol: NOP56
  Gene Name: NOP56 ribonucleoprotein
  ENSP ID: ENSP00000434317
  MOD_RES (1)..(1): Any amino acid
XLEKLEELTMDGAKAKAILDASRSSMGMDISAIDLINIESFSSRVVSLSEYRQSLHTYLRSKMSQVAPSLSALIGEAVGARLIAHAGSLTNLAKYPASTVQILGAEKALFRALKTRGNTPKYGLIFHSTFIGRAAAKNKGRISRYLANKCSIASRIDCFSEVPTSVFGEKLREQVEERLSFYETGEIPRKNLDVMKEAMVQAEEAAAEITRKLEKQEKKRLKKEKKRLAALALASSENSSSTPEECEEGDRC

SEQ ID NO: 57669 - protein, 529 aa, Homo sapiens
  Payload ID: 11314
  Gene Symbol: NOP58
  Gene Name: NOP58 ribonucleoprotein
  Uniprot ID: Q9Y2X3
  ENSP ID: ENSP00000264279
MLVLFETSVGYAIFKVLNEKKLQEVDSLWKEFETPEKANKIVKLKHFEKFQDTAEALAAFTALMEGKINKQLKKVLKKIVKEAHEPLAVADAKLGGVIKEKLNLSCIHSPVVNELMRGIRSQMDGLIPGVEPREMAAMCLGLAHSLSRYRLKFSADKVDTMIVQAISLLDDLDKELNNYIMRCREWYGWHFPELGKIISDNLTYCKCLQKVGDRKNYASAKLSELLPEEVEAEVKAAAEISMGTEVSEEDICNILHLCTQVIEISEYRTQLYEYLQNRMMAIAPNVTVMVGELVGARLIAHAGSLLNLAKHAASTVQILGAEKALFRALKSRRDTPKYGLIYHASLVGQTSPKHKGKISRMLAAKTVLAIRYDAFGEDSSSAMGVENRAKLEARLRTLEDRGIRKISGTGKALAKTEKYEHKSEVKTYDPSGDSTLPTCSKKRKIEQVDKEDEITEKKAKKAKIKVKVEEEEEEKVAEEEETSVKKKKKRGKKKHIKEEPLSEEEPCTSTAIASPEKKKKKKKKRENED

SEQ ID NO: 57670 - protein, 187 aa, Homo sapiens
  Payload ID: 11314
  Gene Symbol: NOP58
  Gene Name: NOP58 ribonucleoprotein
  ENSP ID: ENSP00000388126
EPREMAAMCLGLAHSLSRYRLKFSADKVDTMIVQAISLLDDLDKELNNYIMRCREWYGWHFPELGKIISDNLTYCKCLQKVGDRKNYASAKLSELLPEEVEAEVKAAAEISMGTEVSEEDICNILHLCTQVIEISEYRTQLYEYLQNRMMAIAPNVTVMVGELVGARLIAHADFSNAGSQNRFGYPL

SEQ ID NO: 57671 - protein, 68 aa, Homo sapiens
  Payload ID: 11314
  Gene Symbol: NOP58
  Gene Name: NOP58 ribonucleoprotein
  ENSP ID: ENSP00000388905
MLVLFETSVGYAIFKVLNEKKLQEVDSLWKEFETPEKANKIVKLKHFEKFQDTAEALAGLVFPMCEER

SEQ ID NO: 57672 - protein, 636 aa, Homo sapiens
  Payload ID: 11315
  Gene Symbol: NOP9
  Gene Name: NOP9 nucleolar protein
  Uniprot ID: Q86U38
  ENSP ID: ENSP00000267425
MGQGPRSPHKVGRRFPAGGKRGRGAKGSGRPLPGRKRQPWPPPDGRSEPAPDSHPHLSPEALGYFRRALSALKEAPETGEERDLMVHNIMKEVETQALALSTNRTGSEMLQELLGFSPLKPLCRVWAALRSNLRTVACHRCGVHVLQSALLQLPRLLGSAAEEEEEEEEDGKDGPTETLEELVLGLAAEVCDDFLVYCGDTHGSFVVRTLLQVLGGTILESERARPRGSQSSEAQKTPAQECKPADFEVPETFLNRLQDLSSSFLKDIAVFITDKISSFCLQVALQVLHRKLPQFCAHLCNAVIGYLSTRGSSVDGSPLLLFLRDQTSSRLLEQVLLVLEPPRLQSLFEEHLQGQLQTLAAHPIANFPLQRLLDAVTTPELLSPVFEELSPVLEAVLAQGHPGVVIALVGACRRVGAYQAKVLQLLLEAFHCAEPSSRQVACVPLFATLMAYEVYYGLTEEEGAVPAEHQVAMAAARALGDVTVLGSLLLQHLLHFSTPGLVLRSLGALTGPQLLSLAQSPAGSHVLDAILTSPSVTRKLRRRVLQNLKGQYVALACSRHGSRVLDAIWSGAALRARKEIAAELGEQNQELIRDPFGHHVARNVALTTFLKRREAWEQQQGAVAKRRRALNSILED

SEQ ID NO: 57673 - protein, 535 aa, Homo sapiens
  Payload ID: 11315
  Gene Symbol: NOP9
  Gene Name: NOP9 nucleolar protein
  Uniprot ID: Q86U38
  ENSP ID: ENSP00000380020
MGQGPRSPHKVGRRFPAGGKRGRGAKGSGRPLPGRKRQPWPPPDGRSEPAPDSHPHLSPEALGYFRRALSALKEAPETGEERDLMVHNIMKEVETQALALSTNRTGSEMLQELLGFSPLKPLCRVWAALRSNLRTVACHRCGVHVLQSALLQLPRLLGSAAEEEEEEEEDGKDGPTETLEELVLGLAAEVCDDFLVYCGDTHGSFVVRTLLQVLGGTILESERARPRGSQSSEAQKTPAQECKPADFEVPETFLNRLQDLSSSFLKDIAVFITDKISSFCLQVALQVLHRKLPQFCAHLCNAVIGYLSTRGSSVDGSPLLLFLRDQTSSRLLEQVLLVLEPPRLQSLFEEHLQGQLQTLAAHPIANFPLQRLLDAVTTPELLSPVFEELSPVLEAVLAQGHPGVVIALVGACRRVGAYQAKVLQLLLEAFHCAEPSSRQVACVPLFATLMAYEVYYGLTEEEGAVPAEHQVAMAAARALGDVTVLGSLLLQHLLHFSTPGLVLRSLGALTGPQLLSLAQRPGRKLLLSLGSRTRS

SEQ ID NO: 57674 - protein, 97 aa, Homo sapiens
  Payload ID: 11315
  Gene Symbol: NOP9
  Gene Name: NOP9 nucleolar protein
  ENSP ID: ENSP00000451905
  MOD_RES (1)..(1): Any amino acid
XVTTPELLSPVFEELSPVLEAVLAQGHPGVVIALVGACRRVGAYQAKVLQLLLEAFHCAEPSSRQVACVPLFATLMAYEVYYGLTEEEGAVPAEHQG

SEQ ID NO: 57675 - protein, 133 aa, Homo sapiens
  Payload ID: 11316
  Gene Symbol: NDP
  Gene Name: Norrie disease (pseudoglioma)
  Uniprot ID: Q00604
  ENSP ID: ENSP00000367301
MRKHVLAASFSMLSLLVIMGDTDSKTDSSFIMDSDPRRCMRHHYVDSISHPLYKCSSKMVLLARCEGHCSQASRSEPLVSFSTVLKQPFRSSCHCCRPQTSKLKALRLRCSGGMRLTATYRYILSCHCEECNS

SEQ ID NO: 57676 - protein, 2555 aa, Homo sapiens
  Payload ID: 11317
  Gene Symbol: NOTCH1
  Gene Name: notch 1
  Uniprot ID: P46531
  ENSP ID: ENSP00000277541
MPPLLAPLLCLALLPALAARGPRCSQPGETCLNGGKCEAANGTEACVCGGAFVGPRCQDPNPCLSTPCKNAGTCHVVDRRGVADYACSCALGFSGPLCLTPLDNACLTNPCRNGGTCDLLTLTEYKCRCPPGWSGKSCQQADPCASNPCANGGQCLPFEASYICHCPPSFHGPTCRQDVNECGQKPGLCRHGGTCHNEVGSYRCVCRATHTGPNCERPYVPCSPSPCQNGGTCRPTGDVTHECACLPGFTGQNCEENIDDCPGNNCKNGGACVDGVNTYNCRCPPEWTGQYCTEDVDECQLMPNACQNGGTCHNTHGGYNCVCVNGWTGEDCSENIDDCASAACFHGATCHDRVASFYCECPHGRTGLLCHLNDACISNPCNEGSNCDTNPVNGKAICTCPSGYTGPACSQDVDECSLGANPCEHAGKCINTLGSFECQCLQGYTGPRCEIDVNECVSNPCQNDATCLDQIGEFQCICMPGYEGVHCEVNTDECASSPCLHNGRCLDKINEFQCECPTGFTGHLCQYDVDECASTPCKNGAKCLDGPNTYTCVCTEGYTGTHCEVDIDECDPDPCHYGSCKDGVATFTCLCRPGYTGHHCETNINECSSQPCRHGGTCQDRDNAYLCFCLKGTTGPNCEINLDDCASSPCDSGTCLDKIDGYECACEPGYTGSMCNINIDECAGNPCHNGGTCEDGINGFTCRCPEGYHDPTCLSEVNECNSNPCVHGACRDSLNGYKCDCDPGWSGTNCDINNNECESNPCVNGGTCKDMTSGYVCTCREGFSGPNCQTNINECASNPCLNQGTCIDDVAGYKCNCLLPYTGATCEVVLAPCAPSPCRNGGECRQSEDYESFSCVCPTGWQGQTCEVDINECVLSPCRHGASCQNTHGGYRCHCQAGYSGRNCETDIDDCRPNPCHNGGSCTDGINTAFCDCLPGFRGTFCEEDINECASDPCRNGANCTDCVDSYTCTCPAGFSGIHCENNTPDCTESSCFNGGTCVDGINSFTCLCPPGFTGSYCQHDVNECDSQPCLHGGTCQDGCGSYRCTCPQGYTGPNCQNLVHWCDSSPCKNGGKCWQTHTQYRCECPSGWTGLYCDVPSVSCEVAAQRQGVDVARLCQHGGLCVDAGNTHHCRCQAGYTGSYCEDLVDECSPSPCQNGATCTDYLGGYSCKCVAGYHGVNCSEEIDECLSHPCQNGGTCLDLPNTYKCSCPRGTQGVHCEINVDDCNPPVDPVSRSPKCFNNGTCVDQVGGYSCTCPPGFVGERCEGDVNECLSNPCDARGTQNCVQRVNDFHCECRAGHTGRRCESVINGCKGKPCKNGGTCAVASNTARGFICKCPAGFEGATCENDARTCGSLRCLNGGTCISGPRSPTCLCLGPFTGPECQFPASSPCLGGNPCYNQGTCEPTSESPFYRCLCPAKFNGLLCHILDYSFGGGAGRDIPPPLIEEACELPECQEDAGNKVCSLQCNNHACGWDGGDCSLNFNDPWKNCTQSLQCWKYFSDGHCDSQCNSAGCLFDGFDCQRAEGQCNPLYDQYCKDHFSDGHCDQGCNSAECEWDGLDCAEHVPERLAAGTLVVVVLMPPEQLRNSSFHFLRELSRVLHTNVVFKRDAHGQQMIFPYYGREEELRKHPIKRAAEGWAAPDALLGQVKASLLPGGSEGGRRRRELDPMDVRGSIVYLEIDNRQCVQASSQCFQSATDVAAFLGALASLGSLNIPYKIEAVQSETVEPPPPAQLHFMYVAAAAFVLLFFVGCGVLLSRKRRRQHGQLWFPEGFKVSEASKKKRREPLGEDSVGLKPLKNASDGALMDDNQNEWGDEDLETKKFRFEEPVVLPDLDDQTDHRQWTQQHLDAADLRMSAMAPTPPQGEVDADCMDVNVRGPDGFTPLMIASCSGGGLETGNSEEEEDAPAVISDFIYQGASLHNQTDRTGETALHLAARYSRSDAAKRLLEASADANIQDNMGRTPLHAAVSADAQGVFQILIRNRATDLDARMHDGTTPLILAARLAVEGMLEDLINSHADVNAVDDLGKSALHWAAAVNNVDAAVVLLKNGANKDMQNNREETPLFLAAREGSYETAKVLLDHFANRDITDHMDRLPRDIAQERMHHDIVRLLDEYNLVRSPQLHGAPLGGTPTLSPPLCSPNGYLGSLKPGVQGKKVRKPSSKGLACGSKEAKDLKARRKKSQDGKGCLLDSSGMLSPVDSLESPHGYLSDVASPPLLPSPFQQSPSVPLNHLPGMPDTHLGIGHLNVAAKPEMAALGGGGRLAFETGPPRLSHLPVASGTSTVLGSSSGGALNFTVGGSTSLNGQCEWLSRLQSGMVPNQYNPLRGSVAPGPLSTQAPSLQHGMVGPLHSSLAASALSQMMSYQGLPSTRLATQPHLVQTQQVQPQNLQMQQQNLQPANIQQQQSLQPPPPPPQPHLGVSSAASGHLGRSFLSGEPSQADVQPLGPSSLAVHTILPQESPALPTSLPSSLVPPVTAAQFLTPPSQHSYSSPVDNTPSHQLQVPEHPFLTPSPESPDQWSSSSPHSNVSDWSEGVSSPPTSMQSQIARIPEAFK

SEQ ID NO: 57677 - protein, 2471 aa, Homo sapiens
  Payload ID: 11318
  Gene Symbol: NOTCH2
  Gene Name: notch 2
  Uniprot ID: Q04721
  ENSP ID: ENSP00000256646
MPALRPALLWALLALWLCCAAPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGTGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPAPVHAQHALSFSNLHEMQPLAHGASTVLPSVSQLLSHHHIVSPGSGSAGSLSRLHPVPVPADWMNRMEVNETQYNEMFGMVLAPAEGTHPGIAPQSRPPEGKHITTPREPLPPIVTFQLIPKGSIAQPAGAPQPQSTCPPAVAGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 57678 - protein, 235 aa, Homo sapiens
  Payload ID: 11318
  Gene Symbol: NOTCH2
  Gene Name: notch 2
  ENSP ID: ENSP00000473427
MCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPETVRNKRNRALGKGQASLEWKRTR

SEQ ID NO: 57679 - protein, 863 aa, Homo sapiens [sequence omitted]

SEQ ID NO: 57680 - protein, 236 aa, Homo sapiens [sequence omitted]

SEQ ID NO: 57681 - protein, 236 aa, Homo sapiens; identical to SEQ ID NO: 56289
  Payload ID: 11319
  Gene Symbol: NOTCH2NL
  Gene Name: notch 2 N-terminal like
  Uniprot ID: Q7Z3S9
  ENSP ID: ENSP00000354929

SEQ ID NO: 57682 - protein, 236 aa, Homo sapiens; identical to SEQ ID NO: 56289
  Payload ID: 11319
  Gene Symbol: NOTCH2NL
  Gene Name: notch 2 N-terminal like
  Uniprot ID: Q7Z3S9
  ENSP ID: ENSP00000464060

SEQ ID NO: 57683 - protein, 230 aa, Homo sapiens
  Payload ID: 11319
  Gene Symbol: NOTCH2NL
  Gene Name: notch 2 N-terminal like
  Uniprot ID: Q7Z3S9
  ENSP ID: ENSP00000476330
MCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCLQGFTGQYCDSLYVPCAPSPCVNGGTCRQTGDFTFECNCLPATWPIFPKLLSLQEKESYC

SEQ ID NO: 57684 - protein, 2321 aa, Homo sapiens
  Payload ID: 11320
  Gene Symbol: NOTCH3
  Gene Name: notch 3
  Uniprot ID: Q9UM47
  ENSP ID: ENSP00000263388
MGPGARGRRRRRRPMSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQGPRCQQDVDECAGPAPCGPHGICTNLAGSFSCTCHGGYTGPSCDQDINDCDPNPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGPHGLGPLLCPPGAFLPGLKAAQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPAAGAHSSPPKARFLRVPSEHPYLTPSPESPEHWASPSPPSLSDWSESTPSPATATGAMATTTGALPAQPLPLSVPSSLAQAQTQLGPQPEVTPKRQVLA

SEQ ID NO: 57685 - protein, 177 aa, Homo sapiens
  Payload ID: 11320
  Gene Symbol: NOTCH3
  Gene Name: notch 3
  ENSP ID: ENSP00000468879
  MOD_RES (1)..(1): Any amino acid
XQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKVSPSPWSTGCQQWHSAIAIQPGQQSETLSKNKTK

SEQ ID NO: 57686 - protein, 117 aa, Homo sapiens
  Payload ID: 11320
  Gene Symbol: NOTCH3
  Gene Name: notch 3
  ENSP ID: ENSP00000470661
  MOD_RES (1)..(1): Any amino acid
XLMGEVATDWMDTECPEAKRLKVEEPGMGAEEAVDCRQWTQHHLVAADIRVAPAMALTPPQGDADADGMDVNVRGPDSHPKPLYRLGCPHGRWLNGTDPGGPPGSRGHGGRAHRQPC

SEQ ID NO: 57687 - protein, 1286 aa, Homo sapiens
  Payload ID: 11320
  Gene Symbol: NOTCH3
  Gene Name: notch 3
  ENSP ID: ENSP00000473138
GPGARGRRRRRRPMSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQDPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASC

SEQ ID NO: 57688 - protein, 2003 aa, Homo sapiens
  Payload ID: 11321
  Gene Symbol: NOTCH4
  Gene Name: notch 4
  Uniprot ID: Q99466
  ENSP ID: ENSP00000364163
MQPPSLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAKLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTGYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 57689 - protein, 2003 aa, Homo sapiens
  Payload ID: 11321
  Gene Symbol: NOTCH4
  Gene Name: notch 4
  ENSP ID: ENSP00000372751
MQPPSLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAKLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTVYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 57690 - protein, 2002 aa, Homo sapiens
  Payload ID: 11321
  Gene Symbol: NOTCH4
  Gene Name: notch 4
  ENSP ID: ENSP00000389207
MQPPSLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAQLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTGYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 57691 - protein, 1048 aa, Homo sapiens
  Payload ID: 11321
  Gene Symbol: NOTCH4
  Gene Name: notch 4
  Uniprot ID: Q99466
  ENSP ID: ENSP00000401321
CAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 57692 - protein, 2003 aa, Homo sapiens; identical to SEQ ID NO: 57688
  Payload ID: 11321
  Gene Symbol: NOTCH4
  Gene Name: notch 4
  Uniprot ID: Q99466
  ENSP ID: ENSP00000403447

SEQ ID NO: 57693 - protein, 2003 aa, Homo sapiens
  Payload ID: 11321
  Gene Symbol: NOTCH4
  Gene Name: notch 4
  Uniprot ID: Q99466
  ENSP ID: ENSP00000408335
MQPPSLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAQLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTGYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 57694 - protein, 2005 aa, Homo sapiens
  Payload ID: 11321
  Gene Symbol: NOTCH4
  Gene Name: notch 4
  ENSP ID: ENSP00000410674
MQPPSLLLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAQLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECEAQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTGYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 57695 - protein, 443 aa, Homo sapiens
  Payload ID: 11322
  Gene Symbol: NLE1
  Gene Name: notchless homolog 1 (Drosophila)
  ENSP ID: ENSP00000354075
MAAAVPDEAVARDVQRLLVQFQDEGGQLLGSPFDVPVDITPDRLQLVCNALLAQEDPLPLAFFVHDAEIVSSLGKTLESQAVETEKVLDIIYQPQAIFRVRAVTRCTSSLEGHSEAVISVAFSPTGKYLASGSGDTTILLWDPSTGKQVGRTLAGHSKWITGLSWEPLHANPECRYVASSSKDGSVRIWDTTAGRCERILTGHTQSVTCLRWGGDGLLYSASQDRTIKVWRAHDGVLCRTLQGHGHWVNTMALSTDYALRTGAFEPAEASVNPQDLQGSLQELKERALSRYNLVRGQGPERLVSGSDDFTLFLWSPAEDKKPLTRMTGHQALINQVLFSPDSRIVASASFDKSIKLWDGRTGKYLASLRGHVAAVYQIAWSADSRLLVSGSSDSTLKVWDVKAQKLAMDLPGHADEVYAVDWSPDGQRVASGGKDKCLRIWRR

SEQ ID NO: 57696 - protein, 485 aa, Homo sapiens
  Payload ID: 11322
  Gene Symbol: NLE1
  Gene Name: notchless homolog 1 (Drosophila)
  Uniprot ID: Q9NVX2
  ENSP ID: ENSP00000413572
MAAAVPDEAVARDVQRLLVQFQDEGGQLLGSPFDVPVDITPDRLQLVCNALLAQEDPLPLAFFVHDAEIVSSLGKTLESQAVETEKVLDIIYQPQAIFRVRAVTRCTSSLEGHSEAVISVAFSPTGKYLASGSGDTTVRFWDLSTETPHFTCKGHRHWVLSISWSPDGRKLASGCKNGQILLWDPSTGKQVGRTLAGHSKWITGLSWEPLHANPECRYVASSSKDGSVRIWDTTAGRCERILTGHTQSVTCLRWGGDGLLYSASQDRTIKVWRAHDGVLCRTLQGHGHWVNTMALSTDYALRTGAFEPAEASVNPQDLQGSLQELKERALSRYNLVRGQGPERLVSGSDDFTLFLWSPAEDKKPLTRMTGHQALINQVLFSPDSRIVASASFDKSIKLWDGRTGKYLASLRGHVAAVYQIAWSADSRLLVSGSSDSTLKVWDVKAQKLAMDLPGHADEVYAVDWSPDGQRVASGGKDKCLRIWRR

SEQ ID NO: 57697 - protein, 87 aa, Homo sapiens
  Payload ID: 11322
  Gene Symbol: NLE1
  Gene Name: notchless homolog 1 (Drosophila)
  ENSP ID: ENSP00000465420
MAAAVPDEAVARDVQRLLVQFQDEGGQLLGSPFDVPVDITPDRLQLVCNALLAQVPGQWLWRHHRALLGSQHRDTTFHMQGTQTLGP

SEQ ID NO: 57698 - protein, 193 aa, Homo sapiens
  Payload ID: 11322
  Gene Symbol: NLE1
  Gene Name: notchless homolog 1 (Drosophila)
  Uniprot ID: Q9NVX2
  ENSP ID: ENSP00000466588
MALSTDYALRTGAFEPAEASVNPQDLQGSLQELKERALSRYNLVRGQGPERLVSGSDDFTLFLWSPAEDKKPLTRMTGHQALINQVLFSPDSRIVASASFDKSIKLWDGRTGKYLASLRGHVAAVYQIAWSADSRLLVSGSSDSTLKVWDVKAQKLAMDLPGHADEVYAVDWSPDGQRVASGGKDKCLRIWRR

SEQ ID NO: 57699 - protein, 304 aa, Homo sapiens
  Payload ID: 11322
  Gene Symbol: NLE1
  Gene Name: notchless homolog 1 (Drosophila)
  ENSP ID: ENSP00000466764
  MOD_RES (1)..(1): Any amino acid
XSSKDGSVRIWDTTAGRCERILTGHTQSVTCLRWGGDGLLYSASQDRTIKVWRAHDGVLCRTLQGHGHWVNTMALSTDYALRTGAFEPAEASVNPQDLQGSLQELKERALSRYNLVRGQGPERLVSGSDDFTLFLWSPAEDKKPLTRMTGHQALINQVLFSPDSRIVASASFDKSIKLWDGRTGKDDFHSVTWCSSGSSAAARSWLITTSASWVQVILLPQPPRYLASLRGHVAAVYQIAWSADSRLLVSGSSDSTLKVWDVKAQKLAMDLPGHADEVYAVDWSPDGQRVASGGKDKCLRIWRR

SEQ ID NO: 57700 - protein, 127 aa, Homo sapiens
  Payload ID: 11322
  Gene Symbol: NLE1
  Gene Name: notchless homolog 1 (Drosophila)
  ENSP ID: ENSP00000468339
MAAAVPDEAVARDVQRLLVQFQDEGGQLLGSPFDVPVDITPDRLQLVCNALLAQEDPLPLAFFVHDAEIVSSLGKTLESQAVETEKVLDIIYQPQAIFRVRAVTRCTSSLEGHSEAVISVAFSPTGK

SEQ ID NO: 57701 - protein, 114 aa, Homo sapiens
  Payload ID: 11323
  Gene Symbol: NRARP
  Gene Name: NOTCH-regulated ankyrin repeat protein
  Uniprot ID: Q7Z6K4
  ENSP ID: ENSP00000349041
MSQAELSTCSAPQTQRIFQEAVRKGNTQELQSLLQNMTNCEFNVNSFGPEGQTALHQSVIDGNLELVKLLVKFGADIRLANRDGWSALHIAAFGGHQDIVLYLITKAKYAASGR

SEQ ID NO: 57702 - protein, 251 aa, Homo sapiens
  Payload ID: 11324
  Gene Symbol: NOTO
  Gene Name: notochord homeobox
  Uniprot ID: A8MTQ0
  ENSP ID: ENSP00000381486
MPSPRPRGSPPPAPSGSRVRPPRSGRSPAPRSPTGPNTPRAPGRFESPFSVEAILARPDPCAPAASQPSGSACVHPAFWTAASLCATGGLPWACPTSWLPAYLSVGFYPVPGPRVAPVCGLLGFGVTGLELAHCSGLWAFPDWAPTEDLQDTERQQKRVRTMFNLEQLEELEKVFAKQHNLVGKKRAQLAARLKLTENQVRVWFQNRRVKYQKQQKLRAAVTSAEAASLDEPSSSSIASIQSDDAESGVDG

SEQ ID NO: 57703 - protein, 496 aa, Homo sapiens
  Payload ID: 11325
  Gene Symbol: NOTUM
  Gene Name: notum pectinacetylesterase homolog (Drosophila)
  Uniprot ID: Q6P988
  ENSP ID: ENSP00000387310
MGRGVRVLLLLSLLHCAGGSEGRKTWRRRGQQPPPPPRTEAAPAAGQPVESFPLDFTAVEGNMDSFMAQVKSLAQSLYPCSAQQLNEDLRLHLLLNTSVTCNDGSPAGYYLKESRGSRRWLLFLEGGWYCFNRENCDSRYDTMRRLMSSRDWPRTRTGTGILSSQPEENPYWWNANMVFIPYCSSDVWSGASSKSEKNEYAFMGALIIQEVVRELLGRGLSGAKVLLLAGSSAGGTGVLLNVDRVAEQLEKLGYPAIQVRGLADSGWFLDNKQYRHTDCVDTITCAPTEAIRRGIRYWNGVVPERCRRQFQEGEEWNCFFGYKVYPTLRCPVFVVQWLFDEAQLTVDNVHLTGQPVQEGLRLYIQNLGRELRHTLKDVPASFAPACLSHEIIIRSHWTDVQVKGTSLPRALHCWDRSLHDSHKASKTPLKGCPVHLVDSCPWPHCNPSCPTVRDQFTGQEMNVAQFLMHMGFDMQTVAQPQGLEPSELLGMLSNGS

SEQ ID NO: 57704 - protein, 295 aa, Homo sapiens
  Payload ID: 11325
  Gene Symbol: NOTUM
  Gene Name: notum pectinacetylesterase homolog (Drosophila)
  ENSP ID: ENSP00000407905
MGRGVRVLLLLSLLHCAGGSEGRKTWRRRGQQPPPPPRTEAAPAAGQPVESFPLDFTAVEGNMDSFMAQVKSLAQSLYPCSAQQLNEDLRLHLLLNTSVTCNDGSPAGYYLKESRGSRRWLLFLEGGWYCFNRENCDSRYDTMRRLMSSRDWPRTRTGTGILSSQPEENPYWWNANMVFIPYCSSDVWSGASSKSEKNEYAFMGALIIQEVVRELLGRGLSGAKVLLLAGSSAGGTGVLLNVDRVAEQLEKLGYPAIQVRGLADSGWFLDNKQYRHTDCVDTITCAPTEAIRRGI

SEQ ID NO: 57705 - protein, 197 aa, Homo sapiens
  Payload ID: 11325
  Gene Symbol: NOTUM
  Gene Name: notum pectinacetylesterase homolog (Drosophila)
  ENSP ID: ENSP00000464734
MRRLMSSRDWPRTRTGTGILSSQPEENPYWWNANMVFIPYCSSDVWSGASSKSEKNEYAFMGALIIQEVVRELLGRGLSGAKVLLLAGSSAGGTGVLLNVDRVAEQLEKLGYPAIQVRGLADSGWFLDNKQYRHTDCVDTITCAPTEAIRRGIRYWNGVVPERCRRQFQEGEEWNCFFGYKVYPTLRCPVFVVQWLF

SEQ ID NO: 57706 - protein, 1359 aa, Homo sapiens
  Payload ID: 11326
  Gene Symbol: NPC1L1
  Gene Name: NPC1-like 1
  Uniprot ID: Q9UHC9
  ENSP ID: ENSP00000289547
MAEAGLRGWLLWALLLRLAQSEPYTTIHQPGYCAFYDECGKNPELSGSLMTLSNVSCLSNTPARKITGDHLILLQKICPRLYTGPNTQACCSAKQLVSLEASLSITKALLTRCPACSDNFVNLHCHNTCSPNQSLFINVTRVAQLGAGQLPAVVAYEAFYQHSFAEQSYDSCSRVRVPAAATLAVGTMCGVYGSALCNAQRWLNFQGDTGNGLAPLDITFHLLEPGQAVGSGIQPLNEGVARCNESQGDDVATCSCQDCAASCPAIARPQALDSTFYLGQMPGSLVLIIILCSVFAVVTILLVGFRVAPARDKSKMVDPKKGTSLSDKLSFSTHTLLGQFFQGWGTWVASWPLTILVLSVIPVVALAAGLVFTELTTDPVELWSAPNSQARSEKAFHDQHFGPFFRTNQVILTAPNRSSYRYDSLLLGPKNFSGILDLDLLLELLELQERLRHLQVWSPEAQRNISLQDICYAPLNPDNTSLYDCCINSLLQYFQNNRTLLLLTANQTLMGQTSQVDWKDHFLYCANAPLTFKDGTALALSCMADYGAPVFPFLAIGGYKGKDYSEAEALIMTFSLNNYPAGDPRLAQAKLWEEAFLEEMRAFQRRMAGMFQVTFMAERSLEDEINRTTAEDLPIFATSYIVIFLYISLALGSYSSWSRVMVDSKATLGLGGVAVVLGAVMAAMGFFSYLGIRSSLVILQVVPFLVLSVGADNIFIFVLEYQRLPRRPGEPREVHIGRALGRVAPSMLLCSLSEAICFFLGALTPMPAVRTFALTSGLAVILDFLLQMSAFVALLSLDSKRQEASRLDVCCCVKPQELPPPGQGEGLLLGFFQKAYAPFLLHWITRGVVLLLFLALFGVSLYSMCHISVGLDQELALPKDSYLLDYFLFLNRYFEVGAPVYFVTTLGYNFSSEAGMNAICSSAGCNNFSFTQKIQYATEFPEQSYLAIPASSWVDDFIDWLTPSSCCRLYISGPNKDKFCPSTVNSLNCLKNCMSITMGSVRPSVEQFHKYLPWFLNDRPNIKCPKGGLAAYSTSVNLTSDGQVLDTVAILSPRLEYSGTISAHCNLYLLDSTSRFMAYHKPLKNSQDYTEALRAARELAANITADLRKVPGTDPAFEVFPYTITNVFYEQYLTILPEGLFMLSLCLVPTFAVSCLLLGLDLRSGLLNLLSIVMILVDTVGFMALWGISYNAVSLINLVSAVGMSVEFVSHITRSFAISTKPTWLERAKEATISMGSAVFAGVAMTNLPGILVLGLAKAQLIQIFFFRLNLLITLLGLLHGLVFLPVILSYVGPDVNPALALEQKRAEEAVAAVMVASCPNHPSRVSTADNIYVNHSFEGSIKGAGAISNFLPNNGRQF

SEQ ID NO: 57707 - protein, 1332 aa, Homo sapiens
  Payload ID: 11326
  Gene Symbol: NPC1L1
  Gene Name: NPC1-like 1
  ENSP ID: ENSP00000370552
MAEAGLRGWLLWALLLRLAQSEPYTTIHQPGYCAFYDECGKNPELSGSLMTLSNVSCLSNTPARKITGDHLILLQKICPRLYTGPNTQACCSAKQLVSLEASLSITKALLTRCPACSDNFVNLHCHNTCSPNQSLFINVTRVAQLGAGQLPAVVAYEAFYQHSFAEQSYDSCSRVRVPAAATLAVGTMCGVYGSALCNAQRWLNFQGDTGNGLAPLDITFHLLEPGQAVGSGIQPLNEGVARCNESQGDDVATCSCQDCAASCPAIARPQALDSTFYLGQMPGSLVLIIILCSVFAVVTILLVGFRVAPARDKSKMVDPKKGTSLSDKLSFSTHTLLGQFFQGWGTWVASWPLTILVLSVIPVVALAAGLVFTELTTDPVELWSAPNSQARSEKAFHDQHFGPFFRTNQVILTAPNRSSYRYDSLLLGPKNFSGILDLDLLLELLELQERLRHLQVWSPEAQRNISLQDICYAPLNPDNTSLYDCCINSLLQYFQNNRTLLLLTANQTLMGQTSQVDWKDHFLYCANAPLTFKDGTALALSCMADYGAPVFPFLAIGGYKGKDYSEAEALIMTFSLNNYPAGDPRLAQAKLWEEAFLEEMRAFQRRMAGMFQVTFMAERSLEDEINRTTAEDLPIFATSYIVIFLYISLALGSYSSWSRVMVDSKATLGLGGVAVVLGAVMAAMGFFSYLGIRSSLVILQVVPFLVLSVGADNIFIFVLEYQRLPRRPGEPREVHIGRALGRVAPSMLLCSLSEAICFFLGALTPMPAVRTFALTSGLAVILDFLLQMSAFVALLSLDSKRQEASRLDVCCCVKPQELPPPGQGEGLLLGFFQKAYAPFLLHWITRGVVLLLFLALFGVSLYSMCHISVGLDQELALPKDSYLLDYFLFLNRYFEVGAPVYFVTTLGYNFSSEAGMNAICSSAGCNNFSFTQKIQYATEFPEQSYLAIPASSWVDDFIDWLTPSSCCRLYISGPNKDKFCPSTVNSLNCLKNCMSITMGSVRPSVEQFHKYLPWFLNDRPNIKCPKGGLAAYSTSVNLTSDGQVLASRFMAYHKPLKNSQDYTEALRAARELAANITADLRKVPGTDPAFEVFPYTITNVFYEQYLTILPEGLFMLSLCLVPTFAVSCLLLGLDLRSGLLNLLSIVMILVDTVGFMALWGISYNAVSLINLVSAVGMSVEFVSHITRSFAISTKPTWLERAKEATISMGSAVFAGVAMTNLPGILVLGLAKAQLIQIFFFRLNLLITLLGLLHGLVFLPVILSYVGPDVNPALALEQKRAEEAVAAVMVASCPNHPSRVSTADNIYVNHSFEGSIKGAGAISNFLPNNGRQF

SEQ ID NO: 57708 - protein, 724 aa, Homo sapiens
  Payload ID: 11326
  Gene Symbol: NPC1L1
  Gene Name: NPC1-like 1
  Uniprot ID: Q9UHC9
  ENSP ID: ENSP00000404670
MAEAGLRGWLLWALLLRLAQSEPYTTIHQPGYCAFYDECGKNPELSGSLMTLSNVSCLSNTPARKITGDHLILLQKICPRLYTGPNTQACCSAKQLVSLEASLSITKALLTRCPACSDNFVNLHCHNTCSPNQSLFINVTRVAQLGAGQLPAVVAYEAFYQHSFAEQSYDSCSRVRVPAAATLAVGTMCGVYGSALCNAQRWLNFQGDTGNGLAPLDITFHLLEPGQAVGSGIQPLNEGVARCNESQGDDVATCSCQDCAASCPAIARPQALDSTFYLGQMPGSLVLIIILCSVFAVVTILLVGFRVAPARDKSKMVDPKKGTSLSDKLSFSTHTLLGQFFQGWGTWVASWPLTILVLSVIPVVALAAGLVFTELTTDPVELWSAPNSQARSEKAFHDQHFGPFFRTNQVILTAPNRSSYRYDSLLLGPKNFSGILDLDLLLELLELQERLRHLQVWSPEAQRNISLQDICYAPLNPDNTSLYDCCINSLLQYFQNNRTLLLLTANQTLMGQTSQVDWKDHFLYCANAPLTFKDGTALALSCMADYGAPVFPFLAIGGYKGKDYSEAEALIMTFSLNNYPAGDPRLAQAKLWEEAFLEEMRAFQRRMAGMFQVTFMAERSLEDEINRTTAEDLPIFATSYIVIFLYISLALGSYSSWSRVMVDSKATLGLGGVAVVLGAVMAAMGFFSYLGIRSSLVILQVVPFLVLSVGADNIFIFVLEYQGP

SEQ ID NO: 57709 - protein, 1286 aa, Homo sapiens
  Payload ID: 11326
  Gene Symbol: NPC1L1
  Gene Name: NPC1-like 1
  ENSP ID: ENSP00000438033
MAEAGLRGWLLWALLLRLAQSEPYTTIHQPGYCAFYDECGKNPELSGSLMTLSNVSCLSNTPARKITGDHLILLQKICPRLYTGPNTQACCSAKQLVSLEASLSITKALLTRCPACSDNFVNLHCHNTCSPNQSLFINVTRVAQLGAGQLPAVVAYEAFYQHSFAEQSYDSCSRVRVPAAATLAVGTMCGVYGSALCNAQRWLNFQGDTGNGLAPLDITFHLLEPGQAVGSGIQPLNEGVARCNESQGDDVATCSCQDCAASCPAIARPQALDSTFYLGQMPGSLVLIIILCSVFAVVTILLVGFRVAPARDKSKMVDPKKGTSLSDKLSFSTHTLLGQFFQGWGTWVASWPLTILVLSVIPVVALAAGLVFTELTTDPVELWSAPNSQARSEKAFHDQHFGPFFRTNQVILTAPNRSSYRYDSLLLGPKNFSGILDLDLLLELLELQERLRHLQVWSPEAQRNISLQDICYAPLNPDNTSLYDCCINSLLQYFQNNRTLLLLTANQTLMGQTSQVDWKDHFLYCANAPLTFKDGTALALSCMADYGAPVFPFLAIGGYKGKDYSEAEALIMTFSLNNYPAGDPRLAQAKLWEEAFLEEMRAFQRRMAGMFQVTFMAERSLEDEINRTTAEDLPIFATSYIVIFLYISLALGSYSSWSRVMVDSKATLGLGGVAVVLGAVMAAMGFFSYLGIRSSLVILQVVPFLVLSVGADNIFIFVLEYQRLPRRPGEPREVHIGRALGRVAPSMLLCSLSEAICFFLGALTPMPAVRTFALTSGLAVILDFLLQMSAFVALLSLDSKRQEASRLDVCCCVKPQELPPPGQGEGLLLGFFQKAYAPFLLHWITRGVVVGAPVYFVTTLGYNFSSEAGMNAICSSAGCNNFSFTQKIQYATEFPEQSYLAIPASSWVDDFIDWLTPSSCCRLYISGPNKDKFCPSTVNSLNCLKNCMSITMGSVRPSVEQFHKYLPWFLNDRPNIKCPKGGLAAYSTSVNLTSDGQVLASRFMAYHKPLKNSQDYTEALRAARELAANITADLRKVPGTDPAFEVFPYTITNVFYEQYLTILPEGLFMLSLCLVPTFAVSCLLLGLDLRSGLLNLLSIVMILVDTVGFMALWGISYNAVSLINLVSAVGMSVEFVSHITRSFAISTKPTWLERAKEATISMGSAVFAGVAMTNLPGILVLGLAKAQLIQIFFFRLNLLITLLGLLHGLVFLPVILSYVGPDVNPALALEQKRAEEAVAAVMVASCPNHPSRVSTADNIYVNHSFEGSIKGAGAISNFLPNNGRQF

SEQ ID NO: 57710 - protein, 150 aa, Homo sapiens
  Payload ID: 11327
  Gene Symbol: NPHP3-ACAD11
  Gene Name: NPHP3-ACAD11 readthrough (NMD candidate)
  ENSP ID: ENSP00000372769
MGTASSLVSPAGGEVIEDTYGAGGGEACEIPVEVKPKARLLRNSFRRGAGAAAGAGPGSLPRGVGAGGLLGASFKSTGSSVPELEYAAAEYERLRKEYEIFRVSKNQELLSMGRREAKLDTENKRLRAELQGLAAVARSRLTATWNSWAQ

SEQ ID NO: 57711 - protein, 636 aa, Homo sapiens
  Payload ID: 11327
  Gene Symbol: NPHP3-ACAD11
  Gene Name: NPHP3-ACAD11 readthrough (NMD candidate)
  ENSP ID: ENSP00000419763
MGTASSLVSPAGGEVIEDTYGAGGGEACEIPVEVKPKARLLRNSFRRGAGAAAGAGPGSLPRGVGAGGLLGASFKSTGSSVPELEYAAAEYERLRKEYEIFRVSKNQELLSMGRREAKLDTENKRLRAELQALQKTYQKILREKESALEAKYQAMERAATFEHDRDKVKRQFKIFRETKENEIQDLLRAKRELESKLQRLQAQGIQVFDPGESDSDDNCTDVTAAGTQCEYWTGGALGSEPSIGSMIQLQQSFRGPEFAHSSIDVEGPFANVNRDDWDIAVASLLQVTPLFSHSLWSNTVRCYLIYTDETQPEMDLFLKDYSPKLKRMCETMGYFFHAVYFPIDVENQYLTVRKWEIEKSSLVILFIHLTLPSLLLEDCEEAFLKNPEGKPRLIFHRLEDGKVSSDSVQQLIDQVSNLNKTSKAKIIDHSGDPAEGVYKTYICVEKIIKQDILGFENTDLETKDLGSEDSIPEEDDFGDVLWDIHDEQEQMETFQQASNSAHELGFEKYYQRLNDLVAAPAPIPPLLVSGGPGSGKSLLLSKWIQLQQKNSPNTLILSHFVGRPMSTSSESSLIIKRLTLKLMQHSWSVSALTLDPAKLLEEFPRWLEKLSARHQGSIIIVIDSIDQVQVVAYTSS

SEQ ID NO: 57712 - protein, 232 aa, Homo sapiens
  Payload ID: 11327
  Gene Symbol: NPHP3-ACAD11
  Gene Name: NPHP3-ACAD11 readthrough (NMD candidate)
  ENSP ID: ENSP00000488520
  MOD_RES (1)..(1): Any amino acid
XSLEMRERVLGPDHPDCAQSLNNLAALCNEKKQYDKAEELYERALDIRRRALAPDHPSLAYTVKHLAILYKKMGKLDKAVPLYELAVEIRQKSFGPKHPSVATALVNLAVLYSQMKKHVEALPLYERALKIYEDSLGRMHPRVGETLKNLAVLSYEGGDFEKAAELYKRAMEIKEAETSLLGGKAPSRHSSSGDTFSLKTAHSPNVFLQQGQRAGKSNPTFYLQKGFQTYVL

SEQ ID NO: 57713 - protein, 608 aa, Homo sapiens
  Payload ID: 11328
  Gene Symbol: NPLOC4
  Gene Name: NPL4 homolog, ubiquitin recognition factor
  Uniprot ID: Q8TAT6
  ENSP ID: ENSP00000331487
MAESIIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLCRHGPLGKCVHCVPLEPFDEDYLNHLEPPVKHMSFHAYIRKLTGGADKGKFVALENISCKIKSGCEGHLPWPNGICTKCQPSAITLNRQKYRHVDNIMFENHTVADRFLDFWRKTGNQHFGYLYGRYTEHKDIPLGIRAEVAAIYEPPQIGTQNSLELLEDPKAEVVDEIAAKLGLRKVGWIFTDLVSEDTRKGTVRYSRNKDTYFLSSEECITAGDFQNKHPNMCRLSPDGHFGSKFVTAVATGGPDNQVHFEGYQVSNQCMALVRDECLLPCKDAPELGYAKESSSEQYVPDVFYKDVDKFGNEITQLARPLPVEYLIIDITTTFPKDPVYTFSISQNPFPIENRDVLGETQDFHSLATYLSQNTSSVFLDTISDFHLLLFLVTNEVMPLQDSISLLLEAVRTRNEELAQTWKRSEQWATIEQLCSTVGGQLPGLHEYGAVGGSTHTATAAMWACQHCTFMNQPGTGHCEMCSLPRT

SEQ ID NO: 57714 - protein, 617 aa, Homo sapiens
  Payload ID: 11328
  Gene Symbol: NPLOC4
  Gene Name: NPL4 homolog, ubiquitin recognition factor
  Uniprot ID: Q8TAT6
  ENSP ID: ENSP00000363879
MAESIIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLCRHGPLGKCVHCVPLEPFDEDYLNHLEPPVKHMSFHAYIRKLTGGADKGKFVALENISCKIKSGCEGHLPWPNGICTKCQPSAITLNRQKYRHVDNIMFENHTVADRFLDFWRKTGNQHFGYLYGRYTEHKDIPLGIRAEVAAIYEPPQIGTQNSLELLEDPKAEVVDEIAAKLGLRKVGWIFTDLVSEDTRKGTVRYSRNKDTYFLSSEECITAGDFQNKHPNMCRLSPDGHFGSKFVTAVATGGPDNQVHFEGYQVSNQCMALVRDECLLPCKDAPELGYAKESSSEQYVPDVFYKDVDKFGNEITQLARPLPVEYLIIDITTTFPKDPVYTFSISQNPFPIENRDVLGETQDFHSLATYLSQNTSSVFLDTISDFHLLLFLVTNEVMPLQDSISLLLEAVRTRNEELAQTWKRSEQWATIEQLCSEYPHPLPRHPVAGAGEQPTLHSSPLPVVPWIPHPAASWQVPSAMQRVETRPPCQARGRLR

SEQ ID NO: 57715 - protein, 172 aa, Homo sapiens
  Payload ID: 11328
  Gene Symbol: NPLOC4
  Gene Name: NPL4 homolog, ubiquitin recognition factor
  ENSP ID: ENSP00000458384
  MOD_RES (1)..(1): Any amino acid
XYTFSISQNPFPIENRDVLGETQTESHSITQAGVQWCDLGSLQPPPPGFKRFFCFSLLSSWDYRTSIAWPPICLRIPHLCSWIPSQISTSCCSWSPMKLCLCRTASACCWRPCGPEMRSSPRHGRGLSSGPPSSSCAAQLAGSSQVSMSTAPSGAPHTRPLQPCGPVSTARS

SEQ ID NO: 57716 - protein, 145 aa, Homo sapiens
  Payload ID: 11328
  Gene Symbol: NPLOC4
  Gene Name: NPL4 homolog, ubiquitin recognition factor
  ENSP ID: ENSP00000459457
  MOD_RES (1)..(1): Any amino acid
XQNPFPIENRDVLGETQDFHSLATYLSQNTSSVFLDTISDFHLLLFLVTNEVMPLQDSISLLLEAVRTRNEELAQTWKRSEQWATIEQLCTSRVAGITDVYHHTWRCHLYAQLAGSSQVSMSTAPSGAPHTRPLQPCGPVSTARS

SEQ ID NO: 57717 - protein, 110 aa, Homo sapiens
  Payload ID: 11328
  Gene Symbol: NPLOC4
  Gene Name: NPL4 homolog, ubiquitin recognition factor
  ENSP ID: ENSP00000459462
TFPKDPVYTFSISQNPFPIENRDVLGETQDFHSLATYLSQNTSSVFLDTISDFHLLLFLVTNEVMPLQDSISLLLEAVRTRNEELAQTWKRSEQWATIEQLCKTGFHSVA

SEQ ID NO: 57718 - protein, 182 aa, Homo sapiens
  Payload ID: 11328
  Gene Symbol: NPLOC4
  Gene Name: NPL4 homolog, ubiquitin recognition factor
  ENSP ID: ENSP00000460465
GNEITQLARPLPVEYLIIDITTTFPKDPVYTFSISQNPFPIENRDVLGETQDFHSLATYLSQNTSSVFLDTISDFHLLLFLVTNEVMPLQDSISLLLEAVRTRNEELAQTWKRSEQWATIEQLCSSRHSPSSAFLVAGITGAHHHPQAQLAGSSQVSMSTAPSGAPHTRPLQPCGPVSTARS

SEQ ID NO: 57719 - protein, 58 aa, Homo sapiens
  Payload ID: 11328
  Gene Symbol: NPLOC4
  Gene Name: NPL4 homolog, ubiquitin recognition factor
  ENSP ID: ENSP00000461478
  MOD_RES (1)..(1): Any amino acid
XAPNVVEDEIDQYLSKQDGKIYRSRDPQLCRHGPLGKCVHCVPLEGEVCCPGEHQLQD

SEQ ID NO: 57720 - protein, 135 aa, Homo sapiens
  Payload ID: 11328
  Gene Symbol: NPLOC4
  Gene Name: NPL4 homolog, ubiquitin recognition factor
  ENSP ID: ENSP00000461543
MAESIIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLHSMRTI

SEQ ID NO: 57721 - protein, 56 aa, Homo sapiens
  Payload ID: 11328
  Gene Symbol: NPLOC4
  Gene Name: NPL4 homolog, ubiquitin recognition factor
  ENSP ID: ENSP00000465247
MRSSPRHGRGLSSGPPSSSCAAQLAGSSQVSMSTAPSGAPHTRPLQPCGPVSTARS

SEQ ID NO: 57722 - protein, 56 aa, Homo sapiens; identical to SEQ ID NO: 57721
  Payload ID: 11328
  Gene Symbol: NPLOC4
  Gene Name: NPL4 homolog, ubiquitin recognition factor
  ENSP ID: ENSP00000467400

SEQ ID NO: 57723 - protein, 134 aa, Homo sapiens
  Payload ID: 11328
  Gene Symbol: NPLOC4
  Gene Name: NPL4 homolog, ubiquitin recognition factor
  ENSP ID: ENSP00000486640
MEAVIIRVQSPDGVKRITATKRETAATFLKKVAKEFGFQNNGFSVYINRNKTGEITASSNKSLNLLKIKHGDLLFLFPSSLAGPSSEMETSVPPGFKVFGAPNVVEDEIDQYLSKQDGKIYRSRDPQLHSMRTI

SEQ ID NO: 57724 - protein, 380 aa, Homo sapiens
  Payload ID: 11329
  Gene Symbol: NPRL2
  Gene Name: NPR2-like, GATOR1 complex subunit
  Uniprot ID: Q8WTW4
  ENSP ID: ENSP00000232501
MGSGCRIECIFFSEFHPTLGPKITYQVPEDFISRELFDTVQVYIITKPELQNKLITVTAMEKKLIGCPVCIEHKKYSRNALLFNLGFVCDAQAKTCALEPIVKKLAGYLTTLELESSFVSMEESKQKLVPIMTILLEELNASGRCTLPIDESNTIHLKVIEQRPDPPVAQEYDVPVFTKDKEDFFNSQWDLTTQQILPYIDGFRHIQKISAEADVELNLVRIAIQNLLYYGVVTLVSILQYSNVYCPTPKVQDLVDDKSLQEACLSYVTKQGHKRASLRDVFQLYCSLSPGTTVRDLIGRHPQQLQHVDERKLIQFGLMKNLIRRLQKYPVRVTREEQSHPARLYTGCHSYDEICCKTGMSYHELDERLENDPNIIICWK

SEQ ID NO: 57725 - protein, 87 aa, Homo sapiens
  Payload ID: 11329
  Gene Symbol: NPRL2
  Gene Name: NPR2-like, GATOR1 complex subunit
  ENSP ID: ENSP00000388019
MGSGCRIECIFFSEFHPTLGPKITYQVPEDFISRELFDTVQVYIITKPELQNKLITVYGKEADRLSCVHRTQEVQPQCSPLQPGLRV

SEQ ID NO: 57726 - protein, 87 aa, Homo sapiens; identical to SEQ ID NO: 57725
  Payload ID: 11329
  Gene Symbol: NPRL2
  Gene Name: NPR2-like, GATOR1 complex subunit
  ENSP ID: ENSP00000388358

SEQ ID NO: 57727 - protein, 87 aa, Homo sapiens; identical to SEQ ID NO: 57725
  Payload ID: 11329
  Gene Symbol: NPRL2
  Gene Name: NPR2-like, GATOR1 complex subunit
  ENSP ID: ENSP00000389429

SEQ ID NO: 57728 - protein, 87 aa, Homo sapiens; identical to SEQ ID NO: 57725
  Payload ID: 11329
  Gene Symbol: NPRL2
  Gene Name: NPR2-like, GATOR1 complex subunit
  ENSP ID: ENSP00000396172

SEQ ID NO: 57729 - protein, 57 aa, Homo sapiens
  Payload ID: 11329
  Gene Symbol: NPRL2
  Gene Name: NPR2-like, GATOR1 complex subunit
  ENSP ID: ENSP00000412779
MGSGCRIECIFFSEFHPTLGPKITYQVPEDFISRELFDTVQVYIITKPELQNKLITV

SEQ ID NO: 57730 - protein, 57 aa, Homo sapiens; identical to SEQ ID NO: 57729
  Payload ID: 11329
  Gene Symbol: NPRL2
  Gene Name: NPR2-like, GATOR1 complex subunit
  ENSP ID: ENSP00000415045

SEQ ID NO: 57731 - protein, 544 aa, Homo sapiens
  Payload ID: 11330
  Gene Symbol: NPRL3
  Gene Name: NPR3-like, GATOR1 complex subunit
  ENSP ID: ENSP00000382834
MRDNTSPISVILVSSGSRGNKLLFRYPFQRSQEHPASQTSKPRSRYAASNTGDHADEQDGDSRFSDVILATILATKSEMCGQKFELKIDNVRFVGHPTLLQHALGQANADPSVINCLHNLSRRIATVLQHEERRCQYLTREAKLILALQDEVSAMADGNEGPQSPFHHILPKCKLARDLKEAYDSLCTSGVVRLHINSWLEVSFCLPHKIHYAASSLIPPEAIERSLKAIRPYHALLLLSDEKSLLGELPIDCSPALVRVIKTTSAVKNLQQLAQDADLALLQVFQLAAHLVYWGKAIIIYPLCENNVYMLSPNASVCLYSPLAEQFSHQFPSHDLPSVLAKFSLPVSLSEFRNPLAPAVQETQLIQMVVWMLQRRLLIQLHTYVCLMASPSEEEPRPREDDVPFTARVGGRSLSTPNALSFGSPTSSDDMTLTSPSMDNSSAELLPSGDSPLNQRMTENLLASLSEHERAAILSVPAAQNPEDLRMFARLLHYFRGRHHLEEIMYNENTRRSQLLMLFDKFRSVLVVTTHEDPVIAVFQALLP

SEQ ID NO: 57732 - protein, 69 aa, Homo sapiens
  Payload ID: 11330
  Gene Symbol: NPRL3
  Gene Name: NPR3-like, GATOR1 complex subunit
  ENSP ID: ENSP00000395288
MRDNTSPISVILANADPSVINCLHNLSRRIATVLQHEERRCQYLTREAKLILALQDEVSAMADACARRA

SEQ ID NO: 57733 - protein, 182 aa, Homo sapiens
  Payload ID: 11330
  Gene Symbol: NPRL3
  Gene Name: NPR3-like, GATOR1 complex subunit
  ENSP ID: ENSP00000399894
MRDNTSPISVILVSSGSRGNKLLFRYPFQRSQEHPASQTSKPRSRYAASNTGDHADEQDGDSSEPCPPTDEQLVAGFSDVILATILATKSEMCGQKFELKIDNVRFVGHPTLLQHALGQISKTDPSPKREAPTMILFNVVFALRANADPSVINCLHNLSRRIATVLQHEERRCQYLTREAKL

SEQ ID NO: 57734 - protein, 86 aa, Homo sapiens
  Payload ID: 11330
  Gene Symbol: NPRL3
  Gene Name: NPR3-like, GATOR1 complex subunit
  ENSP ID: ENSP00000401529
MRDNTSPISVILVSSGSRGNKLLFRYPFQRSQEHPASQTSKPRSRYAASNTGDHADEQDGDSRQSFTLSPKAGVQWCDLGLLQPHL

SEQ ID NO: 57735 - protein, 58 aa, Homo sapiens
  Payload ID: 11330
  Gene Symbol: NPRL3
  Gene Name: NPR3-like, GATOR1 complex subunit
  ENSP ID: ENSP00000405942
MRDNTSPISVILVSRVADTLPATRATMLMSRTAIPGFQMLFWQQFWQPSLKCVAKNLN

SEQ ID NO: 57736 - protein, 62 aa, Homo sapiens
  Payload ID: 11330
  Gene Symbol: NPRL3
  Gene Name: NPR3-like, GATOR1 complex subunit
  ENSP ID: ENSP00000418475
MRDNTSPISVILVSSGSRGNKLLFRYPFQRSQEHPASQTSFQMLFWQQFWQPSLKCVAKNLN

SEQ ID NO: 57737 - protein, 201 aa, Homo sapiens
  Payload ID: 11330
  Gene Symbol: NPRL3
  Gene Name: NPR3-like, GATOR1 complex subunit
  ENSP ID: ENSP00000477764
MCGQKFELKIDNVRFVGHPTLLQHALGQISKTDPSPKREAPTMILFNVVFALRANADPSVINCLHNLSRRIATVLQHEERRCQYLTREAKLILALQDEVSAMADGNEGPQSPFHHILPKCKLARDLKEAYDSLCTSGVVRLHINSWLEVSFCLPHKIHYAASSLIPPEAIERSLKAIRPYHALLLLSDEKSLLGELPIDCS

SEQ ID NO: 57738 - protein, 69 aa, Homo sapiens
  Payload ID: 11330
  Gene Symbol: NPRL3
  Gene Name: NPR3-like, GATOR1 complex subunit
  ENSP ID: ENSP00000477801
MRDNTSPISVILVSSGSRGNKLLFRYPFQRSQEHPASQTSKPRSRYAASNTGDHADEQDGDSRPTQTRQ

SEQ ID NO: 57739 - protein, 77 aa, Homo sapiens
  Payload ID: 11330
  Gene Symbol: NPRL3
  Gene Name: NPR3-like, GATOR1 complex subunit
  ENSP ID: ENSP00000478045
MRDNTSPISVILVSSGSRGNKLLFRYPFQRSQEHPASQTSKPRSRYAASNTGDHADEQDGDSRSPKQILPRRGKHLL

SEQ ID NO: 57740 - protein, 569 aa, Homo sapiens
  Payload ID: 11330
  Gene Symbol: NPRL3
  Gene Name: NPR3-like, GATOR1 complex subunit
  Uniprot ID: Q12980
  ENSP ID: ENSP00000478273
MRDNTSPISVILVSSGSRGNKLLFRYPFQRSQEHPASQTSKPRSRYAASNTGDHADEQDGDSRFSDVILATILATKSEMCGQKFELKIDNVRFVGHPTLLQHALGQISKTDPSPKREAPTMILFNVVFALRANADPSVINCLHNLSRRIATVLQHEERRCQYLTREAKLILALQDEVSAMADGNEGPQSPFHHILPKCKLARDLKEAYDSLCTSGVVRLHINSWLEVSFCLPHKIHYAASSLIPPEAIERSLKAIRPYHALLLLSDEKSLLGELPIDCSPALVRVIKTTSAVKNLQQLAQDADLALLQVFQLAAHLVYWGKAIIIYPLCENNVYMLSPNASVCLYSPLAEQFSHQFPSHDLPSVLAKFSLPVSLSEFRNPLAPAVQETQLIQMVVWMLQRRLLIQLHTYVCLMASPSEEEPRPREDDVPFTARVGGRSLSTPNALSFGSPTSSDDMTLTSPSMDNSSAELLPSGDSPLNQRMTENLLASLSEHERAAILSVPAAQNPEDLRMFARLLHYFRGRHHLEEIMYNENTRRSQLLMLFDKFRSVLVVTTHEDPVIAVFQALLP

SEQ ID NO: 57741 - protein, 569 aa, Homo sapiens; identical to SEQ ID NO: 57740
  Payload ID: 11330
  Gene Symbol: NPRL3
  Gene Name: NPR3-like, GATOR1 complex subunit
  Uniprot ID: Q12980
  ENSP ID: ENSP00000483814

SEQ ID NO: 57742 - protein, 1164 aa, Homo sapiens
  Payload ID: 11331
  Gene Symbol: NRDE2
  Gene Name: NRDE-2, necessary for RNA interference, domain containing
  Uniprot ID: Q9H7Z3
  ENSP ID: ENSP00000346335
MALFPAFAGLSEAPDGGSSRKELDWLSNPSFCVGSITSLSQQTEAAPAHVSEGLPLTRSHLKSESSDESDTNKKLKQTSRKKKKEKKKKRKHQHHKKTKRKHGPSSSSRSETDTDSEKDKPSRGVGGSKKESEEPNQGNNAAADTGHRFVWLEDIQAVTGETFRTDKKPDPANWEYKSLYRGDIARYKRKGDSCLGINPKKQCISWEGTSTEKKHSRKQVERYFTKKSVGLMNIDGVAISSKTEPPSSEPISFIPVKDLEDAAPVTTWLNPLGIYDQSTTHWLQGQGPPEQESKQPDAQPDSESAALKAKVEEFNRRVRENPRDTQLWMAFVAFQDEVMKSPGLYAIEEGEQEKRKRSLKLILEKKLAILERAIESNQSSVDLKLAKLKLCTEFWEPSTLVKEWQKLIFLHPNNTALWQKYLLFCQSQFSTFSISKIHSLYGKCLSTLSAVKDGSILSHPALPGTEEAMFALFLQQCHFLRQAGHSEKAISLFQAMVDFTFFKPDSVKDLPTKGQVEFFEPFWDSGEPRAGEKGARGWKAWMHQQERGGWVVINPDEDDDEPEEDDQEIKDKTLPRWQIWLAAERSRDQRHWRPWRPDKTKKQTEEDCEDPERQVLFDDIGQSLIRLSSHDLQFQLVEAFLQFLGVPSGFTPPASCLYLAMDENSIFDNGLYDEKPLTFFNPLFSGASCVGRMDRLGYPRWTRGQNREGEEFIRNVFHLVMPLFSGKEKSQLCFSWLQYEIAKVIWCLHTKNKKRLKSQGKNCKKLAKNLLKEPENCNNFCLWKQYAHLEWLLGNTEDARKVFDTALGMAGSRELKDSDLCELSLLYAELEVELSPEVRRAATARAVHILTKLTESSPYGPYTGQVLAVHILKARKAYEHALQDCLGDSCVSNPAPTDSCSRLISLAKCFMLFQYLTIGIDAAVQIYEQVFAKLNSSVFPEGSGEGDSASSQSWTSVLEAITLMHTSLLRFHMKVSVYPLAPLREALSQALKLYPGNQVLWRSYVQIQNKSHSASKTRRFFDTITRSAKPLEPWLFAIEAEKLRKRLVETVQRLDGREIHATIPETGLMHRIQALFENAMRSDSGSQCPLLWRMYLNFLVSLGNKERSKGVFYKALQNCPWAKVLYLDAVEYFPDEMQEILDLMTEKELRVRLPLEELELLLED

SEQ ID NO: 57743 - protein, 43 aa, Homo sapiens
  Payload ID: 11331
  Gene Symbol: NRDE2
  Gene Name: NRDE-2, necessary for RNA interference, domain containing
  ENSP ID: ENSP00000451025
MALFPAFAGLSEAPDGGSSRKVKEIMLQLILDIALFGLRTFRL

SEQ ID NO: 57744 - protein, 204 aa, Homo sapiens
  Payload ID: 11331
  Gene Symbol: NRDE2
  Gene Name: NRDE-2, necessary for RNA interference, domain containing
  ENSP ID: ENSP00000452071
FSISKIHSLYGKCLSTLSAVKDGSILSHPALPGTEEAMFADSEHRMKVAALFLQQCHFLRQAGHSEKAISLFQAMVDFTFFKPDSVKDLPTKGQVEFFEPFWDSGEPRAGEKGARGWKAWMHQQERGGWVVINPDEDDDEPEEDDQEIKDKTLPRWQIWLAAERSRDQRHWRPWRPDKTKKQTEEDCEDPERQVLFDDIGQSLI

SEQ ID NO: 57745 - protein, 227 aa, Homo sapiens
  Payload ID: 11331
  Gene Symbol: NRDE2
  Gene Name: NRDE-2, necessary for RNA interference, domain containing
  ENSP ID: ENSP00000452107
  MOD_RES (1)..(1): Any amino acid
XGHRFVWLEDIQAVTGETFRTDKKPDPANWEYKSLYRGDIARYKRKGDSCLGINPKKQCISWEGTSTEKKHSRKQVERYFTKKSVGLMNIDGVAISSKTEPPSSEPISFIPVKDLEDAAPVTTWLNPLGIYDQSTTHWLQGQGPPEQESKQPDAQPDSESAALKAKVEEFNRRVRENPRDTQLWMAFVAFQHSFFSSATFCGRLATLRRPSHCSRPWWTSPSSNPTA

SEQ ID NO: 57746 - protein, 43 aa, Homo sapiens; identical to SEQ ID NO: 57743
  Payload ID: 11331
  Gene Symbol: NRDE2
  Gene Name: NRDE-2, necessary for RNA interference, domain containing
  ENSP ID: ENSP00000486385

SEQ ID NO: 57747 - protein, 189 aa, Homo sapiens
  Payload ID: 11332
  Gene Symbol: NSA2
  Gene Name: NSA2 ribosome biogenesis homolog
  ENSP ID: ENSP00000296802
MPQNEYIELHRKRYGYRLDYHEKKRKKESREAHERSKKAKKMIGLKAKLYHKQRHAEKIQMKKTIKMHEKRNTKQKNDEKTPQGAVPAYLLDREGQSRAKVLSNMIKQKRKEKAGKWEVPLPKVRAQGETEVLKVIRTGKRKKKAWKRMVTKVCFVGDGFTRKPPKYERFIRPMENMPRLPTILKMMDV

SEQ ID NO: 57748 - protein, 98 aa, Homo sapiens
  Payload ID: 11332
  Gene Symbol: NSA2
  Gene Name: NSA2 ribosome biogenesis homolog
  ENSP ID: ENSP00000427266
  MOD_RES (1)..(1): Any amino acid
XREGQSRAKVLSNMIKQKRKEKAGKWEVPLPKVRAQGETEVLKVIRTGKRKKKAWKRMVTKVCFVGDGFTRKPPKYERFIRPMENMPRLPTILKMMDV

SEQ ID NO: 57749 - protein, 260 aa, Homo sapiens
  Payload ID: 11332
  Gene Symbol: NSA2
  Gene Name: NSA2 ribosome biogenesis homolog
  Uniprot ID: O95478
  ENSP ID: ENSP00000483484
MPQNEYIELHRKRYGYRLDYHEKKRKKESREAHERSKKAKKMIGLKAKLYHKQRHAEKIQMKKTIKMHEKRNTKQKNDEKTPQGAVPAYLLDREGQSRAKVLSNMIKQKRKEKAGKWEVPLPKVRAQGETEVLKVIRTGKRKKKAWKRMVTKVCFVGDGFTRKPPKYERFIRPMGLRFKKAHVTHPELKATFCLPILGVKKNPSSPLYTTLGVITKGTVIEVNVSELGLVTQGGKVIWGKYAQVTNNPENDGCINAVLLV

SEQ ID NO: 57750 - protein, 266 aa, Homo sapiens
  Payload ID: 11333
  Gene Symbol: NSMCE1
  Gene Name: NSE1 homolog, SMC5-SMC6 complex component
  Uniprot ID: Q8WV22
  ENSP ID: ENSP00000355077
MQGSTRRMGVMTDVHRRFLQLLMTHGVLEEWDVKRLQTHCYKVHDRNATVDKLEDFINNINSVLESLYIEIKRGVTEDDGRPIYALVNLATTSISKMATDFAENELDLFRKALELIIDSETGFASSTNILNLVDQLKGKKMRKKEAEQVLQKFVQNKWLIEKEGEFTLHGRAILEMEQYIRETYPDAVKICNICHSLLIQGQSCETCGIRMHLPCVAKYFQSNAEPRCPHCNDYWPHEIPKVFDPEKERESGVLKSNKKSLRSRQH

SEQ ID NO: 57751 - protein, 73 aa, Homo sapiens
  Payload ID: 11333
  Gene Symbol: NSMCE1
  Gene Name: NSE1 homolog, SMC5-SMC6 complex component
  ENSP ID: ENSP00000454726
MQGSTRRMGVMTDVHRRFLQLLMTHGVLEEWDVKRLQTHCYKVHDRNATVDKLEDFINNINSVLESLYIEIKR

SEQ ID NO: 57752 - protein, 70 aa, Homo sapiens
  Payload ID: 11333
  Gene Symbol: NSMCE1
  Gene Name: NSE1 homolog, SMC5-SMC6 complex component
  ENSP ID: ENSP00000455237
MQGSTRRMGVMTDVHRRFLQLLMTHGVLEEWDVKRLQTHCYKVHDRMSFISLTSEKEKQRSFLARLCIGC

SEQ ID NO: 57753 - protein, 70 aa, Homo sapiens; identical to SEQ ID NO: 57752
  Payload ID: 11333
  Gene Symbol: NSMCE1
  Gene Name: NSE1 homolog, SMC5-SMC6 complex component
  ENSP ID: ENSP00000456053

SEQ ID NO: 57754 - protein, 144 aa, Homo sapiens
  Payload ID: 11333
  Gene Symbol: NSMCE1
  Gene Name: NSE1 homolog, SMC5-SMC6 complex component
  ENSP ID: ENSP00000456103
MQGSTRRMGVMTDVHRRFLQLLMTHGVLEEWDVKRLQTHCYKVHDRNATVDKLEDFINNINSVLESLYIEIKRGVTEDDGRPIYALVNLATTSISKMATDFAENELDLFRKALELIIDSETGFASSTNILNLVDQLKGKKMRKK

SEQ ID NO: 57755 - protein, 138 aa, Homo sapiens
  Payload ID: 11333
  Gene Symbol: NSMCE1
  Gene Name: NSE1 homolog, SMC5-SMC6 complex component
  ENSP ID: ENSP00000456754
MQGSTRRMGVMTDVHRRFLQLLMTHGVLEEWDVKRLQTHCYKVHDRNATVDKLEDFINNINSVLESLYIEIKRGVTEDDGRPIYALVNLATTSISKMATDFAENELDLFRKALELIIDSETGFASSTNILNLVDQLKG

SEQ ID NO: 57756 - protein, 78 aa, Homo sapiens
  Payload ID: 11333
  Gene Symbol: NSMCE1
  Gene Name: NSE1 homolog, SMC5-SMC6 complex component
  ENSP ID: ENSP00000457893
LKGKKMRKKEAEQVLQKFVQNKWLIEKEGEFTLHGRAILEMEQYIRETYPDAVKICNICHSLLIQKSSTLRRRGSLVS

SEQ ID NO: 57757 - protein, 193 aa, Homo sapiens
  Payload ID: 11333
  Gene Symbol: NSMCE1
  Gene Name: NSE1 homolog, SMC5-SMC6 complex component
  ENSP ID: ENSP00000458859
MQGSTRRMGVMTDVHRRFLQLLMTHGVLEEWDVKRLQTHCYKVHDRNATVDKLEDFINNINSVLESLYIEIKRGVTEDDGRPIYALVNLATTSISKMATDFAENELDLFRKALELIIDSETGFASSTNILNLVDQLKGKKMRKKEAEQVLQKFVQNKWLIEEGEFTLHGRAILEMEQYIRETYPDAVKICNIC

SEQ ID NO: 57758 - protein, 247 aa, Homo sapiens
  Payload ID: 11334
  Gene Symbol: NSMCE2
  Gene Name: NSE2/MMS21 homolog, SMC5-SMC6 complex SUMO ligase
  Uniprot ID: Q96MF7
  ENSP ID: ENSP00000287437
MPGRSSSNSGSTGFISFSGVESALSSLKNFQACINSGMDTASSVALDLVESQTEVSSEYSMDKAMVEFATLDRQLNHYVKAVQSTINHVKEERPEKIPDLKLLVEKKFLALQSKNSDADFQNNEKFVQFKQQLKELKKQCGLQADREADGTEGVDEDIIVTQSQTNFTCPITKEEMKKPVKNKVCGHTYEEDAIVRMIESRQKRKKKAYCPQIGCSHTDIRKSDLIQDEALRRAIENHNKKRHRHSE

SEQ ID NO: 57759 - protein, 187 aa, Homo sapiens
  Payload ID: 11334
  Gene Symbol: NSMCE2
  Gene Name: NSE2/MMS21 homolog, SMC5-SMC6 complex SUMO ligase
  ENSP ID: ENSP00000428846
MDKAMVEFATLDRQLNHYVKAVQSTINHVKEERPEKIPDLKLLVEKKFLALQSKNSDADFQNNEKFVQFKQQLKELKKQCGLQADREADGTEGVDEDIIVTQSQTNFTCPITKEEMKKPVKNKVCGHTYEEDAIVRMIESRQKRKKKAYCPQIGCSHTDIRKSDLIQDEALRRAIENHNKKRHRHSE

SEQ ID NO: 57760 - protein, 94 aa, Homo sapiens
  Payload ID: 11334
  Gene Symbol: NSMCE2
  Gene Name: NSE2/MMS21 homolog, SMC5-SMC6 complex SUMO ligase
  ENSP ID: ENSP00000429014
GSTGFISFSGVESALSSLKNFQACINSGMDTASSVALDLVESQTEVSSEYSMDKAMVEFATLDRQLNHYVKAVQSTINHLGVVAHACSSSYLGG

SEQ ID NO: 57761 - protein, 139 aa, Homo sapiens
  Payload ID: 11334
  Gene Symbol: NSMCE2
  Gene Name: NSE2/MMS21 homolog, SMC5-SMC6 complex SUMO ligase
  ENSP ID: ENSP00000429383
MPGRSSSNSGSTGFISFSGVESALSSLKNFQACINSGMDTASSVALDLVESQTEVSSEYSMDKAMVEFATLDRQLNHYVKAVQSTINHVKEERPEKIPDLKLLVEKKFLALQSKNSDADFQNNEKFVQFKQQLKELKKQ

SEQ ID NO: 57762 - protein, 193 aa, Homo sapiens
  Payload ID: 11334
  Gene Symbol: NSMCE2
  Gene Name: NSE2/MMS21 homolog, SMC5-SMC6 complex SUMO ligase
  ENSP ID: ENSP00000429612
MPGRSSSNSGSTGFISFSGVESALSSLKNFQACINSGMDTASSVALDLVESQTEVSSEYSMDKAMVEFATLDRQLNHYVKAVQSTINHVKEERPEKIPDLKLLVEKKFLALQSKNSDADFQNNEKFVQFKQQLKELKKQCGLQADREADGTEGVDEDIIVTQSQTNFTCPITKEEMKKPVKNKVCGHTYEEDA

SEQ ID NO: 57763 - protein, 80 aa, Homo sapiens
  Payload ID: 11334
  Gene Symbol: NSMCE2
  Gene Name: NSE2/MMS21 homolog, SMC5-SMC6 complex SUMO ligase
  ENSP ID: ENSP00000430313
MPGRSSSNSGSTGFISFSGVESALSSLKNFQACINSGMDTASSVALDLVESQSFWEEEHRGQGPFSSRHIKASASHQHDQ

SEQ ID NO: 57764 - protein, 247 aa, Homo sapiens; identical to SEQ ID NO: 57758
  Payload ID: 11334
  Gene Symbol: NSMCE2
  Gene Name: NSE2/MMS21 homolog, SMC5-SMC6 complex SUMO ligase
  Uniprot ID: Q96MF7
  ENSP ID: ENSP00000430668

SEQ ID NO: 57765 - protein, 44 aa, Homo sapiens
  Payload ID: 11334
  Gene Symbol: NSMCE2
  Gene Name: NSE2/MMS21 homolog, SMC5-SMC6 complex SUMO ligase
  ENSP ID: ENSP00000431002
MPGRSSSNSGSTGFISFSGVESALSSLKNFQACINSGMDTASSV

SEQ ID NO: 57766 - protein, 157 aa, Homo sapiens
  Payload ID: 11334
  Gene Symbol: NSMCE2
  Gene Name: NSE2/MMS21 homolog, SMC5-SMC6 complex SUMO ligase
  ENSP ID: ENSP00000478256
MPGRSSSNSGSTGFISFSGVESALSSLKNFQACINSGMDTASSVALDLVESQTEVSSEYSMDKAMVEFATLDRQLNHYVKAVQSTINHVKEERPEKIPDLKLLVEKKFLALQSKNSDADFQNNEKFVQFKQQLKELKKQCKSTCFALVRLFEIRELT

SEQ ID NO: 57767 - protein, 157 aa, Homo sapiens; identical to SEQ ID NO: 57766
  Payload ID: 11334
  Gene Symbol: NSMCE2
  Gene Name: NSE2/MMS21 homolog, SMC5-SMC6 complex SUMO ligase
  ENSP ID: ENSP00000481615

SEQ ID NO: 57768 - protein, 316 aa, Homo sapiens
  Payload ID: 11335
  Gene Symbol: NSMCE4A
  Gene Name: NSE4 homolog A, SMC5-SMC6 complex component
  Uniprot ID: Q9NXX6
  ENSP ID: ENSP00000358013
MSGDSSGRGPEGRGRGRDPHRDRTRSRSRSRSPLSPRSRRGSARERREAPERPSLEDTEPSDSGDEMMDPASLEAEADQGLCRQIRHQYRALINSVQQNREDILNAGDKLTEVLEEANTLFNEVSRAREAVLDAHFLVLASDLGKEKAKQLRSDLSSFDMLRYVETLLTHMGVNPLEAEELIRDEDSPDFEFIVYDSWKITGRTAENTFNKTHTFHFLLGSIYGECPVPKPRVDRPRKVPVIQEERAMPAQLRRMEESHQEATEKEVERILGLLQTYFREDRDSLTLSPRLECSGTISTHCNLHLLDSSNSPASAS

SEQ ID NO: 57769 - protein, 385 aa, Homo sapiens
  Payload ID: 11335
  Gene Symbol: NSMCE4A
  Gene Name: NSE4 homolog A, SMC5-SMC6 complex component
  Uniprot ID: Q9NXX6
  ENSP ID: ENSP00000358019
MSGDSSGRGPEGRGRGRDPHRDRTRSRSRSRSPLSPRSRRGSARERREAPERPSLEDTEPSDSGDEMMDPASLEAEADQGLCRQIRHQYRALINSVQQNREDILNAGDKLTEVLEEANTLFNEVSRAREAVLDAHFLVLASDLGKEKAKQLRSDLSSFDMLRYVETLLTHMGVNPLEAEELIRDEDSPDFEFIVYDSWKITGRTAENTFNKTHTFHFLLGSIYGECPVPKPRVDRPRKVPVIQEERAMPAQLRRMEESHQEATEKEVERILGLLQTYFREDPDTPMSFFDFVVDPHSFPRTVENIFHVSFIIRDGFARIRLDQDRLPVIEPVSINEENEGFEHNTQVRNQGIIALSYRDWEEIVKTFEISEPVITPSQRQQKPSA

SEQ ID NO: 57770 - protein, 370 aa, Homo sapiens
  Payload ID: 11336
  Gene Symbol: NSFL1C
  Gene Name: NSFL1 (p97) cofactor (p47)
  Uniprot ID: Q9UNZ2
  ENSP ID: ENSP00000216879
MAAERQEALREFVAVTGAEEDRARFFLESAGWDLQIALASFYEDGGDEDIVTISQATPSSVSRGTAPSDNRVTSFRDLIHDQDEDEEEEEGQRFYAGGSERSGQQIVGPPRKKSPNELVDDLFKGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTGEGQKLGSTAPQVLSTSSPAQQAENEAKASSSILIDESEPTTNIQIRLADGGRLVQKFNHSHRISDIRLFIVDARPAMAATSFILMTTFPNKELADESQTLKEANLLNAVIVQRLT

SEQ ID NO: 57771 - protein, 339 aa, Homo sapiens
  Payload ID: 11336
  Gene Symbol: NSFL1C
  Gene Name: NSFL1 (p97) cofactor (p47)
  Uniprot ID: Q9UNZ2
  ENSP ID: ENSP00000338643
MAAERQEALREFVAVTGAEEDRARFFLESAGWDLQIALASFYEDGGDEDIVTISQATPSSVSRGTAPSDNRVTSFRDLIHDQDEDEEEEEGQRFYAGGSERSGQQIVGPPRKKSPNELVDDLFKGAKEHGAVAVERVTKSPGETSKPRVHVVLKLWKSGFSLDNGELRSYQDPSNAQFLESIRRGEVPAELRRLAHGGQVNLDMEDHRDEDFVKPKGAFKAFTGEGQKLGSTAPQVLSTSSPAQQAENEAKASSSILIDESEPTTNIQIRLADGGRLVQKFNHSHRISDIRLFIVDARPAMAATSFILMTTFPNKELADESQTLKEANLLNAVIVQRLT

SEQ ID NO: 57772 - protein, 372 aa, Homo sapiens
  Payload ID: 11336
  Gene Symbol: NSFL1C
  Gene Name: NSFL1 (p97) cofactor (p47)
  Uniprot ID: Q9UNZ2
  ENSP ID: ENSP00000418529
MAAERQEALREFVAVTGAEEDRARFFLESAGWDLQIALASFYEDGGDEDIVTISQATPSSVSRGTAPSDNRVTSFRDLIHDQDEDEEEEEGQRSRFYAGGSERSGQQIVGPPRKKSPNELVDDLFKGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTGEGQKLGSTAPQVLSTSSPAQQAENEAKASSSILIDESEPTTNIQIRLADGGRLVQKFNHSHRISDIRLFIVDARPAMAATSFILMTTFPNKELADESQTLKEANLLNAVIVQRLT

SEQ ID NO: 57773 - protein, 274 aa, Homo sapiens
  Payload ID: 11336
  Gene Symbol: NSFL1C
  Gene Name: NSFL1 (p97) cofactor (p47)
  ENSP ID: ENSP00000434067
MAAERQEALREFVAVTGAEEDRARFFLESAGWDLQIALASFYEDGGDEDIVTISQATPSSVSRGTAPSDNRVTSFRDLIHDQDEDEEEEEGQRFYAGGSERSGQQIVGPPRKKSPNELVDDLFKGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTGEGQKLGRLSCFPPFKPLFS

SEQ ID NO: 57774 - protein, 35 aa, Homo sapiens
  Payload ID: 11336
  Gene Symbol: NSFL1C
  Gene Name: NSFL1 (p97) cofactor (p47)
  ENSP ID: ENSP00000451675
MAAERQEALREFVAVTGAEEDRARFFLESAGWDLQ

SEQ ID NO: 57775 - protein, 35 aa, Homo sapiens; identical to SEQ ID NO: 57774
  Payload ID: 11336
  Gene Symbol: NSFL1C
  Gene Name: NSFL1 (p97) cofactor (p47)
  ENSP ID: ENSP00000452019

SEQ ID NO: 57776 - protein, 71 aa, Homo sapiens
  Payload ID: 11336
  Gene Symbol: NSFL1C
  Gene Name: NSFL1 (p97) cofactor (p47)
  ENSP ID: ENSP00000473400
MAAERQEALREFVAVTGAEEDRARFFLESAGWDLQIALASFYEDGGDEDIVTISQATPSSVSRGTAPREKR

SEQ ID NO: 57777 - protein, 105 aa, Homo sapiens
  Payload ID: 11336
  Gene Symbol: NSFL1C
  Gene Name: NSFL1 (p97) cofactor (p47)
  ENSP ID: ENSP00000473616
MAAERQEALREFVAVTGAEEDRARFFLESAGWDLQIALASFYEDGGDEDIVTISQATPSSVSRGTAPSDNRVTSFRDLIHDQDEDEEEEEGQRGHSVCHMNGKVR

SEQ ID NO: 57778 - protein, 172 aa, Homo sapiens
  Payload ID: 11337
  Gene Symbol: NSL1
  Gene Name: NSL1, MIS12 kinetochore complex component
  ENSP ID: ENSP00000355943
MAGSPELVVLDPPWDKELAAGTESQALVSATPREDFRVRCTSKRAVTEMLQLCGRFVQKLGDALPEEIREPALRDAQWTFESAVQENISINGQAWQEASDNCFMDSDIKVLEDQFDEIIVDIATKRKQYPRKILECVIKTIKAKQEILKQYHPVVHPLDLKYDPDPVLACIN

SEQ ID NO: 57779 - protein, 281 aa, Homo sapiens
  Payload ID: 11337
  Gene Symbol: NSL1
  Gene Name: NSL1, MIS12 kinetochore complex component
  Uniprot ID: Q96IY1
  ENSP ID: ENSP00000355944
MAGSPELVVLDPPWDKELAAGTESQALVSATPREDFRVRCTSKRAVTEMLQLCGRFVQKLGDALPEEIREPALRDAQWTFESAVQENISINGQAWQEASDNCFMDSDIKVLEDQFDEIIVDIATKRKQYPRKILECVIKTIKAKQEILKQYHPVVHPLDLKYDPDPAPHMENLKCRGETVAKEISEAMKSLPALIEQGEGFSQVLRMQPVIHLQRIHQEVFSSCHRKPDAKPENFITQIETTPTETASRKTSDMVLKRKQTKDCPQRKWYPLRPKKINLDT

SEQ ID NO: 57780 - protein, 75 aa, Homo sapiens
  Payload ID: 11337
  Gene Symbol: NSL1
  Gene Name: NSL1, MIS12 kinetochore complex component
  ENSP ID: ENSP00000355945
MDSDIKVLEDQFDEIIVDIATKRKQYPRKILECVIKTIKAKQEILKQYHPVVHPLDLKYDPDPGAKPGGLALGAV

SEQ ID NO: 57781 - protein, 213 aa, Homo sapiens
  Payload ID: 11337
  Gene Symbol: NSL1
  Gene Name: NSL1, MIS12 kinetochore complex component
  Uniprot ID: Q96IY1
  ENSP ID: ENSP00000486783
MAGSPELVVLDPPWDKELAAGTESQALVSATPREDFRVRCTSKRAVTEMLQLCGRFVQKLGDALPEEIREPALRDAQWTFESAVQENISINGQAWQEASDNCFMDSDIKVLEDQFDEIIVDIATKRKQYPRKILECVIKTIKAKQEILKQYHPVVHPLDLKYDPDPVLNGNAFNFSPFNMMLAVDLSYMVFITSSPSYGKFEMQRGNSSKGDQ

SEQ ID NO: 57782 - protein, 502 aa, Homo sapiens
  Payload ID: 11338
  Gene Symbol: SGSH
  Gene Name: N-sulfoglucosamine sulfohydrolase
  Uniprot ID: P51688
  ENSP ID: ENSP00000314606
MSCPVPACCALLLVLGLCRARPRNALLLLADDGGFESGAYNNSAIATPHLDALARRSLLFRNAFTSVSSCSPSRASLLTGLPQHQNGMYGLHQDVHHFNSFDKVRSLPLLLSQAGVRTGIIGKKHVGPETVYPFDFAYTEENGSVLQVGRNITRIKLLVRKFLQTQDDRPFFLYVAFHDPHRCGHSQPQYGTFCEKFGNGESGMGRIPDWTPQAYDPLDVLVPYFVPNTPAARADLAAQYTTVGRMDQGVGLVLQELRDAGVLNDTLVIFTSDNGIPFPSGRTNLYWPGTAEPLLVSSPEHPKRWGQVSEAYVSLLDLTPTILDWFSIPYPSYAIFGSKTIHLTGRSLLPALEAEPLWATVFGSQSHHEVTMSYPMRSVQHRHFRLVHNLNFKMPFPIDQDFYVSPTFQDLLNRTTAGQPTGWYKDLRHYYYRARWELYDRSRDPHETQNLATDPRFAQLLEMLRDQLAKWQWETHDPWVCAPDGVLEEKLSPQCQPLHNEL

SEQ ID NO: 57783 - protein, 274 aa, Homo sapiens
  Payload ID: 11338
  Gene Symbol: SGSH
  Gene Name: N-sulfoglucosamine sulfohydrolase
  ENSP ID: ENSP00000458200
MSCPVPACCALLLVLGLCRARPRNALLLLADRALSVSHLTQRMTEALRVARTTTAPSPPRTWTPWPAAASSFAMPSPRSAAALPAAPASSLACPSIRMGCTGCTRTCTTSTPSTRCGACRCCSAKLVCAQASSGRSTWGRRPCTRLTLRTRRRMAPSSRWGGTSLELSCSSGNSCRLRMTGLSSSTSPSTTPTAVGTPSPSTEPSVRSLATERAAWVVSQTGPPRPTTHWTCWCLTSSPTPRQPEPTWPLSTPPSAAWTKELDWCSRSCVTPVS

SEQ ID NO: 57784 - protein, 227 aa, Homo sapiens
  Payload ID: 11338
  Gene Symbol: SGSH
  Gene Name: N-sulfoglucosamine sulfohydrolase
  ENSP ID: ENSP00000459280
MSCPVPACCALLLVLGLCRARPRNALLLLADDGGFESGAYNNSAIATPHLDALARRSLLFRNAFTSVSSCSPSRASLLTGLPQASSGRSTWGRRPCTRLTLRTRRRMAPSSRWGGTSLELSCSSGNSCRLRMTGLSSSTSPSTTPTAVGTPSPSTEPSVRSLATERAAWVVSQTGPPRPTTHWTCWCLTSSPTPRQPEPTWPLSTPPSAAWTKELDWCSRSCVTPVS

SEQ ID NO: 57785 - protein, 106 aa, Homo sapiens
  Payload ID: 11338
  Gene Symbol: SGSH
  Gene Name: N-sulfoglucosamine sulfohydrolase
  ENSP ID: ENSP00000459708
  MOD_RES (1)..(1): Any amino acid
XARPRNALLLLADDGGFESGAYNNSAIATPHLDALARRSLLFRNAFTSVSSCSPSRASLLTGLPQHQNGMYGLHQDVHHFNSFDKVRSLPLLLSQAGVRTGGAEHH

SEQ ID NO: 57786 - protein, 187 aa, Homo sapiens
  Payload ID: 11338
  Gene Symbol: SGSH
  Gene Name: N-sulfoglucosamine sulfohydrolase
  ENSP ID: ENSP00000459765
MSCPVPACCALLLVLGLCRARPRNALLLLADDGGFESGAYNNSAIATPHLDALARRSLLFRNAFTSVSSCSPSRASLLTGLPQHQNGMYGLHQDVHHFNSFDKVRSLPLLLSQAGVRTGLSSRPGIIGKKHVGPETVYPFDFAYTEENGSVLQVGRNITRIKLLVRKFLQTQDDRPFFLYVAFHDPH

SEQ ID NO: 57787 - protein, 67 aa, Homo sapiens
  Payload ID: 11338
  Gene Symbol: SGSH
  Gene Name: N-sulfoglucosamine sulfohydrolase
  ENSP ID: ENSP00000460720
VIFTSDNGIPFPSGRTNLYWPGTAEPLLVSSPEHPKRWGQVSEAYVSLLEEKNEAQRGEVSCSGLHS

SEQ ID NO: 57788 - protein, 110 aa, Homo sapiens
  Payload ID: 11338
  Gene Symbol: SGSH
  Gene Name: N-sulfoglucosamine sulfohydrolase
  ENSP ID: ENSP00000461128
MYGLHQDVHHFNSFDKVRSLPLLLSQAGVRTGIIGKKHVGPETVYPFDFAYTEENGSVLQVGRNITRIKLLVRKFLQTQDDRPFFLYVAFHDPHRCGHSQPQYGTFCEKF

SEQ ID NO: 57789 - protein, 108 aa, Homo sapiens
  Payload ID: 11338
  Gene Symbol: SGSH
  Gene Name: N-sulfoglucosamine sulfohydrolase
  ENSP ID: ENSP00000461160
MSCPVPACCALLLVLGLCRARPRNALLLLADDGGFESGAYNNSAIATPHLDALARRSLLFRNAFTSVSSCSPSRASLLTGLPQAFLPLRRLPRPPPLWALPAPVRNLL

SEQ ID NO: 57790 - protein, 194 aa, Homo sapiens
  Payload ID: 11338
  Gene Symbol: SGSH
  Gene Name: N-sulfoglucosamine sulfohydrolase
  ENSP ID: ENSP00000461827
  MOD_RES (1)..(1): Any amino acid
XFDFAYTEENGSVLQVGRNITRIKLLVRKFLQTQDDRPFFLYVAFHDPHRCGHSQPQYGTFCEKFGNGESGMGRIPDWTPQAYDPLDVLVPYFVPNTPAARADLAAQYTTVGRMDQGVGLVLQELRDAGVLNDTLVIFTSDNGIPFPSGRTNLYWPGTAEPLLVSSPEHPKRWGQVSEAYVSLLVTRLLLPTVK

SEQ ID NO: 57791 - protein, 533 aa, Homo sapiens
  Payload ID: 11339
  Gene Symbol: NT5C1B-RDH14
  Gene Name: NT5C1B-RDH14 readthrough
  ENSP ID: ENSP00000412639
MSQTSLKQKKNEPGMRSSKESLEAEKRKESDKTGVRLSNQGSQESSLRKTDSRGYLVRSQWSRISRSPSTKAPSIDEPRSRNTSAKVELPSSSTSSRTPSTSPSLHDSSPPPLSGQPSLQPPASPQLPRSLDSRPPTPPEPDPGSRRSTKMQENPEAWAQGIVREIRQTRDSQPLEYSRTSPTEWKSSSQRRGIYPASTQLDRNSLSEQQQQQREDEDDYEAAYWASMRSFYEKNPSCSRPWPPKPKNAITIALSSCALFNMVDGRKIYEQEGLEKYMEYQLTNENVILTPGPAFRFVKALQYVNARLRDLYPDEQDLFDIVLMTNNHAQVGVRLINSVNHYGLLIDRFCLTGGKDPIGYLKAYLTNLYIAADSEKVQEAIQEGIASATMFDGAKDMAYCDTQLRVAFDGDAVLFSDESEHFTKEHGLDKFFQYDTLCESKPLAQEEPRLDVLINNAGIFQCPYMKTEDGFEMQFGVNHLGHFLLTNLLLGLLKSSAPSRIVVVSSKLYKYGDINFDDLNSEQSYNKSFCYSR

SEQ ID NO: 57792 - protein, 602 aa, Homo sapiens
  Payload ID: 11339
  Gene Symbol: NT5C1B-RDH14
  Gene Name: NT5C1B-RDH14 readthrough
  ENSP ID: ENSP00000433415
MSQTSLKQKKNEPGMRSSKESLEAEKRKESDKTGVRLSNQMRRAVNPNHSLRCCPFQGHSSCRRCLCAAEGTALGPCHTIRIYIHMCLLWEQGQQITMMRGSQESSLRKTDSRGYLVRSQWSRISRSPSTKAPSIDEPRSRNTSAKLPSSSTSSRTPSTSPSLHDSSPPPLSGQPSLQPPASPQLPRSLDSRPPTPPEPDPGSRRSTKMQENPEAWAQGIVREIRQTRDSQPLEYSRTSPTEWKSSSQRRGIYPASTQLDRNSLSEQQQQQREDEDDYEAAYWASMRSFYEKNPSCSRPWPPKPKNAITIALSSCALFNMVDGRKIYEQEGLEKYMEYQLTNENVILTPGPAFRFVKALQYVNARLRDLYPDEQDLFDIVLMTNNHAQVGVRLINSVNHYGLLIDRFCLTGGKDPIGYLKAYLTNLYIAADSEKVQEAIQEGIASATMFDGAKDMAYCDTQLRVAFDGDAVLFSDESEHFTKEHGLDKFFQYDTLCESKPLAQGPLKGFLEDLGRLQKKFYAKNERLLCPIRTYLVTARSAASSGARVLKTLRRWGLEIDEALFLAGAPKSPILVKIRPHIFFDDHMFHIEGAQRKSLGWMS

SEQ ID NO: 57793 - protein, 310 aa, Homo sapiens
  Payload ID: 11340
  Gene Symbol: NTAN1
  Gene Name: N-terminal asparagine amidase
  Uniprot ID: Q96AB6
  ENSP ID: ENSP00000287706
MPLLVEGRRVRLPQSAGDLVRAHPPLEERARLLRGQSVQQVGPQGLLYVQQRELAVTSPKDGSISILGSDDATTCHIVVLRHTGNGATCLTHCDGTDTKAEVPLIMNSIKSFSDHAQCGRLEVHLVGGFSDDRQLSQKLTHQLLSEFDRQEDDIHLVTLCVTELNDREENENHFPVIYGIAVNIKTAEIYRASFQDRGPEEQLRAARTLAGGPMISIYDAETEQLRIGPYSWTPFPHVDFWLHQDDKQILENLSTSPLAEPPHFVEHIRSTLMFLKKHPSPAHTLFSGNKALLYKKNEDGLWEKISSPGS

SEQ ID NO: 57794 - protein, 18 aa, Homo sapiens
  Payload ID: 11340
  Gene Symbol: NTAN1
  Gene Name: N-terminal asparagine amidase
  ENSP ID: ENSP00000454595
PLIMNSIKSFSDHAQCGR

SEQ ID NO: 57795 - protein, 223 aa, Homo sapiens
  Payload ID: 11340
  Gene Symbol: NTAN1
  Gene Name: N-terminal asparagine amidase
  ENSP ID: ENSP00000454883
MPLLVEGRRVRLPQSAGDLVRAHPPLEERARLLRGSISILGSDDATTCHIVVLRHTGNGATCLTHCDGTDTKAEVPLIMNSIKSFSDHAQCGRLEVHLVGGFSDDRQLSQKLTHQLLSEFDRQEDDIHLVTLCVTELNDREENENHFPVIYGIAVNIKTAEIYRASFQDRGPEEQLRAARTLAGGPMISIYDAETEQLRIGPYSWTPFPHVDFWLHQDDKQIL

SEQ ID NO: 57796 - protein, 146 aa, Homo sapiens
  Payload ID: 11340
  Gene Symbol: NTAN1
  Gene Name: N-terminal asparagine amidase
  ENSP ID: ENSP00000455396
MNSIKSFSDHAQCGRLEVHLVGGFSDDRQLSQKLTHQLLSEFDRQEDDIHLVTLCVTELNDREENENHFPVIYGIAVNIKTAEIYRASFQDRGPEEQLRAARTLAGGPMISIYDAETEQLRIGPYSWTPFPHVDFWLHQDDKQILE

SEQ ID NO: 57797 - protein, 27 aa, Homo sapiens
  Payload ID: 11340
  Gene Symbol: NTAN1
  Gene Name: N-terminal asparagine amidase
  ENSP ID: ENSP00000456142
LVRAHPPLEAPSPFWVLMMPLLVTLWS

SEQ ID NO: 57798 - protein, 45 aa, Homo sapiens
  Payload ID: 11340
  Gene Symbol: NTAN1
  Gene Name: N-terminal asparagine amidase
  ENSP ID: ENSP00000457467
MPLLVEGRRVRLPQSAGDLVRAHPPLEAPSPFWVLMMPLLVTLWS

SEQ ID NO: 57799 - protein, 45 aa, Homo sapiens; identical to SEQ ID NO: 57798
  Payload ID: 11340
  Gene Symbol: NTAN1
  Gene Name: N-terminal asparagine amidase
  ENSP ID: ENSP00000478644

SEQ ID NO: 57800 - protein, 205 aa, Homo sapiens
  Payload ID: 11340
  Gene Symbol: NTAN1
  Gene Name: N-terminal asparagine amidase
  ENSP ID: ENSP00000481975
MNSIKSFSDHAQCGRLEVHLVGGFSDDRQLSQKLTHQLLSEFDRQEDDIHLVTLCVTELNDREENENHFPVIYGIAVNIKTAEIYRASFQDRGPEEQLRAARTLAGGPMISIYDAETEQLRIGPYSWTPFPHVDFWLHQDDKQILENLSTSPLAEPPHFVEHIRSTLMFLKKHPSPAHTLFSGNKALLYKKNEDGLWEKISSPGS

SEQ ID NO: 57801 - protein, 205 aa, Homo sapiens; identical to SEQ ID NO: 57800
  Payload ID: 11340
  Gene Symbol: NTAN1
  Gene Name: N-terminal asparagine amidase
  ENSP ID: ENSP00000483643

SEQ ID NO: 57802 - protein, 310 aa, Homo sapiens; identical to SEQ ID NO: 57793
  Payload ID: 11340
  Gene Symbol: NTAN1
  Gene Name: N-terminal asparagine amidase
  Uniprot ID: Q96AB6
  ENSP ID: ENSP00000484380

SEQ ID NO: 57803 - protein, 205 aa, Homo sapiens; identical to SEQ ID NO: 57800
  Payload ID: 11340
  Gene Symbol: NTAN1
  Gene Name: N-terminal asparagine amidase
  ENSP ID: ENSP00000485340

SEQ ID NO: 57804 - protein, 146 aa, Homo sapiens; identical to SEQ ID NO: 57796
  Payload ID: 11340
  Gene Symbol: NTAN1
  Gene Name: N-terminal asparagine amidase
  ENSP ID: ENSP00000487653

SEQ ID NO: 57805 - protein, 223 aa, Homo sapiens; identical to SEQ ID NO: 57795
  Payload ID: 11340
  Gene Symbol: NTAN1
  Gene Name: N-terminal asparagine amidase
  ENSP ID: ENSP00000488243

SEQ ID NO: 57806 - protein, 27 aa, Homo sapiens
  Payload ID: 11340
  Gene Symbol: NTAN1
  Gene Name: N-terminal asparagine amidase
  ENSP ID: ENSP00000488459
LVRAHPPLEAPSPFWVLMMPLLVTLWS

SEQ ID NO: 57807 - protein, 18 aa, Homo sapiens
  Payload ID: 11340
  Gene Symbol: NTAN1
  Gene Name: N-terminal asparagine amidase
  ENSP ID: ENSP00000488710
PLIMNSIKSFSDHAQCGR

SEQ ID NO: 57808 - protein, 351 aa, Homo sapiens
  Payload ID: 11341
  Gene Symbol: NECAB1
  Gene Name: N-terminal EF-hand calcium binding protein 1
  Uniprot ID: Q8N987
  ENSP ID: ENSP00000387380
MEDSQETSPSSNNSSEELSSALHLSKGMSIFLDILRRADKNDDGKLSFEEFKAYFADGVLSGEELHELFHTIDTHNTNNLDTEELCEYFSQHLGEYENVLAALEDLNLSILKAMGKTKKDYQEASNLEQFVTRFLLKETLNQLQSLQNSLECAMETTEEQTRQERQGPAKPEVLSIQWPGKRSSRRVQRHNSFSPNSPQFNVSGPGLLEEDNQWMTQINRLQKLIDRLEKKDLKLEPPEEEIIEGNTKSHIMLVQRQMSVIEEDLEEFQLALKHYVESASSQSGCLRISIQKLSNESRYMIYEFWENSSVWNSHLQTNYSKTFQRSNVDFLETPELTSTMLVPASWWILNN

SEQ ID NO: 57809 - protein, 100 aa, Homo sapiens
  Payload ID: 11341
  Gene Symbol: NECAB1
  Gene Name: N-terminal EF-hand calcium binding protein 1
  Uniprot ID: Q8N987
  ENSP ID: ENSP00000428632
MLVQRQMSVIEEDLEEFQLALKHYVESASSQSGCLRISIQKLSNESRYMIYEFWENSSVWNSHLQTNYSKTFQRSNVDFLETPELTSTMLVPASWWILNN

SEQ ID NO: 57810 - protein, 100 aa, Homo sapiens; identical to SEQ ID NO: 57809
  Payload ID: 11341
  Gene Symbol: NECAB1
  Gene Name: N-terminal EF-hand calcium binding protein 1
  Uniprot ID: Q8N987
  ENSP ID: ENSP00000428953

SEQ ID NO: 57811 - protein, 386 aa, Homo sapiens
  Payload ID: 11342
  Gene Symbol: NECAB2
  Gene Name: N-terminal EF-hand calcium binding protein 2
  Uniprot ID: Q7Z6G3
  ENSP ID: ENSP00000307449
MCERAARLCRAGAHRLLREPPQQGRALGGLLRWVGARMGEPRESLAPAAPADPGPASPRGGTAVILDIFRRADKNDDGKLSLEEFQLFFADGVLNEKELEDLFHTIDSDNTNHVDTKELCDYFVDHMGDYEDVLASLETLNHSVLKAMGYTKKVYEGGSNVDQFVTRFLLKETANQIQSLLSSVESAVEAIEEQTSQLRQNHIKPSHSAAQTWCGSPTPASAPNHKLMAMEQGKTLPSATEDAKEEGLEAQISRLAELIGRLESKALWFDLQQRLSDEDGTNMHLQLVRQEMAVCPEQLSEFLDSLRQYLRGTTGVRNCFHITAVRLSDGFTFVIYEFWETEEAWKRHLQSPLCKAFRHVKVDTLSQPEALSRILVPAAWCTVGRD

SEQ ID NO: 57812 - protein, 183 aa, Homo sapiens
  Payload ID: 11342
  Gene Symbol: NECAB2
  Gene Name: N-terminal EF-hand calcium binding protein 2
  ENSP ID: ENSP00000455322
NTNHVDTKELCDYFVDHMGDYEDVLASLETLNHSVLKAMGYTKKVYEGGSNVDQFVTRFLLKETANQIQSLLSSVESAVEAIEEQTSQLRQNHIKPSHSAAQTWCGSPTPASAPNHKLMAMEQGKTLPSATEDAKEEGLEAQISRLAELIGRLESKHLQLVRQEMAVCPEQLSEFLDSLRQYL

SEQ ID NO: 57813 - protein, 62 aa, Homo sapiens
  Payload ID: 11342
  Gene Symbol: NECAB2
  Gene Name: N-terminal EF-hand calcium binding protein 2
  ENSP ID: ENSP00000455713
  MOD_RES (1)..(1): Any amino acid
XSEFLDSLRQYLRGTTGVRNCFQHLQSPLCKAFRHVKVDTLSQPEALSRILVPAAWCTVGRD

SEQ ID NO: 57814 - protein, 303 aa, Homo sapiens
  Payload ID: 11342
  Gene Symbol: NECAB2
  Gene Name: N-terminal EF-hand calcium binding protein 2
  ENSP ID: ENSP00000457354
MMMGSCPWRNSSSSLQMASLMRKNWRISFTRLTLTTPNYFVDHMGDYEDVLASLETLNHSVLKAMGYTKKVYEGGSNVDQFVTRFLLKETANQIQSLLSSVESAVEAIEEQTSQLRQNHIKPSHSAAQTWCGSPTPASAPNHKLMAMEQGKTLPSATEDAKEEGLEAQISRLAELIGRLESKALWFDLQQRLSDEDGTNMHLQLVRQEMAVCPEQLSEFLDSLRQYLRGTTGVRNCFHITAVRLSDGFTFVIYEFWETEEAWKRHLQSPLCKAFRHVKVDTLSQPEALSRILVPAAWCTVGRD

SEQ ID NO: 57815 - protein, 396 aa, Homo sapiens
  Payload ID: 11343
  Gene Symbol: NECAB3
  Gene Name: N-terminal EF-hand calcium binding protein 3
  Uniprot ID: Q96P71
  ENSP ID: ENSP00000246190
MACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKVRAVGPGPHKGGPSWYPPEPGPCWRPGPHSVPSQAPRLEPLREEDLAKGPDLHILMAQRQVQVAEEGLQDFHRALRCYVDFTGAQSHCLHVSAQKMLDGASFTLYEFWQDEASWRRHQQSPGSKAFQRILIDHLRAPDTLTTVFFPASWWIMNNN

SEQ ID NO: 57816 - protein, 362 aa, Homo sapiens
  Payload ID: 11343
  Gene Symbol: NECAB3
  Gene Name: N-terminal EF-hand calcium binding protein 3
  Uniprot ID: Q96P71
  ENSP ID: ENSP00000364386
MACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKAPRLEPLREEDLAKGPDLHILMAQRQVQVAEEGLQDFHRALRCYVDFTGAQSHCLHVSAQKMLDGASFTLYEFWQDEASWRRHQQSPGSKAFQRILIDHLRAPDTLTTVFFPASWWIMNNN

SEQ ID NO: 57817 - protein, 289 aa, Homo sapiens
  Payload ID: 11343
  Gene Symbol: NECAB3
  Gene Name: N-terminal EF-hand calcium binding protein 3
  ENSP ID: ENSP00000392064
MACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKHILMAQRQVQVAEEGLQDFHRALRCYVDFTGAQSHCLHVSAQKMLDGA

SEQ ID NO: 57818 - protein, 192 aa, Homo sapiens
  Payload ID: 11343
  Gene Symbol: NECAB3
  Gene Name: N-terminal EF-hand calcium binding protein 3
  ENSP ID: ENSP00000475369
MACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRLIPSWGPSPRPCEPHFL

SEQ ID NO: 57819 - protein, 297 aa, Homo sapiens
  Payload ID: 11343
  Gene Symbol: NECAB3
  Gene Name: N-terminal EF-hand calcium binding protein 3
  ENSP ID: ENSP00000475420
MACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKRQVQVAEEGLQDFHRALRCYVDFTGAQSHCLHVSAQKMLDGASFTLYEFWQDEASW

SEQ ID NO: 57820 - protein, 71 aa, Homo sapiens
  Payload ID: 11343
  Gene Symbol: NECAB3
  Gene Name: N-terminal EF-hand calcium binding protein 3
  ENSP ID: ENSP00000475755
MACAGLLTVCLLRPPAPQPQPQTPRHPQLAPDPGPAGHTLFQDVFRRADKNELLCRWGSQPGGAAGTVQRH

SEQ ID NO: 57821 - protein, 125 aa, Homo sapiens
  Payload ID: 11343
  Gene Symbol: NECAB3
  Gene Name: N-terminal EF-hand calcium binding protein 3
  ENSP ID: ENSP00000475834
MQWRLQVNRLQELIDQLECKAPRLEPLREEDLAKGPDLHILMAQRQVQVAEEGLQDFHRALRCYVDFTGAQSHCLHVSAQKMLDGASFTLYEFWQDEASWRRHQQSPGSKAFQRILIDHLRAPDT

SEQ ID NO: 57822 - protein, 54 aa, Homo sapiens
  Payload ID: 11343
  Gene Symbol: NECAB3
  Gene Name: N-terminal EF-hand calcium binding protein 3
  ENSP ID: ENSP00000475938
MACAGLLTVCLLRPPAPQPQPQTPRHPQLAPDPGPAGHTLFQDVFRRADKNALI

SEQ ID NO: 57823 - protein, 210 aa, Homo sapiens
  Payload ID: 11343
  Gene Symbol: NECAB3
  Gene Name: N-terminal EF-hand calcium binding protein 3
  ENSP ID: ENSP00000476044
MACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRCRERGGAEQALRQPAGRTPSPEECQPVIHLVPRLF

SEQ ID NO: 57824 - protein, 95 aa, Homo sapiens
  Payload ID: 11343
  Gene Symbol: NECAB3
  Gene Name: N-terminal EF-hand calcium binding protein 3
  ENSP ID: ENSP00000476165
  MOD_RES (1)..(1): Any amino acid
XQNYFADGVLSLGELQELFSGIDGHLTDNLETEKLCDYFSEHLGVYRPVLAALESLNRAVLAAMDATKLVSGVADGGGSTVRQWASAVLWDPPQS

SEQ ID NO: 57825 - protein, 223 aa, Homo sapiens
  Payload ID: 11344
  Gene Symbol: NTMT1
  Gene Name: N-terminal Xaa-Pro-Lys N-methyltransferase 1
  Uniprot ID: Q9BV86
  ENSP ID: ENSP00000361558
MTSEVIEDEKQFYSKAKTYWKQIPPTVDGMLGGYGHISSIDINSSRKFLQRFLREGPNKTGTSCALDCGAGIGRITKRLLLPLFREVDMVDITEDFLVQAKTYLGEEGKRVRNYFCCGLQDFTPEPDSYDVIWIQWVIGHLTDQHLAEFLRRCKGSLRPNGIIVIKDNMAQEGVILDDVDSSVCRDLDVVRRIICSAGLSLLAEERQENLPDEIYHVYSFALR

SEQ ID NO: 57826 - protein, 145 aa, Homo sapiens
  Payload ID: 11344
  Gene Symbol: NTMT1
  Gene Name: N-terminal Xaa-Pro-Lys N-methyltransferase 1
  Uniprot ID: Q9BV86
  ENSP ID: ENSP00000361559
MTSEVIEDEKQFYSKAKTYWKQIPPTVDGMLGGYGHISSIDINSSRKFLQRFLREGPNKTGTSCALDCGAGIGRITKRLLLPLFREVDMVDITEDFLVQAKTYLGEEGKRATSPISTWPSSCGAARAASAPTASSSSKTTWPRRA

SEQ ID NO: 57827 - protein, 223 aa, Homo sapiens; identical to SEQ ID NO: 57825
  Payload ID: 11344
  Gene Symbol: NTMT1
  Gene Name: N-terminal Xaa-Pro-Lys N-methyltransferase 1
  Uniprot ID: Q9BV86
  ENSP ID: ENSP00000361561

SEQ ID NO: 57828 - protein, 223 aa, Homo sapiens; identical to SEQ ID NO: 57825
  Payload ID: 11344
  Gene Symbol: NTMT1
  Gene Name: N-terminal Xaa-Pro-Lys N-methyltransferase 1
  Uniprot ID: Q9BV86
  ENSP ID: ENSP00000361564

SEQ ID NO: 57829 - protein, 135 aa, Homo sapiens
  Payload ID: 11344
  Gene Symbol: NTMT1
  Gene Name: N-terminal Xaa-Pro-Lys N-methyltransferase 1
  ENSP ID: ENSP00000473900
MVDITEDFLVQAKTYLGEEGKRVRNYFCCGLQDFTPEPDSYDVIWIQWVIGHLTDQHLAEFLRRCKGSLRPNGIIVIKDNMAQEGVILDDVDSSVCRDLDVVRRIICSAGLSLLAEERQENLPDEIYHVYSFALR

SEQ ID NO: 57830 - protein, 70 aa, Homo sapiens
  Payload ID: 11344
  Gene Symbol: NTMT1
  Gene Name: N-terminal Xaa-Pro-Lys N-methyltransferase 1
  ENSP ID: ENSP00000473916
MTSEVIEDEKQFYSKAKTYWKQIPPTVDGMLGGKARTRQERPVPWTVELALGGSPSGCSCRCSERWIWST

SEQ ID NO: 57831 - protein, 109 aa, Homo sapiens
  Payload ID: 11344
  Gene Symbol: NTMT1
  Gene Name: N-terminal Xaa-Pro-Lys N-methyltransferase 1
  ENSP ID: ENSP00000474445
MTSEVIEDEKQFYSKAKTYWKQIPPTVDGMLGGYGHISSIDINSSRKFLQRFLRVGRSGVLSRRGCGSGGTAESMWGATFYTCNTAGLLAISWYLPQSLEELGWVGTVG

SEQ ID NO: 57832 - protein, 223 aa, Homo sapiens; identical to SEQ ID NO: 57825
  Payload ID: 11344
  Gene Symbol: NTMT1
  Gene Name: N-terminal Xaa-Pro-Lys N-methyltransferase 1
  Uniprot ID: Q9BV86
  ENSP ID: ENSP00000478521

SEQ ID NO: 57833 - protein, 223 aa, Homo sapiens; identical to SEQ ID NO: 57825
  Payload ID: 11344
  Gene Symbol: NTMT1
  Gene Name: N-terminal Xaa-Pro-Lys N-methyltransferase 1
  Uniprot ID: Q9BV86
  ENSP ID: ENSP00000483489

SEQ ID NO: 57834 - protein, 135 aa, Homo sapiens; identical to SEQ ID NO: 57829
  Payload ID: 11344
  Gene Symbol: NTMT1
  Gene Name: N-terminal Xaa-Pro-Lys N-methyltransferase 1
  ENSP ID: ENSP00000484447

SEQ ID NO: 57835 - protein, 312 aa, Homo sapiens
  Payload ID: 11345
  Gene Symbol: NTHL1
  Gene Name: nth-like DNA glycosylase 1
  Uniprot ID: P78549
  ENSP ID: ENSP00000219066
MCSPQESGMTALSARMLTRSRSLGPGAGPRGCREEPGPLRRREAAAEARKSHSPVKRPRKAQRLRVAYEGSDSEKGEGAEPLKVPVWEPQDWQQQLVNIRAMRNKKDAPVDHLGTEHCYDSSAPPKVRRYQVLLSLMLSSQTKDQVTAGAMQRLRARGLTVDSILQTDDATLGKLIYPVGFWRSKVKYIKQTSAILQQHYGGDIPASVAELVALPGVGPKMAHLAMAVAWGTVSGIAVDTHVHRIANRLRWTKKATKSPEETRAALEEWLPRELWHEINGLLVGFGQQTCLPVHPRCHACLNQALCPAAQGL

SEQ ID NO: 57836 - protein, 236 aa, Homo sapiens
  Payload ID: 11345
  Gene Symbol: NTHL1
  Gene Name: nth-like DNA glycosylase 1
  ENSP ID: ENSP00000455267
  MOD_RES (1)..(1): Any amino acid
XSLGPGAGPRGCREEPGPLRRREAAAEARKSHSPVKRPRKAQRLRVAYEGSDSEKGEGAEPLKVPVWEPQDWQQQLVNIRAMRNKKDAPVDHLGTEHCYDSSAPPKSKVKYIKQTSAILQQHYGGDIPASVAELVALPGVGPKMAHLAMAVAWGTVSGIAAVDTHVHRIANRLRWTKKATKSPEETRAALEEWLPRELWHEINGLLVGFGQQTCLPVHPRCHACLNQALCPAAQGL

SEQ ID NO: 57837 - protein, 218 aa, Homo sapiens
  Payload ID: 11345
  Gene Symbol: NTHL1
  Gene Name: nth-like DNA glycosylase 1
  ENSP ID: ENSP00000456301
  MOD_RES (1)..(1): Any amino acid
XPGPLRRREAAAEARKSHSPVKRPRKAQRLRVAYEGSDSEKGEGAEPLKVPVWEPQDWQQQLVNIRAMRNKKDAPVDHLGTEHCYDSSAPPKVRRYQVLLSLMLSSQTKDQVTAGAMQRLRARGLTVDSILQTDDATLGKLIYPVGFWRSKVKYIKQTSAILQQHYGGDIPASVAELVALPGVGPKMAHLAMAVAWGTVSGIGVCGPDHLQGDPRAAS

SEQ ID NO: 57838 - protein, 100 aa, Homo sapiens
  Payload ID: 11345
  Gene Symbol: NTHL1
  Gene Name: nth-like DNA glycosylase 1
  ENSP ID: ENSP00000457818
  MOD_RES (1)..(1): Any amino acid
XRSRSLGPGAGPRGCREEPGPLRRREAAAEARKSHSPVKRPRKAQRLRVAYEGSDSEKGTQVPGAAVTDALQPNQRPGDGGRHAATAGAGPDGGQHPADR

SEQ ID NO: 57839 - protein, 832 aa, Homo sapiens
  Payload ID: 11346
  Gene Symbol: NKPD1
  Gene Name: NTPase, KAP family P-loop domain containing 1
  ENSP ID: ENSP00000321976
MHKHYKVHFAKDAQSPNGHYFWDPELGHRKGCCHQWRQDSAALRAHGPCRPSPQSHWQLAYHSHQVGGSGWRRGLLPSVLQQQRQPQSQPSPPSPLRQRLCPIHEAQKGLPATSTVPKEPASAPQAPTLPTTAPAMARSGPALPSAAGVLLKPSEPTDARPLPAPAACGSFTAYSSDILTEDDVYCSCLAKTLCHVPVPVTVGFYAPFGCRLHMMLDKITALMQQEAAQRESEELQHVQWRPRAVSGWGVPQLLWYLVFLQPIITEVHLRRRNVQFLFIRFSAWQYAGTDKLWAGLVTTLCEGIRRHYGALPFSVYSVLGNKPATRQDCCQSEWHCRRRVCLGLLALLAALGLGVGLLYLSLGGHALGHGSPSGSLLKVFGGAATTLSGSGLLMAVYSVGKHLFVSQRKKIERLVSREKFGSQLGFMCEVKKEVELLTDFLCFLEIYQRRRLRVVLEVTGLDTCYPERVVGVLNAINTLLSDSHAPFIFILVVDPSILAACLESAGNMKGTADNGYLFLNRTVTLPFSVPIMGRRTKLQFLHDAVQSRDDLLYREMTRKPWLPGDAGGESAQLLAVQAQAGTERGQGRIDDEAARRIQEALFCLHDERDCLYEYVPDNVVSMRRIVNTVPITVRLLQQQQQQGDFGGPTPRQAVAWVVLANQWPCRLSWALQCLEDRQQTGGAPEGRARLWDVFRDNSRELHTMTKALQNVLDLDGDPELFERFLGADFPFTVAEAQSLLRCTVNLDHSIRRRMGLIRAVSALKPPSPPKSPTRDTPHAAHRANSASRAPPSGRASGQAGEGHHTGDLAHRGKLWPVACALFRPGQSSPGGP

SEQ ID NO: 57840 - protein, 610 aa, Homo sapiens
  Payload ID: 11346
  Gene Symbol: NKPD1
  Gene Name: NTPase, KAP family P-loop domain containing 1
  Uniprot ID: Q17RQ9
  ENSP ID: ENSP00000401739
MQQEAAQRESEELQHVQWRPRAVSGWGVPQLLWYLVFLQPIITEVHLRRRNVQFLFIRFSAWQYAGTDKLWAGLVTTLCEGIRRHYGALPFSVYSVLGNKPATRQDCCQSEWHCRRRVCLGLLALLAALGLGVGLLYLSLGGHALGHGSPSGSLLKVFGGAATTLSGSGLLMAVYSVGKHLFVSQRKKIERLVSREKFGSQLGFMCEVKKEVELLTDFLCFLEIYQRRRLRVVLEVTGLDTCYPERVVGVLNAINTLLSDSHAPFIFILVVDPSILAACLESAGNMKGTADNGYLFLNRTVTLPFSVPIMGRRTKLQFLHDAVQSRDDLLYREMTRKPWLPGDAGGESAQLLAVQAQAGTERGQGRIDDEAARRIQEALFCLHDERDCLYEYVPDNVVSMRRIVNTVPITVRLLQQQQQQGDFGGPTPRQAVAWVVLANQWPCRLSWALQCLEDRQQTGGAPEGRARLWDVFRDNSRELHTMTKALQNVLDLDGDPELFERFLGADFPFTVAEAQSLLRCTVNLDHSIRRRMGLIRAVSALKPPSPPKSPTRDTPHAAHRANSASRAPPSGRASGQAGEGHHTGDLAHRGKLWPVACALFRPGQSSPGGP

SEQ ID NO: 57841 - protein, 610 aa, Homo sapiens; identical to SEQ ID NO: 57840
  Payload ID: 11346
  Gene Symbol: NKPD1
  Gene Name: NTPase, KAP family P-loop domain containing 1
  Uniprot ID: Q17RQ9
  ENSP ID: ENSP00000468649

SEQ ID NO: 57842 - protein, 661 aa, Homo sapiens
  Payload ID: 11347
  Gene Symbol: NUAK1
  Gene Name: NUAK family, SNF1-like kinase, 1
  Uniprot ID: O60285
  ENSP ID: ENSP00000261402
MEGAAAPVAGDRPDLGLGAPGSPREAVAGATAALEPRKPHGVKRHHHKHNLKHRYELQETLGKGTYGKVKRATERFSGRVVAIKSIRKDKIKDEQDMVHIRREIEIMSSLNHPHIISIYEVFENKDKIVIIMEYASKGELYDYISERRRLSERETRHFFRQIVSAVHYCHKNGVVHRDLKLENILLDDNCNIKIADFGLSNLYQKDKFLQTFCGSPLYASPEIVNGRPYRGPEVDSWALGVLLYTLVYGTMPFDGFDHKNLIRQISSGEYREPTQPSDARGLIRWMLMVNPDRRATIEDIANHWWVNWGYKSSVCDCDALHDSESPLLARIIDWHHRSTGLQADTEAKMKGLAKPTTSEVMLERQRSLKKSKKENDFAQSGQDAVPESPSKLSSKRPKGILKKRSNSEHRSHSTGFIEGVVGPALPSTFKMEQDLCRTGVLLPSSPEAEVPGKLSPKQSATMPKKGILKKTQQRESGYYSSPERSESSELLDSNDVMGSSIPSPSPPDPARVTSHSLSCRRKGILKHSSKYSAGTMDPALVSPEMPTLESLSEPGVPAEGLSRSYSRPSSVISDDSVLSSDSFDLLDLQENRPARQRIRSCVSAENFLQIQDFEGLQNRPRPQYLKRYRNRLADSSFSLLTDMDDVTQVYKQALEICSKLN

SEQ ID NO: 57843 - protein, 118 aa, Homo sapiens
  Payload ID: 11347
  Gene Symbol: NUAK1
  Gene Name: NUAK family, SNF1-like kinase, 1
  ENSP ID: ENSP00000446873
MLMVNPDRRATIEDIANHWWVNWGYKSSVCDCDALHDSESPLLARIIDWHHRSTGLQADTEAKMKGLAKPTTSEVMLERQRSLKKSKKENDFAQSGQDAVPESPSKLSSKRPKGILKK

SEQ ID NO: 57844 - protein, 152 aa, Homo sapiens
  Payload ID: 11347
  Gene Symbol: NUAK1
  Gene Name: NUAK family, SNF1-like kinase, 1
  ENSP ID: ENSP00000448288
MEYASKGELYDYISERRRLSERETRHFFRQIVSAVHYCHKNGVVHRDLKLENILLDDNCNIKIADFGLSNLYQKDKFLQTFCGSPLYASPEIVNGRPYRGPEVDSWALGVLLYTLVYGTMPFDGFDHKNLIRQISSGEYREPTQPSDARGLI

SEQ ID NO: 57845 - protein, 74 aa, Homo sapiens
  Payload ID: 11347
  Gene Symbol: NUAK1
  Gene Name: NUAK family, SNF1-like kinase, 1
  ENSP ID: ENSP00000449990
MPFDGFDHKNLIRQISSGEYREPTQPSDARGLIRWMLMVNPDRRATIEDIANHWWVNWGYKSSVCDCDALHDSE

SEQ ID NO: 57846 - protein, 672 aa, Homo sapiens
  Payload ID: 11348
  Gene Symbol: NUAK2
  Gene Name: NUAK family, SNF1-like kinase, 2
  Uniprot ID: Q9H093
  ENSP ID: ENSP00000356125
MLCFTARSGTAVAPRPGAGPVPRASALPAQPTDSPAALAHLLLAMESLVFARRSGPTPSAAELARPLAEGLIKSPKPLMKKQAVKRHHHKHNLRHRYEFLETLGKGTYGKVKKARESSGRLVAIKSIRKDKIKDEQDLMHIRREIEIMSSLNHPHIIAIHEVFENSSKIVIVMEYASRGDLYDYISERQQLSEREARHFFRQIVSAVHYCHQNRVVHRDLKLENILLDANGNIKIADFGLSNLYHQGKFLQTFCGSPLYASPEIVNGKPYTGPEVDSWSLGVLLYILVHGTMPFDGHDHKILVKQISNGAYREPPKPSDACGLIRWLLMVNPTRRATLEDVASHWWVNWGYATRVGEQEAPHEGGHPGSDSARASMADWLRRSSRPLLENGAKVCSFFKQHAPGGGSTTPGLERQHSLKKSRKENDMAQSLHSDTADDTAHRPGKSNLKLPKGILKKKVSASAEGVQEDPPELSPIPASPGQAAPLLPKKGILKKPRQRESGYYSSPEPSESGELLDAGDVFVSGDPKEQKPPQASGLLLHRKGILKLNGKFSQTALELAAPTTFGSLDELAPPRPLARASRPSGAVSEDSILSSESFDQLDLPERLPEPPLRGCVSVDNLTGLEEPPSEGPGSCLRRWRQDPLGDSCFSLTDCQEVTATYRQALRVCSKLT

SEQ ID NO: 57847 - protein, 327 aa, Homo sapiens
  Payload ID: 11349
  Gene Symbol: NAIF1
  Gene Name: nuclear apoptosis inducing factor 1
  Uniprot ID: Q69YI7
  ENSP ID: ENSP00000362170
MAVPAKKRKMNFSEREVEIIVEELELKKHLLVNHFNAGVPLAAKSAAWHGILRRVNAVATCRRELPEVKKKWSDLKTEVRRKVAQVRAAVEGGEAPGPTEEDGAGGPGTGGGSGGGGPAVAPVLLTPMQQRICNLLGEATIISLPSTTEIHPVALGPSATAAAATVTLTQIPTETTYHTLEEGVVEYCTAEAPPPLPPETPVDMMAQHADTSVKPQALKSRIALNSAKLIQEQRVTNLHVKEIAQHLEQQNDLLQMIRRSQEVQACAQERQAQAMEGTQAALSVLIQVLRPMIKDFRRYLQSNTANPAPASDPGQVAQNGQPDSIIQ

SEQ ID NO: 57848 - protein, 494 aa, Homo sapiens
  Payload ID: 11350
  Gene Symbol: NAF1
  Gene Name: nuclear assembly factor 1 ribonucleoprotein
  Uniprot ID: Q96HR8
  ENSP ID: ENSP00000274054
MEVVEAAAAQLETLKFNGTDFGVGEGPAAPSPGSAPVPGTQPPLQSFEGSPDAGQTVEVKPAGEQPLQPVLNAVAAGTPAPQPQPPAESPACGDCVTSPGAAEPARAPDSLETSDSDSDSDSETDSDSSSSSSSSSSSSSSSSSSCISLPPVLSDGDDDLQIEKENKNFPLKTKDELLLNELPSVEELTIILPEDIELKPLGMVSSIIEQLVIIESMTNLPPVNEETVIFKSDRQAAGKIFEIFGPVAHPFYVLRFNSSDHIESKGIKIKETMYFAPSMKDFTQYIFTEKLKQDKGSDASWKNDQEPPPEALDFSDDEKEKEAKQRKKSQIQGRKKLKSEFNEPGEDFTEVHQNWNAHSSASEHAKGYRNREFTRGFSRARYPRSCHGRPPPQHFYNSEHMVSQETSGFPSQRQNNPIMPQYPFPLPVFDMHNFPLRPPPPPPPPPVNMGWATPNMAAHPLLNLPYSLPPPPPPPPLPPPPSSGDSNSHFGPYY

SEQ ID NO: 57849 - protein, 389 aa, Homo sapiens
  Payload ID: 11350
  Gene Symbol: NAF1
  Gene Name: nuclear assembly factor 1 ribonucleoprotein
  Uniprot ID: Q96HR8
  ENSP ID: ENSP00000408963
MEVVEAAAAQLETLKFNGTDFGVGEGPAAPSPGSAPVPGTQPPLQSFEGSPDAGQTVEVKPAGEQPLQPVLNAVAAGTPAPQPQPPAESPACGDCVTSPGAAEPARAPDSLETSDSDSDSDSETDSDSSSSSSSSSSSSSSSSSSCISLPPVLSDGDDDLQIEKENKNFPLKTKDELLLNELPSVEELTIILPEDIELKPLGMVSSIIEQLVIIESMTNLPPVNEETVIFKSDRQAAGKIFEIFGPVAHPFYVLRFNSSDHIESKGIKIKETMYFAPSMKDFTQYIFTEKLKQDKGSDASWKNDQEPPPEALDFSDDEKEKEAKQRKKSQIQGRKKLKSEFNEPGTGISHRYCGLGSRPLQSSESHKLFGFQMHIKVTFTCYFSLLSMQ

SEQ ID NO: 57850 - protein, 42 aa, Homo sapiens
  Payload ID: 11350
  Gene Symbol: NAF1
  Gene Name: nuclear assembly factor 1 ribonucleoprotein
  ENSP ID: ENSP00000427518
MYFAPSMKDFTQYIFTEKLKQDKGSDASWKNDQEPPPETMVD

SEQ ID NO: 57851 - protein, 788 aa, Homo sapiens
  Payload ID: 11351
  Gene Symbol: NASP
  Gene Name: nuclear autoantigenic sperm protein (histone-binding)
  Uniprot ID: P49321
  ENSP ID: ENSP00000255120
MAMESTATAAVAAELVSADKIEDVPAPSTSADKVESLDVDSEAKKLLGLGQKHLVMGDIPAAVNAFQEAASLLGKKYGETANECGEAFFFYGKSLLELARMENGVLGNALEGVHVEEEEGEKTEDESLVENNDNIDEEAREELREQVYDAMGEKEEAKKTEDKSLAKPETDKEQDSEMEKGGREDMDISKSAEEPQEKVDLTLDWLTETSEEAKGGAAPEGPNEAEVTSGKPEQEVPDAEEEKSVSGTDVQEECREKGGQEKQGEVIVSIEEKPKEVSEEQPVVTLEKQGTAVEVEAESLDPTVKPVDVGGDEPEEKVVTSENEAGKAVLEQLVGQEVPPAEESPEVTTEAAEASAVEAGSEVSEKPGQEAPVLPKDGAVNGPSVVGDQTPIEPQTSIERLTETKDGSGLEEKVRAKLVPSQEETKLSVEESEAAGDGVDTKVAQGATEKSPEDKVQIAANEETQEREEQMKEGEETEGSEEDDKENDKTEEMPNDSVLENKSLQENEEEEIGNLELAWDMLDLAKIIFKRQETKEAQLYAAQAHLKLGEVSVESENYVQAVEEFQSCLNLQEQYLEAHDRLLAETHYQLGLAYGYNSQYDEAVAQFSKSIEVIENRMAVLNEQVKEAEGSSAEYKKEIEELKELLPEIREKIEDAKESQRSGNVAELALKATLVESSTSGFTPGGGGSSVSMIASRKPTDGASSSNCVTDISHLVRKKRKPEEESPRKDDAKKAKQEPEVNGGSGDAVPSGNEVSENMEEEAENQAESRAAVEGTVEAGATVESTAC

SEQ ID NO: 57852 - protein, 449 aa, Homo sapiens
  Payload ID: 11351
  Gene Symbol: NASP
  Gene Name: nuclear autoantigenic sperm protein (histone-binding)
  Uniprot ID: P49321
  ENSP ID: ENSP00000255121
MAMESTATAAVAAELVSADKIEDVPAPSTSADKVESLDVDSEAKKLLGLGQKHLVMGDIPAAVNAFQEAASLLGKKYGETANECGEAFFFYGKSLLELARMENGVLGNALEGVHVEEEEGEKTEDESLVENNDNIDETEGSEEDDKENDKTEEMPNDSVLENKSLQENEEEEIGNLELAWDMLDLAKIIFKRQETKEAQLYAAQAHLKLGEVSVESENYVQAVEEFQSCLNLQEQYLEAHDRLLAETHYQLGLAYGYNSQYDEAVAQFSKSIEVIENRMAVLNEQVKEAEGSSAEYKKEIEELKELLPEIREKIEDAKESQRSGNVAELALKATLVESSTSGFTPGGGGSSVSMIASRKPTDGASSSNCVTDISHLVRKKRKPEEESPRKDDAKKAKQEPEVNGGSGDAVPSGNEVSENMEEEAENQAESRAAVEGTVEAGATVESTAC

SEQ ID NO: 57853 - protein, 422 aa, Homo sapiens
  Payload ID: 11351
  Gene Symbol: NASP
  Gene Name: nuclear autoantigenic sperm protein (histone-binding)
  ENSP ID: ENSP00000361122
MAMESTATAAVAAELVSADKIEDVPAPSTSADKVESLDVDSEAKKLLGLGQKHLVMGDIPAAVNAFQEAASLLMENGVLGNALEGVHVEEEEGEKTEDESLVENNDNIDETEGSEEDDKENDKTEEMPNDSVLENKSLQENEEEEIGNLELAWDMLDLAKIIFKRQETKEAQLYAAQAHLKLGEVSVESENYVQAVEEFQSCLNLQEQYLEAHDRLLAETHYQLGLAYGYNSQYDEAVAQFSKSIEVIENRMAVLNEQVKEAEGSSAEYKKEIEELKELLPEIREKIEDAKESQRSGNVAELALKATLVESSTSGFTPGGGGSSVSMIASRKPTDGASSSNCVTDISHLVRKKRKPEEESPRKDDAKKAKQEPEVNGGSGDAVPSGNEVSENMEEEAENQAESRAAVEGTVEAGATVESTAC

SEQ ID NO: 57854 - protein, 38 aa, Homo sapiens
  Payload ID: 11351
  Gene Symbol: NASP
  Gene Name: nuclear autoantigenic sperm protein (histone-binding)
  ENSP ID: ENSP00000388010
MAMESTATAAVAAELVSADKIEDVPAPSTSADKVESNH

SEQ ID NO: 57855 - protein, 256 aa, Homo sapiens
  Payload ID: 11351
  Gene Symbol: NASP
  Gene Name: nuclear autoantigenic sperm protein (histone-binding)
  ENSP ID: ENSP00000400792
MAMESTATAAVAAELVSADKIEDVPAPSTSADKVESLDVDSEAKKLLGLGQKHLVMGDIPAAVNAFQEAASLLGKKYGETANECGEAFFFYGKSLLELARMENGVLGNALEGVHVEEEEGEKTEDESLVENNDNIDETEGSEEDDKENDKTEEMPNDSVLENKSLQENEEEEIGNLELAWDMLDLAKIIFKRQETKEAQLYAAQAHLKLGEVSVESENYVQAVEEFQSCLNLQEQYLEAHDRLLAETHYQLGLAYG

SEQ ID NO: 57856 - protein, 38 aa, Homo sapiens; identical to SEQ ID NO: 57854
  Payload ID: 11351
  Gene Symbol: NASP
  Gene Name: nuclear autoantigenic sperm protein (histone-binding)
  ENSP ID: ENSP00000403157

SEQ ID NO: 57857 - protein, 268 aa, Homo sapiens
  Payload ID: 11351
  Gene Symbol: NASP
  Gene Name: nuclear autoantigenic sperm protein (histone-binding)
  ENSP ID: ENSP00000432289
MAMESTATAAVAAELVSADKIEDVPAPSTSADKVERMENGVLGNALEGVHVEEEEGEKTEDESLVENNDNIDETEGSEEDDKENDKTEEMPNDSVLENKSLQENEEEEIGNLELAWDMLDLAKIIFKRQETKEAQLYAAQAHLKLGEVSVESENYVQAVEEFQSCLNLQEQYLEAHDRLLAETHYQLGLAYGYNSQYDEAVAQFSKSIEVIENRMAVLNEQVKEAEGSSAEYKKEIEELKELLPEIREKIEDAKESQRSGNVAELALK

SEQ ID NO: 57858 - protein, 175 aa, Homo sapiens
  Payload ID: 11351
  Gene Symbol: NASP
  Gene Name: nuclear autoantigenic sperm protein (histone-binding)
  ENSP ID: ENSP00000434240
  MOD_RES (1)..(1): Any amino acid
XQEQYLEAHDRLLAETHYQLGLAYGYNSQYDEAVAQFSKSIEVIENRMAVLNEQVKEAEGSSAEYKKEIEELKELLPEIREKIEDAKESQRSGNVAELALKATLVESSTSGFTPGGGGSSVSMIASRKPTDGASSSNCVTDISHLVRKKAENQAESRAAVEGTVEAGATVESTAC

SEQ ID NO: 57859 - protein, 56 aa, Homo sapiens
  Payload ID: 11351
  Gene Symbol: NASP
  Gene Name: nuclear autoantigenic sperm protein (histone-binding)
  ENSP ID: ENSP00000435363
MAMESTATAAVAAELVSADKIEDVPAPSTSADKVERDEVSSRCPGWGSSHLLTSAT

SEQ ID NO: 57860 - protein, 55 aa, Homo sapiens
  Payload ID: 11351
  Gene Symbol: NASP
  Gene Name: nuclear autoantigenic sperm protein (histone-binding)
  ENSP ID: ENSP00000435548
MAMESTATAAVAAELVSADKMSGRARWLTPVIQHFGRPRWADHEVRRSRPSWLTR

SEQ ID NO: 57861 - protein, 38 aa, Homo sapiens; identical to SEQ ID NO: 57854
  Payload ID: 11351
  Gene Symbol: NASP
  Gene Name: nuclear autoantigenic sperm protein (histone-binding)
  ENSP ID: ENSP00000436388

SEQ ID NO: 57862 - protein, 56 aa, Homo sapiens; identical to SEQ ID NO: 57859
  Payload ID: 11351
  Gene Symbol: NASP
  Gene Name: nuclear autoantigenic sperm protein (histone-binding)
  ENSP ID: ENSP00000436778

SEQ ID NO: 57863 - protein, 37 aa, Homo sapiens
  Payload ID: 11351
  Gene Symbol: NASP
  Gene Name: nuclear autoantigenic sperm protein (histone-binding)
  ENSP ID: ENSP00000436790
MAMESTATAAVAAELVSADKIEDVPAPSTSADKVERN

SEQ ID NO: 57864 - protein, 316 aa, Homo sapiens
  Payload ID: 11351
  Gene Symbol: NASP
  Gene Name: nuclear autoantigenic sperm protein (histone-binding)
  ENSP ID: ENSP00000436924
MAMESTATAAVAAELVSADKIEDVPAPSTSADKVERGKKYGETANECGEAFFFYGKSLLELARMENGVLGNALEGVHVEEEEGEKTEDESLVENNDNIDEEAREELREQVYDAMGEKEEAKKTEDKSLAKPETDKEQDSEMEKGGREDMDISKSAEEPQEKVDLTLDWLTETSEEAKGGAAPEGPNEAEVTSGKPEQEVPDAEEEKSVSGTDVQEECREKGGQEKQGEVIVSIEEKPKEVSEEQPVVTLEKQGTAVEVEAESLDPTVKPVDVGGDEPEEKVVTSENEAGKAVLEQLVGQEVPPAEESPEVTTEAAE

SEQ ID NO: 57865 - protein, 154 aa, Homo sapiens
  Payload ID: 11351
  Gene Symbol: NASP
  Gene Name: nuclear autoantigenic sperm protein (histone-binding)
  ENSP ID: ENSP00000436939
MAMESTATAAVAAELVSADNLDVDSEAKKLLGLGQKHLVMGDIPAAVNAFQEAASLLGKKYGETANECGEAFFFYGKSLLELARMENGVLGNALEGVHVEEEEGEKTEDESLVENNDNIDETEGSEEDDKENDKTEEMPNDSVLENKSLQENEE

SEQ ID NO: 57866 - protein, 288 aa, Homo sapiens
  Payload ID: 11351
  Gene Symbol: NASP
  Gene Name: nuclear autoantigenic sperm protein (histone-binding)
  ENSP ID: ENSP00000437116
  MOD_RES (1)..(1): Any amino acid
XTEGSEEDDKENDKTEEMPNDSVLENKSLQENEEEEIGNLELAWDMLDLAKIIFKRQETKEAQLYAAQAHLKLGEVSVESENYVQAVEEFQSCLNLQEQYLEAHDRLLAETHYQLGLAYGYNSQYDEAVAQFSKSIEVIENRMAVLNEQVKEAEGSSAEYKKEIEELKELLPEIREKIEDAKESQRSGNVAELALKATLVESSTSGFTPGGGGSSVSMKRKPEEESPRKDDAKKAKQEPEVNGGSGDAVPSGNEVSENMEEEAENQAESRAAVEGTVEAGATVESTAC

SEQ ID NO: 57867 - protein, 143 aa, Homo sapiens
  Payload ID: 11351
  Gene Symbol: NASP
  Gene Name: nuclear autoantigenic sperm protein (histone-binding)
  ENSP ID: ENSP00000437241
MAMESTATAAVAAELVSADKIEDVPAPSTSADKVERMENGVLGNALEGVHVEEEEGEKTEDESLVENNDNIDEEAREELREQVYDAMGEKEEAKKTEDKSLAKPETDKEQDSEMEKGGREDMDISKSAEEPQEKVDLTLDWLT

SEQ ID NO: 57868 - protein, 724 aa, Homo sapiens
  Payload ID: 11351
  Gene Symbol: NASP
  Gene Name: nuclear autoantigenic sperm protein (histone-binding)
  Uniprot ID: P49321
  ENSP ID: ENSP00000438871
MAMESTATAAVAAELVSADKIEDVPAPSTSADKVERMENGVLGNALEGVHVEEEEGEKTEDESLVENNDNIDEEAREELREQVYDAMGEKEEAKKTEDKSLAKPETDKEQDSEMEKGGREDMDISKSAEEPQEKVDLTLDWLTETSEEAKGGAAPEGPNEAEVTSGKPEQEVPDAEEEKSVSGTDVQEECREKGGQEKQGEVIVSIEEKPKEVSEEQPVVTLEKQGTAVEVEAESLDPTVKPVDVGGDEPEEKVVTSENEAGKAVLEQLVGQEVPPAEESPEVTTEAAEASAVEAGSEVSEKPGQEAPVLPKDGAVNGPSVVGDQTPIEPQTSIERLTETKDGSGLEEKVRAKLVPSQEETKLSVEESEAAGDGVDTKVAQGATEKSPEDKVQIAANEETQEREEQMKEGEETEGSEEDDKENDKTEEMPNDSVLENKSLQENEEEEIGNLELAWDMLDLAKIIFKRQETKEAQLYAAQAHLKLGEVSVESENYVQAVEEFQSCLNLQEQYLEAHDRLLAETHYQLGLAYGYNSQYDEAVAQFSKSIEVIENRMAVLNEQVKEAEGSSAEYKKEIEELKELLPEIREKIEDAKESQRSGNVAELALKATLVESSTSGFTPGGGGSSVSMIASRKPTDGASSSNCVTDISHLVRKKRKPEEESPRKDDAKKAKQEPEVNGGSGDAVPSGNEVSENMEEEAENQAESRAAVEGTVEAGATVESTAC

SEQ ID NO: 57869 - protein, 56 aa, Homo sapiens; identical to SEQ ID NO: 57859
  Payload ID: 11351
  Gene Symbol: NASP
  Gene Name: nuclear autoantigenic sperm protein (histone-binding)
  ENSP ID: ENSP00000486336

SEQ ID NO: 57870 - protein, 155 aa, Homo sapiens
  Payload ID: 11352
  Gene Symbol: NCBP1
  Gene Name: nuclear cap binding protein subunit 1, 80kDa
  ENSP ID: ENSP00000364272
  MOD_RES (1)..(1): Any amino acid
XLFVWEILHSTIRKMNKHVLKIQKELEEAKEKLARQHKRRSDDDDRSSDRKDGVLEEQIERLQEKVESAQSEQKNLFLVIFQRFIMILTEHLVRCETDGTSVLTPWYKNCIERLQQIFLQVCGELRLGNNTILSHKDFSLKKILVKFVRRLYSTC

SEQ ID NO: 57871 - protein, 790 aa, Homo sapiens
  Payload ID: 11352
  Gene Symbol: NCBP1
  Gene Name: nuclear cap binding protein subunit 1, 80kDa
  Uniprot ID: Q09161
  ENSP ID: ENSP00000364289
MSRRRHSDENDGGQPHKRRKTSDANETEDHLESLICKVGEKSACSLESNLEGLAGVLEADLPNYKSKILRLLCTVARLLPEKLTIYTTLVGLLNARNYNFGGEFVEAMIRQLKESLKANNYNEAVYLVRFLSDLVNCHVIAAPSMVAMFENFVSVTQEEDVPQVRRDWYVYAFLSSLPWVGKELYEKKDAEMDRIFANTESYLKRRQKTHVPMLQVWTADKPHPQEEYLDCLWAQIQKLKKDRWQERHILRPYLAFDSILCEALQHNLPPFTPPPHTEDSVYPMPRVIFRMFDYTDDPEGPVMPGSHSVERFVIEENLHCIIKSHWKERKTCAAQLVSYPGKNKIPLNYHIVEVIFAELFQLPAPPHIDVMYTTLLIELCKLQPGSLPQVLAQATEMLYMRLDTMNTTCVDRFINWFSHHLSNFQFRWSWEDWSDCLSQDPESPKPKFVREVLEKCMRLSYHQRILDIVPPTFSALCPANPTCIYKYGDESSNSLPGHSVALCLAVAFKSKATNDEIFSILKDVPNPNQDDDDDEGFSFNPLKIEVFVQTLLHLAAKSFSHSFSALAKFHEVFKTLAESDEGKLHVLRVMFEVWRNHPQMIAVLVDKMIRTQIVDCAAVANWIFSSELSRDFTRLFVWEILHSTIRKMNKHVLKIQKELEEAKEKLARQHKRRSDDDDRSSDRKDGVLEEQIERLQEKVESAQSEQKNLFLVIFQRFIMILTEHLVRCETDGTSVLTPWYKNCIERLQQIFLQHHQIIQQYMVTLENLLFTAELDPHILAVFQQFCALQA

SEQ ID NO: 57872 - protein, 82 aa, Homo sapiens
  Payload ID: 11352
  Gene Symbol: NCBP1
  Gene Name: nuclear cap binding protein subunit 1, 80kDa
  ENSP ID: ENSP00000433007
MSRRRHSDENDGGQPHKRRKTSDANETEDHLESLICKVGEKSACSLESNLEGLAGVLEADLPNYKSKILRLLCTVSVFYLIL

SEQ ID NO: 57873 - protein, 82 aa, Homo sapiens; identical to SEQ ID NO: 57872
  Payload ID: 11352
  Gene Symbol: NCBP1
  Gene Name: nuclear cap binding protein subunit 1, 80kDa
  ENSP ID: ENSP00000487569

SEQ ID NO: 57874 - protein, 156 aa, Homo sapiens
  Payload ID: 11353
  Gene Symbol: NCBP2
  Gene Name: nuclear cap binding protein subunit 2, 20kDa
  Uniprot ID: P52298
  ENSP ID: ENSP00000326806
MSGGLLKALRSDSYVELSQYRDQHFRGDNEEQEKLLKKSCTLYVGNLSFYTTEEQIYELFSKSGDIKKIIMGLDKMKKTACGFCFVEYYSRADAENAMRYINGTRLDDRIIRTDWDAGFKEGRQYGRGRSGGQVRDEYRQDYDAGRGGYGKLAQNQ

SEQ ID NO: 57875 - protein, 83 aa, Homo sapiens
  Payload ID: 11353
  Gene Symbol: NCBP2
  Gene Name: nuclear cap binding protein subunit 2, 20kDa
  ENSP ID: ENSP00000389315
MGLDKMKKTACGFCFVEYYSRADAENAMRYINGTRLDDRIIRTDWDAGFKEGRQYGRGRSGGQVRDEYRQDYDAGRGGYGKLA

SEQ ID NO: 57876 - protein, 86 aa, Homo sapiens
  Payload ID: 11353
  Gene Symbol: NCBP2
  Gene Name: nuclear cap binding protein subunit 2, 20kDa
  ENSP ID: ENSP00000394105
MGLDKMKKTACGFCFVEYYSRADAENAMRYINGTRLDDRIIRTDWDAGFKEGRQYGRGRSGGQVRDEYRQDYDAGRGGYGKLAQNQ

SEQ ID NO: 57877 - protein, 103 aa, Homo sapiens
  Payload ID: 11353
  Gene Symbol: NCBP2
  Gene Name: nuclear cap binding protein subunit 2, 20kDa
  Uniprot ID: P52298
  ENSP ID: ENSP00000397619
MSGGLLKALRSDSYVELSQYRDQHFRGDNEEQEKLLKKSYAENAMRYINGTRLDDRIIRTDWDAGFKEGRQYGRGRSGGQVRDEYRQDYDAGRGGYGKLAQNQ

SEQ ID NO: 57878 - protein, 15 aa, Homo sapiens
  Payload ID: 11353
  Gene Symbol: NCBP2
  Gene Name: nuclear cap binding protein subunit 2, 20kDa
  ENSP ID: ENSP00000402549
MGLDKMKKTACGFCF

SEQ ID NO: 57879 - protein, 138 aa, Homo sapiens
  Payload ID: 11353
  Gene Symbol: NCBP2
  Gene Name: nuclear cap binding protein subunit 2, 20kDa
  Uniprot ID: P52298
  ENSP ID: ENSP00000412785
MVLRKLYAGDNEEQEKLLKKSCTLYVGNLSFYTTEEQIYELFSKSGDIKKIIMGLDKMKKTACGFCFVEYYSRADAENAMRYINGTRLDDRIIRTDWDAGFKEGRQYGRGRSGGQVRDEYRQDYDAGRGGYGKLAQNQ

SEQ ID NO: 57880 - protein, 86 aa, Homo sapiens; identical to SEQ ID NO: 57876
  Payload ID: 11353
  Gene Symbol: NCBP2
  Gene Name: nuclear cap binding protein subunit 2, 20kDa
  ENSP ID: ENSP00000413518

SEQ ID NO: 57881 - protein, 54 aa, Homo sapiens
  Payload ID: 11353
  Gene Symbol: NCBP2
  Gene Name: nuclear cap binding protein subunit 2, 20kDa
  ENSP ID: ENSP00000414122
MSGGLLKALRSDSYVELSQYRDQHFRVREAGPRDGKALGKNAEKRVTMKNKKNY

SEQ ID NO: 57882 - protein, 153 aa, Homo sapiens
  Payload ID: 11354
  Gene Symbol: NCBP2L
  Gene Name: nuclear cap binding protein subunit 2-like
  Uniprot ID: A6PVI3
  ENSP ID: ENSP00000476955
MSKDLKILCKDPALELSCYRDHQFSGRKFQQEKLLKESSTLNMGNLSFYTTEEKIHELFSRSDIRNIFMGLDKIKKTACGFCFVECHNRADAENAMRFLTGTCLDEWIICTDWDVGFREGQQYGRGKSGGQVRDEFREDFHSGRGGFGRQTQI

SEQ ID NO: 57883 - protein, 620 aa, Homo sapiens
  Payload ID: 11355
  Gene Symbol: NCBP3
  Gene Name: nuclear cap binding subunit 3
  Uniprot ID: Q53F19
  ENSP ID: ENSP00000373657
MAAVRGLRVSVKAEAPAGPALGLPSPEAESGVDRGEPEPMEVEEGELEIVPVRRSLKELIPDTSRRYENKAGSFITGIDVTSKEAIEKKEQRAKRFHFRSEVNLAQRNVALDRDMMKKAIPKVRLETIYICGVDEMSTQDVFSYFKEYPPAHIEWLDDTSCNVVWLDEMTATRALINMSSLPAQDKIRSRDASEDKSAEKRKKDKQEDSSDDDEAEEGEVEDENSSDVELDTLSQVEEESLLRNDLRPANKLAKGNRLFMRFATKDDKKELGAARRSQYYMKYGNPNYGGMKGILSNSWKRRYHSRRIQRDVIKKRALIGDDVGLTSYKHRHSGLVNVPEEPIEEEEEEEEEEEEEEEEDQDMDADDRVVVEYHEELPALKQPRERSASRRSSASSSDSDEMDYDLELKMISTPSPKKSMKMTMYADEVESQLKNIRNSMRADSVSSSNIKNRIGNKLPPEKFADVRHLLDEKRQHSRPRPPVSSTKSDIRQRLGKRPHSPEKAFSSNPVVRREPSSDVHSRLGVPRQDSKGLYADTREKKSGNLWTRLGSAPKTKEKNTKKVDHRAPGAEEDDSELQRAWGALIKEKEQSRQKKSRLDNLPSLQIEVSRESSSGSEAES

SEQ ID NO: 57884 - protein, 80 aa, Homo sapiens
  Payload ID: 11355
  Gene Symbol: NCBP3
  Gene Name: nuclear cap binding subunit 3
  ENSP ID: ENSP00000466165
PKTKEKNTKKVDHRAPGAEEDDSELQRAWGALIKEKEQSRQKKSRCYQHPFPKKSQFPGAYWTSFEGEEEGSGQLTLPGP

SEQ ID NO: 57885 - protein, 36 aa, Homo sapiens
  Payload ID: 11355
  Gene Symbol: NCBP3
  Gene Name: nuclear cap binding subunit 3
  ENSP ID: ENSP00000467742
  MOD_RES (1)..(1): Any amino acid
XSLLRNDLRPANKLAKGNRLFMRFATKAPGLGSIQD

SEQ ID NO: 57886 - protein, 243 aa, Homo sapiens
  Payload ID: 11356
  Gene Symbol: NUCKS1
  Gene Name: nuclear casein kinase and cyclin-dependent kinase substrate 1
  Uniprot ID: Q9H1E3
  ENSP ID: ENSP00000356110
MSRPVRNRKVVDYSQFQESDDADEDYGRDSGPPTKKIRSSPREAKNKRRSGKNSQEDSEDSEDKDVKTKKDDSHSAEDSEDEKEDHKNVRQQRQAASKAASKQREMLMEDVGSEEEQEEEDEAPFQEKDSGSDEDFLMEDDDDSDYGSSKKKNKKMVKKSKPERKEKKMPKPRLKATVTPSPVKGKGKVGRPTASKASKEKTPSPKEEDEEPESPPEKKTSTSPPPEKSGDEGSEDEAPSGED

SEQ ID NO: 57887 - protein, 444 aa, Homo sapiens
  Payload ID: 11357
  Gene Symbol: NEMP1
  Gene Name: nuclear envelope integral membrane protein 1
  Uniprot ID: O14524
  ENSP ID: ENSP00000300128
MAGGMKVAVSPAVGPGPWGSGVGGGGTVRLLLILSGCLVYGTAETDVNVVMLQESQVCEKRASQQFCYTNVLIPKWHDIWTRIQIRVNSSRLVRVTQVENEEKLKELEQFSIWNFFSSFLKEKLNDTYVNVGLYSTKTCLKVEIIEKDTKYSVIVIRRFDPKLFLVFLLGLMLFFCGDLLSRSQIFYYSTGMTVGIVASLLIIIFILSKFMPKKSPIYVILVGGWSFSLYLIQLVFKNLQEIWRCYWQYLLSYVLTVGFMSFAVCYKYGPLENERSINLLTWTLQLMGLCFMYSGIQIPHIALAIIIIALCTKNLEHPIQWLYITCRKVCKGAEKPVPPRLLTEEEYRIQGEVETRKALEELREFCNSPDCSAWKTVSRIQSPKRFADFVEGSSHLTPNEVSVHEQEYGLGSIIAQDEIYEEASSEEEDSYSRCPAITQNNFLT

SEQ ID NO: 57888 - protein, 371 aa, Homo sapiens
  Payload ID: 11357
  Gene Symbol: NEMP1
  Gene Name: nuclear envelope integral membrane protein 1
  Uniprot ID: O14524
  ENSP ID: ENSP00000368701
MAGGMKVAVSPAVGPGPWGSGVGGGGTVRLLLILSGCLVYGTAETDVNVVMLQESQVCEKRASQQFCYTNVLIPKWHDIWTRIQIRVNSSRLVRVTQVENEEKLKELEQSQIFYYSTGMTVGIVASLLIIIFILSKFMPKKSPIYVILVGGWSFSLYLIQLVFKNLQEIWRCYWQYLLSYVLTVGFMSFAVCYKYGPLENERSINLLTWTLQLMGLCFMYSGIQIPHIALAIIIIALCTKNLEHPIQWLYITCRKVCKGAEKPVPPRLLTEEEYRIQGEVETRKALEELREFCNSPDCSAWKTVSRIQSPKRFADFVEGSSHLTPNEVSVHEQEYGLGSIIAQDEIYEEASSEEEDSYSRCPAITQNNFLT

SEQ ID NO: 57889 - protein, 110 aa, Homo sapiens
  Payload ID: 11357
  Gene Symbol: NEMP1
  Gene Name: nuclear envelope integral membrane protein 1
  ENSP ID: ENSP00000452391
MAGGMKVAVSPAVGPGPWGSGVGGGGTVRLLLILSGCLVYGTAETDVNVVMLQESQVCEKRASQQFCYTNVLIPKWHDIWTRIQIRVNSSRLVRVTQVENEEKLKELEQI

SEQ ID NO: 57890 - protein, 85 aa, Homo sapiens
  Payload ID: 11358
  Gene Symbol: NEMP2
  Gene Name: nuclear envelope integral membrane protein 2
  ENSP ID: ENSP00000340087
MGPRQGRWWLLLWLPPLATLPVRGEAAAAALSVRRCKALKEKDLIRTSESDCYCYNQNSQVEWKYIWSTMQGDCVLLCGACQEDI

SEQ ID NO: 57891 - protein, 417 aa, Homo sapiens
  Payload ID: 11358
  Gene Symbol: NEMP2
  Gene Name: nuclear envelope integral membrane protein 2
  Uniprot ID: A6NFY4
  ENSP ID: ENSP00000386292
MGPRQGRWWLLLWLPPLATLPVRGEAAAAALSVRRCKALKEKDLIRTSESDCYCYNQNSQVEWKYIWSTMQVKITSPGLFRIVYIAERHNCQYPENILSFIKCVIHNFWIPKESNEITIIINPYRETVCFSVEPVKKIFNYMIHVNRNIMDFKLFLVFVAGVFLFFYARTLSQSPTFYYSSGTVLGVLMTLVFVLLLVKRFIPKYSTFWALMVGCWFASVYIVCQLMEDLKWLWYENRIYVLGYVLIVGFFSFVVCYKHGPLADDRSRSLLMWMLRLLSLVLVYAGVAVPQFAYAAIILLMSSWSLHYPLRACSYMRWKMEQWFTSKELVVKYLTEDEYREQADAETNSALEELRRACRKPDFPSWLVVSRLHTPSKFADFVLGGSHLSPEEISLHEEQYGLGGAFLEEQLFNPSTA

SEQ ID NO: 57892 - protein, 35 aa, Homo sapiens
  Payload ID: 11358
  Gene Symbol: NEMP2
  Gene Name: nuclear envelope integral membrane protein 2
  ENSP ID: ENSP00000403867
DCYCYNQNSQVEWKYIWSTMQGDCVLLCGACQEDI

SEQ ID NO: 57893 - protein, 138 aa, Homo sapiens
  Payload ID: 11358
  Gene Symbol: NEMP2
  Gene Name: nuclear envelope integral membrane protein 2
  Uniprot ID: A6NFY4
  ENSP ID: ENSP00000404283
MQVKITSPGLFRIVYIAERHNCQYPENILSFIKCVIHNFWIPKESNEITIIINPYRETVCFSVEPVKKIFNYMIHVNRNIMDFKLFLVFVAGVFLFFYARTLSQSPTFYYSSGTVLGVLMTLVFVLLLVKRFIPKAMS

SEQ ID NO: 57894 - protein, 24 aa, Homo sapiens
  Payload ID: 11358
  Gene Symbol: NEMP2
  Gene Name: nuclear envelope integral membrane protein 2
  ENSP ID: ENSP00000410306
MQVKITSPGLFRIVYIAERHNCQY

SEQ ID NO: 57895 - protein, 1076 aa, Homo sapiens
  Payload ID: 11359
  Gene Symbol: NEMF
  Gene Name: nuclear export mediator factor
  Uniprot ID: O60524
  ENSP ID: ENSP00000298310
MKSRFSTIDLRAVLAELNASLLGMRVNNVYDVDNKTYLIRLQKPDFKATLLLESGIRIHTTEFEWPKNMMPSSFAMKCRKHLKSRRLVSAKQLGVDRIVDFQFGSDEAAYHLIIELYDRGNIVLTDYEYVILNILRFRTDEADDVKFAVRERYPLDHARAAEPLLTLERLTEIVASAPKGELLKRVLNPLLPYGPALIEHCLLENGFSGNVKVDEKLETKDIEKVLVSLQKAEDYMKTTSNFSGKGYIIQKREIKPSLEADKPVEDILTYEEFHPFLFSQHSQCPYIEFESFDKAVDEFYSKIEGQKIDLKALQQEKQALKKLDNVRKDHENRLEALQQAQEIDKLKGELIEMNLQIVDRAIQVVRSALANQIDWTEIGLIVKEAQAQGDPVASAIKELKLQTNHVTMLLRNPYLLSEEEDDDVDGDVNVEKNETEPPKGKKKKQKNKQLQKPQKNKPLLVDVDLSLSAYANAKKYYDHKRYAAKKTQKTVEAAEKAFKSAEKKTKQTLKEVQTVTSIQKARKVYWFEKFLWFISSENYLIIGGRDQQQNEIIVKRYLTPGDIYVHADLHGATSCVIKNPTGEPIPPRTLTEAGTMALCYSAAWDARVITSAWWVYHHQVSKTAPTGEYLTTGSFMIRGKKNFLPPSYLMMGFSFLFKVDESCVWRHQGERKVRVQDEDMETLASCTSELISEEMEQLDGGDTSSDEDKEEHETPVEVELMTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEENLFDSLTGQPHPEDVLLFAIPICAPYTTMTNYKYKVKLTPGVQKKGKAAKTALNSFMHSKEATAREKDLFRSVKDTDLSRNIPGKVKVSAPNLLNVKRK

SEQ ID NO: 57896 - protein, 178 aa, Homo sapiens
  Payload ID: 11359
  Gene Symbol: NEMF
  Gene Name: nuclear export mediator factor
  ENSP ID: ENSP00000451740
MKSRFSTIDLRAVLAELNASLLGMRVNNVYDVDNKTYLIRLQKPDFKATLLLESGIRIHTTEFEWPKNMMPSSFAMKGNIVLTDYEYVILNILRFRTDEADDVKFAVRERYPLDHARAAEPLLTLERLTEIVASAPKGELLKRVLNPLLPYGPALIEHCLLENGFSGNVKVDEKLETK

SEQ ID NO: 57897 - protein, 121 aa, Homo sapiens
  Payload ID: 11359
  Gene Symbol: NEMF
  Gene Name: nuclear export mediator factor
  ENSP ID: ENSP00000452174
MKSRFSTIDLRAVLAELNASLLGMRVNNVYDVDNKTYLIRLQKPDFKATLLLESGIRIHTTEFEWPKNMMPSSFAMKCRKHLKSRRLVSAKQLGVDRIVDFQFGSDEAAYHLIIELYDRVS

SEQ ID NO: 57898 - protein, 998 aa, Homo sapiens
  Payload ID: 11359
  Gene Symbol: NEMF
  Gene Name: nuclear export mediator factor
  ENSP ID: ENSP00000452540
MKSRFSTIDLRAVLAELNASLLGMRVNNVYDVDNKTYLIRLQKPDFKATLLLESGIRIHTTEFEWPKNMMPSSFAMKGNIVLTDYEYVILNILRFRTDEADDVKFAVRERYPLDHARAAEPLLTLERLTEIVASAPKGELLKRVLNPLLPYGPALIEHCLLENGFSGNVKVDEKLETKDIEKVLVSLQKAEDYMKTTSNFSGKGYIIQKREIKPSLEADKPVEDILTYEEFHPFLFSQHSQCPYIEFESFDKAVDEFYSKIEGQKIDLKALQQEKQALKKLDNVRKDHENRLEALQQAQEIDKLKGELIEMNLQIVDRAIQVVRSALANQIDWTEIGLIVKEAQAQGDPVASAIKELKLQTNHVTMLLRNPYLLSEEEDDDVDGDVNVEKNETEPPKGKKKKQKNKQLQKPQKNKPLLVDVDLSLSAYANAKKYYDHKRYAAKKTQKTVEAAEKAFKSAEKKTKQTLKEVQTVTSIQKARKVYWFEKFLWFISSENYLIIGGRDQQQNEIIVKRYLTPGDIYVHADLHGATSCVIKNPTGEPIPPRTLTEAGTMALCYSAAWDARVITSAWWVYHHQVSKTAPTGEYLTTGSFMIRGKKNFLPPSYLMMGFSFLFKVDESCVWRHQGERKVRVQDEDMETLASCTSELISEEMEQLDGGDTSSDEDKEEHETPVEVELMTQVDQEDITLQSGRDELNEELIQEESSEDEGEYEEVRKDQDSVGEMKDEGEETLNYPDTTIDLSHLQPQRSIQKLASKEESSNSSDSKSQSRRHLSAKERREMKKKKLPSDSGDLEALEGKDKEKESTVHIETHQNTSKNVAAVQPMKRGQKSKMKKMKEKYKDQDEEDRELIMKLLGSAGSNKEEKGKKGKKGKTKDEPVKKQPQKPRGGQRVSDNIKKETPFLEVITHELQDFAVDDPHDDKEEQDLDQQGNEENLFDSLTGQPHPEDVLLFAIPICAPYTTMTNYKYKVKLTPGVQKKGKAAKTALNSFMHSKEAT

SEQ ID NO: 57899 - protein, 380 aa, Homo sapiens
  Payload ID: 11360
  Gene Symbol: NFIA
  Gene Name: nuclear factor I/A
  ENSP ID: ENSP00000360226
MYSPLCLTQDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAAGMPSPTTLKKSEKSGFSSPSPSQTSSLGTAFTQHHRPVITGPRASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPTYSTPSTSPANRFVSVGPRDPSFVNIPQQTQSWYLG

SEQ ID NO: 57900 - protein, 487 aa, Homo sapiens
  Payload ID: 11360
  Gene Symbol: NFIA
  Gene Name: nuclear factor I/A
  ENSP ID: ENSP00000360227
MYSPLCLTQDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAAGHLGFQDSFVTSGVFSVTELVRVSQTPIAAGTGPNFSLSDLESSSYYSMSPGAMRRSLPSTSSTSSTKRLKSVEDEMDSPGEEPFYTGQGRSPGSGSQSSGWHEVEPGMPSPTTLKKSEKSGFSSPSPSQTSSLGTAFTQHHRPVITGPRASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPTYSTPSTSPANRFVSVGPRDPSFVNIPQQTQSWYLG

SEQ ID NO: 57901 - protein, 498 aa, Homo sapiens
  Payload ID: 11360
  Gene Symbol: NFIA
  Gene Name: nuclear factor I/A
  Uniprot ID: Q12857
  ENSP ID: ENSP00000360229
MYSPLCLTQDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAADSSQSESPSQPSDADIKDQPENGHLGFQDSFVTSGVFSVTELVRVSQTPIAAGTGPNFSLSDLESSSYYSMSPGAMRRSLPSTSSTSSTKRLKSVEDEMDSPGEEPFYTGQGRSPGSGSQSSGWHEVEPGMPSPTTLKKSEKSGFSSPSPSQTSSLGTAFTQHHRPVITGPRASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPILVPGIKVAASHHPPDRPPDPFSTL

SEQ ID NO: 57902 - protein, 554 aa, Homo sapiens
  Payload ID: 11360
  Gene Symbol: NFIA
  Gene Name: nuclear factor I/A
  Uniprot ID: Q12857
  ENSP ID: ENSP00000360231
MQMCRPASSSVLYVPTRWPGGCGATWQSCPSPPPRRTRIPQRPAVMYSPLCLTQDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAADSSQSESPSQPSDADIKDQPENGHLGFQDSFVTSGVFSVTELVRVSQTPIAAGTGPNFSLSDLESSSYYSMSPGAMRRSLPSTSSTSSTKRLKSVEDEMDSPGEEPFYTGQGRSPGSGSQSSGWHEVEPGMPSPTTLKKSEKSGFSSPSPSQTSSLGTAFTQHHRPVITGPRASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPTYSTPSTSPANRFVSVGPRDPSFVNIPQQTQSWYLG

SEQ ID NO: 57903 - protein, 532 aa, Homo sapiens
  Payload ID: 11360
  Gene Symbol: NFIA
  Gene Name: nuclear factor I/A
  ENSP ID: ENSP00000360233
MKLADSVMAGKASDGSIKWQLCYDISARTWWMDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAADSSQSESPSQPSDADIKDQPENGHLGFQDSFVTSGVFSVTELVRVSQTPIAAGTGPNFSLSDLESSSYYSMSPGAMRRSLPSTSSTSSTKRLKSVEDEMDSPGEEPFYTGQGRSPGSGSQSSGWHEVEPGMPSPTTLKKSEKSGFSSPSPSQTSSLGTAFTQHHRPVITGPRASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPTYSTPSTSPANRFVSVGPRDPSFVNIPQQTQSWYLG

SEQ ID NO: 57904 - protein, 509 aa, Homo sapiens
  Payload ID: 11360
  Gene Symbol: NFIA
  Gene Name: nuclear factor I/A
  Uniprot ID: Q12857
  ENSP ID: ENSP00000384523
MYSPLCLTQDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAADSSQSESPSQPSDADIKDQPENGHLGFQDSFVTSGVFSVTELVRVSQTPIAAGTGPNFSLSDLESSSYYSMSPGAMRRSLPSTSSTSSTKRLKSVEDEMDSPGEEPFYTGQGRSPGSGSQSSGWHEVEPGMPSPTTLKKSEKSGFSSPSPSQTSSLGTAFTQHHRPVITGPRASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPTYSTPSTSPANRFVSVGPRDPSFVNIPQQTQSWYLG

SEQ ID NO: 57905 - protein, 501 aa, Homo sapiens
  Payload ID: 11360
  Gene Symbol: NFIA
  Gene Name: nuclear factor I/A
  Uniprot ID: Q12857
  ENSP ID: ENSP00000384680
MDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAADSSQSESPSQPSDADIKDQPENGHLGFQDSFVTSGVFSVTELVRVSQTPIAAGTGPNFSLSDLESSSYYSMSPGAMRRSLPSTSSTSSTKRLKSVEDEMDSPGEEPFYTGQGRSPGSGSQSSGWHEVEPGMPSPTTLKKSEKSGFSSPSPSQTSSLGTAFTQHHRPVITGPRASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPTYSTPSTSPANRFVSVGPRDPSFVNIPQQTQSWYLG

SEQ ID NO: 57906 - protein, 466 aa, Homo sapiens
  Payload ID: 11360
  Gene Symbol: NFIA
  Gene Name: nuclear factor I/A
  ENSP ID: ENSP00000419785
MYSPLCLTQDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAADSSQSESPSQPSDADIKDQPENGHLGFQDSFVTSGVFSVTELVRVSQTPIAAGTGPNFSLSDLESSSYYSMSPGAMRRSLPSTSSTSSTKRLKSVEDEMDSPGEEPFYTGQGRSPGSGSQSSGWHEVEPASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPTYSTPSTSPANRFVSVGPRDPSFVNIPQQTQSWYLG

SEQ ID NO: 57907 - protein, 95 aa, Homo sapiens
  Payload ID: 11360
  Gene Symbol: NFIA
  Gene Name: nuclear factor I/A
  ENSP ID: ENSP00000473830
  MOD_RES (1)..(1): Any amino acid
XKKPPCCVLSNPDQKGKMRRIDCLRQADKVWRLDLVMVILFKGIPLESTDGERLVKSPQCSNPGLCVQPHHIGVSVKELDLYLAYFVHAAGGVGR

SEQ ID NO: 57908 - protein, 186 aa, Homo sapiens
  Payload ID: 11360
  Gene Symbol: NFIA
  Gene Name: nuclear factor I/A
  ENSP ID: ENSP00000474461
MSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAADSSQSESPSQPSDADIKDQPENGHLGFQDSFVTSGVFSVTELVRVSQ

SEQ ID NO: 57909 - protein, 157 aa, Homo sapiens
  Payload ID: 11360
  Gene Symbol: NFIA
  Gene Name: nuclear factor I/A
  ENSP ID: ENSP00000474462
MFSFPAASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPTYSTPSTSPANRFVSVGPRDPSFVNIPQQTQSWYLG

SEQ ID NO: 57910 - protein, 184 aa, Homo sapiens
  Payload ID: 11360
  Gene Symbol: NFIA
  Gene Name: nuclear factor I/A
  ENSP ID: ENSP00000474806
  MOD_RES (1)..(1): Any amino acid
XPIAAGTGPNFSLSDLESSSYYSMSPGAMRRSLPSTSSTSSTKRLKSVEDEMDSPGEEPFYTGQGRSPGSGSQSSGWHEVEPGMPSPTTLKKSEKSGFSSPSPSQTSSLGTAFTQHHRPVITGPREFKMAPSILGSPFWKVYSASPHATPSTLHFPTSPIIQQPGPYFSHPAIRYHPQETLKEF

SEQ ID NO: 57911 - protein, 47 aa, Homo sapiens
  Payload ID: 11360
  Gene Symbol: NFIA
  Gene Name: nuclear factor I/A
  ENSP ID: ENSP00000474817
  MOD_RES (1)..(1): Any amino acid
XTKPPTTSTEGGAASPTSPRCHMTGRVLWETLISLRWCGPEQSWYLG

SEQ ID NO: 57912 - protein, 200 aa, Homo sapiens
  Payload ID: 11361
  Gene Symbol: NFIB
  Gene Name: nuclear factor I/B
  ENSP ID: ENSP00000370308
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQGKNFFSSNKCIKI

SEQ ID NO: 57913 - protein, 168 aa, Homo sapiens
  Payload ID: 11361
  Gene Symbol: NFIB
  Gene Name: nuclear factor I/B
  ENSP ID: ENSP00000370311
MNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQSWYLG

SEQ ID NO: 57914 - protein, 446 aa, Homo sapiens
  Payload ID: 11361
  Gene Symbol: NFIB
  Gene Name: nuclear factor I/B
  ENSP ID: ENSP00000370321
MERIPVSVDFWVVCCAVLKCNPGIPKRMSTLCFGFSDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQSWYLG

SEQ ID NO: 57915 - protein, 494 aa, Homo sapiens
  Payload ID: 11361
  Gene Symbol: NFIB
  Gene Name: nuclear factor I/B
  Uniprot ID: O00712
  ENSP ID: ENSP00000370340
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQPNGSGQVVGKVPGHFTPVLAPSPHPSAVRPVTLSMTDTKPITTSTEAYTASGTSQANRYVGLSPRDPSFLHQQQSWYLG

SEQ ID NO: 57916 - protein, 420 aa, Homo sapiens
  Payload ID: 11361
  Gene Symbol: NFIB
  Gene Name: nuclear factor I/B
  Uniprot ID: O00712
  ENSP ID: ENSP00000370346
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQSWYLG

SEQ ID NO: 57917 - protein, 561 aa, Homo sapiens
  Payload ID: 11361
  Gene Symbol: NFIB
  Gene Name: nuclear factor I/B
  ENSP ID: ENSP00000380705
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQPNGSGQVVGKVPGHFTPVLAPSPHPSAVRPVTLSMTDTKPITTSTEAYTASGTSQANRYVGLSPRDPSFLHQQQLRICDWTMNQNGRHLYPSTSEDTLGITWQSPGTWASLVPFQVSNRTPILPANVQNYGLNIIGEPFLQAETSN

SEQ ID NO: 57918 - protein, 487 aa, Homo sapiens
  Payload ID: 11361
  Gene Symbol: NFIB
  Gene Name: nuclear factor I/B
  ENSP ID: ENSP00000380709
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQLRICDWTMNQNGRHLYPSTSEDTLGITWQSPGTWASLVPFQVSNRTPILPANVQNYGLNIIGEPFLQAETSN

SEQ ID NO: 57919 - protein, 570 aa, Homo sapiens
  Payload ID: 11361
  Gene Symbol: NFIB
  Gene Name: nuclear factor I/B
  ENSP ID: ENSP00000380711
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQPNGSGQVVGKVPGHFTPVLAPSPHPSAVRPVTLSMTDTKPITTSTEGEAASPTATTYTASGTSQANRYVGLSPRDPSFLHQQQLRICDWTMNQNGRHLYPSTSEDTLGITWQSPGTWASLVPFQVSNRTPILPANVQNYGLNIIGEPFLQAETSN

SEQ ID NO: 57920 - protein, 309 aa, Homo sapiens
  Payload ID: 11361
  Gene Symbol: NFIB
  Gene Name: nuclear factor I/B
  Uniprot ID: O00712
  ENSP ID: ENSP00000442888
MNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQPNGSGQVVGKVPGHFTPVLAPSPHPSAVRPVTLSMTDTKPITTSTEAYTASGTSQANRYVGLSPRDPSFLHQQQLRICDWTMNQNGRHLYPSTSEDTLGITWQSPGTWASLVPFQVSNRTPILPANVQNYGLNIIGEPFLQAETSN

SEQ ID NO: 57921 - protein, 166 aa, Homo sapiens
  Payload ID: 11361
  Gene Symbol: NFIB
  Gene Name: nuclear factor I/B
  ENSP ID: ENSP00000475362
MVLHSDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITV

SEQ ID NO: 57922 - protein, 59 aa, Homo sapiens
  Payload ID: 11361
  Gene Symbol: NFIB
  Gene Name: nuclear factor I/B
  ENSP ID: ENSP00000475813
MQYSAMDEFHPFIEALLPHVRAIAYTWFNLQARKRKYFKKHEKRMSKDEERAVKDELLS

SEQ ID NO: 57923 - protein, 188 aa, Homo sapiens [sequence omitted]

SEQ ID NO: 57924 - protein, 428 aa, Homo sapiens
  Payload ID: 11362
  Gene Symbol: NFIC
  Gene Name: nuclear factor I/C (CCAAT-binding transcription factor)
  Uniprot ID: P08651
  ENSP ID: ENSP00000342194
MYSSPLCLTQDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPSWYLG

SEQ ID NO: 57925 - protein, 430 aa, Homo sapiens
  Payload ID: 11362
  Gene Symbol: NFIC
  Gene Name: nuclear factor I/C (CCAAT-binding transcription factor)
  Uniprot ID: P08651
  ENSP ID: ENSP00000378543
MDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPPTLRPTRPLQTVPLWD

SEQ ID NO: 57926 - protein, 508 aa, Homo sapiens
  Payload ID: 11362
  Gene Symbol: NFIC
  Gene Name: nuclear factor I/C (CCAAT-binding transcription factor)
  Uniprot ID: P08651
  ENSP ID: ENSP00000396843
MYSSPLCLTQDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPLNGSGQLKMPSHCLSAQMLAPPPPGLPRLALPPATKPATTSEGGATSPTSPSYSPPDTSPANRSFVGLGPRDPAGIYQAQSWYLG

SEQ ID NO: 57927 - protein, 406 aa, Homo sapiens
  Payload ID: 11362
  Gene Symbol: NFIC
  Gene Name: nuclear factor I/C (CCAAT-binding transcription factor)
  Uniprot ID: P08651
  ENSP ID: ENSP00000465177
MDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPPTLRPTRPLQTVPLWD

SEQ ID NO: 57928 - protein, 499 aa, Homo sapiens
  Payload ID: 11362
  Gene Symbol: NFIC
  Gene Name: nuclear factor I/C (CCAAT-binding transcription factor)
  Uniprot ID: P08651
  ENSP ID: ENSP00000465655
MDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPLNGSGQLKMPSHCLSAQMLAPPPPGLPRLALPPATKPATTSEGGATSPTSPSYSPPDTSPANRSFVGLGPRDPAGIYQAQSWYLG

SEQ ID NO: 57929 - protein, 439 aa, Homo sapiens
  Payload ID: 11362
  Gene Symbol: NFIC
  Gene Name: nuclear factor I/C (CCAAT-binding transcription factor)
  Uniprot ID: P08651
  ENSP ID: ENSP00000466647
MYSSPLCLTQDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPPTLRPTRPLQTVPLWD

SEQ ID NO: 57930 - protein, 403 aa, Homo sapiens
  Payload ID: 11363
  Gene Symbol: NFIX
  Gene Name: nuclear factor I/X (CCAAT-binding transcription factor)
  ENSP ID: ENSP00000351354
MGATEPGGDTSSDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGSPRATASALHFPSTSIIQQSSPYFTHPTIRYHHHHGQDSLKEFVQFVCSDGSGQATGQHSQRQAPPLPTGLSASDPGTATF

SEQ ID NO: 57931 - protein, 403 aa, Homo sapiens; identical to SEQ ID NO: 57930
  Payload ID: 11363
  Gene Symbol: NFIX
  Gene Name: nuclear factor I/X (CCAAT-binding transcription factor)
  ENSP ID: ENSP00000353219

SEQ ID NO: 57932 - protein, 441 aa, Homo sapiens
  Payload ID: 11363
  Gene Symbol: NFIX
  Gene Name: nuclear factor I/X (CCAAT-binding transcription factor)
  Uniprot ID: Q14938
  ENSP ID: ENSP00000380781
MYSPYCLTQDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGPASLKKSGKLDFCSALSSQGSSPRMAFTHHPLPVLAGVRPGSPRATASALHFPSTSIIQQSSPYFTHPTIRYHHHHGQDSLKEFVQFVCSDGSGQATGQHSQRQAPPLPTGLSASDPGTATF

SEQ ID NO: 57933 - protein, 183 aa, Homo sapiens
  Payload ID: 11363
  Gene Symbol: NFIX
  Gene Name: nuclear factor I/X (CCAAT-binding transcription factor)
  ENSP ID: ENSP00000465094
MGATEPGGDTSSVCVWTATLSVRVCDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHH

SEQ ID NO: 57934 - protein, 128 aa, Homo sapiens
  Payload ID: 11363
  Gene Symbol: NFIX
  Gene Name: nuclear factor I/X (CCAAT-binding transcription factor)
  ENSP ID: ENSP00000465616
MSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKEL

SEQ ID NO: 57935 - protein, 433 aa, Homo sapiens
  Payload ID: 11363
  Gene Symbol: NFIX
  Gene Name: nuclear factor I/X (CCAAT-binding transcription factor)
  Uniprot ID: Q14938
  ENSP ID: ENSP00000466389
MDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGPASLKKSGKLDFCSALSSQGSSPRMAFTHHPLPVLAGVRPGSPRATASALHFPSTSIIQQSSPYFTHPTIRYHHHHGQDSLKEFVQFVCSDGSGQATGQHSQRQAPPLPTGLSASDPGTATF

SEQ ID NO: 57936 - protein, 101 aa, Homo sapiens
  Payload ID: 11363
  Gene Symbol: NFIX
  Gene Name: nuclear factor I/X (CCAAT-binding transcription factor)
  ENSP ID: ENSP00000466605
MSKDEERAVKDELLGEKPEIKQKWASRLLAKLRKDIRPEFREDFVLTITGKKPPCCVLSNPDQKGKIRRIDCLRQADKNPDNQIVQTSKEMRTSNHCPTGT

SEQ ID NO: 57937 - protein, 455 aa, Homo sapiens
  Payload ID: 11363
  Gene Symbol: NFIX
  Gene Name: nuclear factor I/X (CCAAT-binding transcription factor)
  ENSP ID: ENSP00000466735
MSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGPASLKKSGKLDFCSALSSQGSSPRMAFTHHPLPVLAGVRPGSPRATASALHFPSTSIIQQSSPYFTHPTIRYHHHHGQDSLKEFVQFVCSDGSGQATGQPNGSGQGKVPGSFLLPPPPPVARPVPLPMPDSKSTSTAPDGAALTPPSPSFATTGASSANRFVSIGPRDGNFLNIPQQSQSWFL

SEQ ID NO: 57938 - protein, 502 aa, Homo sapiens
  Payload ID: 11363
  Gene Symbol: NFIX
  Gene Name: nuclear factor I/X (CCAAT-binding transcription factor)
  Uniprot ID: Q14938
  ENSP ID: ENSP00000467512
MYSPYCLTQDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGPASLKKSGKLDFCSALSSQGSSPRMAFTHHPLPVLAGVRPGSPRATASALHFPSTSIIQQSSPYFTHPTIRYHHHHGQDSLKEFVQFVCSDGSGQATGQPNGSGQGKVPGSFLLPPPPPVARPVPLPMPDSKSTSTAPDGAALTPPSPSFATTGASSANRFVSIGPRDGNFLNIPQQSQSWFL

SEQ ID NO: 57939 - protein, 59 aa, Homo sapiens
  Payload ID: 11363
  Gene Symbol: NFIX
  Gene Name: nuclear factor I/X (CCAAT-binding transcription factor)
  ENSP ID: ENSP00000467536
MGATEPGGDTSSVMSSTRSSRHCCLTSALSPTPGSTCRRGSASTSRSMKSGCRRTRSGR

SEQ ID NO: 57940 - protein, 440 aa, Homo sapiens
  Payload ID: 11363
  Gene Symbol: NFIX
  Gene Name: nuclear factor I/X (CCAAT-binding transcription factor)
  Uniprot ID: Q14938
  ENSP ID: ENSP00000467785
MLPACRLQDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGPASLKKSGKLDFCSALSSQGSSPRMAFTHHPLPVLAGVRPGSPRATASALHFPSTSIIQQSSPYFTHPTIRYHHHHGQDSLKEFVQFVCSDGSGQATGQHSQRQAPPLPTGLSASDPGTATF

SEQ ID NO: 57941 - protein, 125 aa, Homo sapiens
  Payload ID: 11363
  Gene Symbol: NFIX
  Gene Name: nuclear factor I/X (CCAAT-binding transcription factor)
  ENSP ID: ENSP00000468707
MSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTI

SEQ ID NO: 57942 - protein, 494 aa, Homo sapiens
  Payload ID: 11363
  Gene Symbol: NFIX
  Gene Name: nuclear factor I/X (CCAAT-binding transcription factor)
  Uniprot ID: Q14938
  ENSP ID: ENSP00000468794
MDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGPASLKKSGKLDFCSALSSQGSSPRMAFTHHPLPVLAGVRPGSPRATASALHFPSTSIIQQSSPYFTHPTIRYHHHHGQDSLKEFVQFVCSDGSGQATGQPNGSGQGKVPGSFLLPPPPPVARPVPLPMPDSKSTSTAPDGAALTPPSPSFATTGASSANRFVSIGPRDGNFLNIPQQSQSWFL

SEQ ID NO: 57943 - protein, 1455 aa, Homo sapiens
  Payload ID: 11364
  Gene Symbol: NFAT5
  Gene Name: nuclear factor of activated T-cells 5, tonicity-responsive
  Uniprot ID: O94916
  ENSP ID: ENSP00000338806
MGGACSSFTTSSSPTIYSTSVTDSKAMQVESCSSAVGVSNRGVSEKQLTSNTVQQHPSTPKRHTVLYISPPPEDLLDNSRMSCQDEGCGLESEQSCSMWMEDSPSNFSNMSTSSYNDNTEVPRKSRKRNPKQRPGVKRRDCEESNMDIFDADSAKAPHYVLSQLTTDNKGNSKAGNGTLENQKGTGVKKSPMLCGQYPVKSEGKELKIVVQPETQHRARYLTEGSRGSVKDRTQQGFPTVKLEGHNEPVVLQVFVGNDSGRVKPHGFYQACRVTGRNTTPCKEVDIEGTTVIEVGLDPSNNMTLAVDCVGILKLRNADVEARIGIAGSKKKSTRARLVFRVNIMRKDGSTLTLQTPSSPILCTQPAGVPEILKKSLHSCSVKGEEEVFLIGKNFLKGTKVIFQENVSDENSWKSEAEIDMELFHQNHLIVKVPPYHDQHITLPVSVGIYVVTNAGRSHDVQPFTYTPDPAAAGALNVNVKKEISSPARPCSFEEAMKAMKTTGCNLDKVNIIPNALMTPLIPSSMIKSEDVTPMEVTAEKRSSTIFKTTKSVGSTQQTLENISNIAGNGSFSSPSSSHLPSENEKQQQIQPKAYNPETLTTIQTQDISQPGTFPAVSASSQLPNSDALLQQATQFQTRETQSREILQSDGTVVNLSQLTEASQQQQQSPLQEQAQTLQQQISSNIFPSPNSVSQLQNTIQQLQAGSFTGSTASGSSGSVDLVQQVLEAQQQLSSVLFSAPDGNENVQEQLSADIFQQVSQIQSGVSPGMFSSTEPTVHTRPDNLLPGRAESVHPQSENTLSNQQQQQQQQQQVMESSAAMVMEMQQSICQAAAQIQSELFPSTASANGNLQQSPVYQQTSHMMSALSTNEDMQMQCELFSSPPAVSGNETSTTTTQQVATPGTTMFQTSSSGDGEETGTQAKQIQNSVFQTMVQMQHSGDNQPQVNLFSSTKSMMSVQNSGTQQQGNGLFQQGNEMMSLQSGNFLQQSSHSQAQLFHPQNPIADAQNLSQETQGSLFHSPNPIVHSQTSTTSSEQMQPPMFHSQSTIAVLQGSSVPQDQQSTNIFLSQSPMNNLQTNTVAQEAFFAAPNSISPLQSTSNSEQQAAFQQQAPISHIQTPMLSQEQAQPPQQGLFQPQVALGSLPPNPMPQSQQGTMFQSQHSIVAMQSNSPSQEQQQQQQQQQQQQQQQQQSILFSNQNTMATMASPKQPPPNMIFNPNQNPMANQEQQNQSIFHQQSNMAPMNQEQQPMQFQSQSTVSSLQNPGPTQSESSQTPLFHSSPQIQLVQGSPSSQEQQVTLFLSPASMSALQTSINQQDMQQSPLYSPQNNMPGIQGATSSPQPQATLFHNTAGGTMNQLQNSPGSSQQTSGMFLFGIQNNCSQLLTSGPATLPDQLMAISQPGQPQNEGQPPVTTLLSQQMPENSPLASSINTNQNIEKIDLLVSLQNQGNNLTGSF

SEQ ID NO: 57944 - protein, 1531 aa, Homo sapiens
  Payload ID: 11364
  Gene Symbol: NFAT5
  Gene Name: nuclear factor of activated T-cells 5, tonicity-responsive
  Uniprot ID: O94916
  ENSP ID: ENSP00000346420
MPSDFISLLSADLDLESPKSLYSRESVYDLLPKELQLPPSRETSVASMSQTSGGEAGSPPPAVVAADASSAPSSSSMGGACSSFTTSSSPTIYSTSVTDSKAMQVESCSSAVGVSNRGVSEKQLTSNTVQQHPSTPKRHTVLYISPPPEDLLDNSRMSCQDEGCGLESEQSCSMWMEDSPSNFSNMSTSSYNDNTEVPRKSRKRNPKQRPGVKRRDCEESNMDIFDADSAKAPHYVLSQLTTDNKGNSKAGNGTLENQKGTGVKKSPMLCGQYPVKSEGKELKIVVQPETQHRARYLTEGSRGSVKDRTQQGFPTVKLEGHNEPVVLQVFVGNDSGRVKPHGFYQACRVTGRNTTPCKEVDIEGTTVIEVGLDPSNNMTLAVDCVGILKLRNADVEARIGIAGSKKKSTRARLVFRVNIMRKDGSTLTLQTPSSPILCTQPAGVPEILKKSLHSCSVKGEEEVFLIGKNFLKGTKVIFQENVSDENSWKSEAEIDMELFHQNHLIVKVPPYHDQHITLPVSVGIYVVTNAGRSHDVQPFTYTPDPAAAGALNVNVKKEISSPARPCSFEEAMKAMKTTGCNLDKVNIIPNALMTPLIPSSMIKSEDVTPMEVTAEKRSSTIFKTTKSVGSTQQTLENISNIAGNGSFSSPSSSHLPSENEKQQQIQPKAYNPETLTTIQTQDISQPGTFPAVSASSQLPNSDALLQQATQFQTRETQSREILQSDGTVVNLSQLTEASQQQQQSPLQEQAQTLQQQISSNIFPSPNSVSQLQNTIQQLQAGSFTGSTASGSSGSVDLVQQVLEAQQQLSSVLFSAPDGNENVQEQLSADIFQQVSQIQSGVSPGMFSSTEPTVHTRPDNLLPGRAESVHPQSENTLSNQQQQQQQQQQVMESSAAMVMEMQQSICQAAAQIQSELFPSTASANGNLQQSPVYQQTSHMMSALSTNEDMQMQCELFSSPPAVSGNETSTTTTQQVATPGTTMFQTSSSGDGEETGTQAKQIQNSVFQTMVQMQHSGDNQPQVNLFSSTKSMMSVQNSGTQQQGNGLFQQGNEMMSLQSGNFLQQSSHSQAQLFHPQNPIADAQNLSQETQGSLFHSPNPIVHSQTSTTSSEQMQPPMFHSQSTIAVLQGSSVPQDQQSTNIFLSQSPMNNLQTNTVAQEAFFAAPNSISPLQSTSNSEQQAAFQQQAPISHIQTPMLSQEQAQPPQQGLFQPQVALGSLPPNPMPQSQQGTMFQSQHSIVAMQSNSPSQEQQQQQQQQQQQQQQQQQSILFSNQNTMATMASPKQPPPNMIFNPNQNPMANQEQQNQSIFHQQSNMAPMNQEQQPMQFQSQSTVSSLQNPGPTQSESSQTPLFHSSPQIQLVQGSPSSQEQQVTLFLSPASMSALQTSINQQDMQQSPLYSPQNNMPGIQGATSSPQPQATLFHNTAGGTMNQLQNSPGSSQQTSGMFLFGIQNNCSQLLTSGPATLPDQLMAISQPGQPQNEGQPPVTTLLSQQMPENSPLASSINTNQNIEKIDLLVSLQNQGNNLTGSF

SEQ ID NO: 57945 - protein, 1455 aa, Homo sapiens; identical to SEQ ID NO: 57943
  Payload ID: 11364
  Gene Symbol: NFAT5
  Gene Name: nuclear factor of activated T-cells 5, tonicity-responsive
  Uniprot ID: O94916
  ENSP ID: ENSP00000377343

SEQ ID NO: 57946 - protein, 99 aa, Homo sapiens
  Payload ID: 11364
  Gene Symbol: NFAT5
  Gene Name: nuclear factor of activated T-cells 5, tonicity-responsive
  ENSP ID: ENSP00000413126
MPSDFISLLSADLDLESPKSLYSRDSLKLHPSQNFHRAGLLEESVYDLLPKELQLPPSRETSVASMSQTSGGEAGSPPPAVVAAGFASEAGSVCIKNDL

SEQ ID NO: 57947 - protein, 119 aa, Homo sapiens
  Payload ID: 11364
  Gene Symbol: NFAT5
  Gene Name: nuclear factor of activated T-cells 5, tonicity-responsive
  ENSP ID: ENSP00000455115
MPSDFISLLSADLDLESPKSLYSRDSLKLHPSQNFHRAGLLEESVYDLLPKELQLPPSRETSVASMSQTSGGEAGSPPPAVVAAGIPEMFILCILMCMILRFKKGFASEAGSVCIKNDL

SEQ ID NO: 57948 - protein, 1455 aa, Homo sapiens; identical to SEQ ID NO: 57943
  Payload ID: 11364
  Gene Symbol: NFAT5
  Gene Name: nuclear factor of activated T-cells 5, tonicity-responsive
  Uniprot ID: O94916
  ENSP ID: ENSP00000455628

SEQ ID NO: 57949 - protein, 1548 aa, Homo sapiens
  Payload ID: 11364
  Gene Symbol: NFAT5
  Gene Name: nuclear factor of activated T-cells 5, tonicity-responsive
  Uniprot ID: O94916
  ENSP ID: ENSP00000457593
MPSDFISLLSADLDLESPKSLYSRDSLKLHPSQNFHRAGLLEESVYDLLPKELQLPPSRETSVASMSQTSGGEAGSPPPAVVAADASSAPSSSSMGGACSSFTTSSSPTIYSTSVTDSKAMQVESCSSAVGVSNRGVSEKQLTSNTVQQHPSTPKRHTVLYISPPPEDLLDNSRMSCQDEGCGLESEQSCSMWMEDSPSNFSNMSTSSYNDNTEVPRKSRKRNPKQRPGVKRRDCEESNMDIFDADSAKAPHYVLSQLTTDNKGNSKAGNGTLENQKGTGVKKSPMLCGQYPVKSEGKELKIVVQPETQHRARYLTEGSRGSVKDRTQQGFPTVKLEGHNEPVVLQVFVGNDSGRVKPHGFYQACRVTGRNTTPCKEVDIEGTTVIEVGLDPSNNMTLAVDCVGILKLRNADVEARIGIAGSKKKSTRARLVFRVNIMRKDGSTLTLQTPSSPILCTQPAGVPEILKKSLHSCSVKGEEEVFLIGKNFLKGTKVIFQENVSDENSWKSEAEIDMELFHQNHLIVKVPPYHDQHITLPVSVGIYVVTNAGRSHDVQPFTYTPDPAAGALNVNVKKEISSPARPCSFEEAMKAMKTTGCNLDKVNIIPNALMTPLIPSSMIKSEDVTPMEVTAEKRSSTIFKTTKSVGSTQQTLENISNIAGNGSFSSPSSSHLPSENEKQQQIQPKAYNPETLTTIQTQDISQPGTFPAVSASSQLPNSDALLQQATQFQTRETQSREILQSDGTVVNLSQLTEASQQQQQSPLQEQAQTLQQQISSNIFPSPNSVSQLQNTIQQLQAGSFTGSTASGSSGSVDLVQQVLEAQQQLSSVLFSAPDGNENVQEQLSADIFQQVSQIQSGVSPGMFSSTEPTVHTRPDNLLPGRAESVHPQSENTLSNQQQQQQQQQQVMESSAAMVMEMQQSICQAAAQIQSELFPSTASANGNLQQSPVYQQTSHMMSALSTNEDMQMQCELFSSPPAVSGNETSTTTTQQVATPGTTMFQTSSSGDGEETGTQAKQIQNSVFQTMVQMQHSGDNQPQVNLFSSTKSMMSVQNSGTQQQGNGLFQQGNEMMSLQSGNFLQQSSHSQAQLFHPQNPIADAQNLSQETQGSLFHSPNPIVHSQTSTTSSEQMQPPMFHSQSTIAVLQGSSVPQDQQSTNIFLSQSPMNNLQTNTVAQEAFFAAPNSISPLQSTSNSEQQAAFQQQAPISHIQTPMLSQEQAQPPQQGLFQPQVALGSLPPNPMPQSQQGTMFQSQHSIVAMQSNSPSQEQQQQQQQQQQQQQQQQQSILFSNQNTMATMASPKQPPPNMIFNPNQNPMANQEQQNQSIFHQQSNMAPMNQEQQPMQFQSQSTVSSLQNPGPTQSESSQTPLFHSSPQIQLVQGSPSSQEQQVTLFLSPASMSALQTSINQQDMQQSPLYSPQNNMPGIQGATSSPQPQATLFHNTAGGTMNQLQNSPGSSQQTSGMFLFGIQNNCSQLLTSGPATLPDQLMAISQPGQPQNEGQPPVTTLLSQQMPENSPLASSINTNQNIEKIDLLVSLQNQGNNLTGSF

SEQ ID NO: 57950 - protein, 143 aa, Homo sapiens
  Payload ID: 11364
  Gene Symbol: NFAT5
  Gene Name: nuclear factor of activated T-cells 5, tonicity-responsive
  ENSP ID: ENSP00000462061
  MOD_RES (1)..(1): Any amino acid
XTLENQKGTGVKKSPMLCGQYPVKSEGKELKIVVQPETQHRARYLTEGSRGSVKDRTQQGFPTVKLEGHNEPVVLQVFVGNDSGRVKPHGFYQACRVTGRNTTPCKEVDIEGTTVIEVGLDPSNNMTLASASRSARNLKEKLA

SEQ ID NO: 57951 - protein, 141 aa, Homo sapiens
  Payload ID: 11364
  Gene Symbol: NFAT5
  Gene Name: nuclear factor of activated T-cells 5, tonicity-responsive
  ENSP ID: ENSP00000463214
AMQVESCSSAVGNNMPGIQGATSSPQPQATLFHNTAGGTMNQLQNSPGSSQQTSGMFLFGIQNNCSQLLTSGPATLPDQLMAISQPGQPQNEGQPPVTTLLSQQMPENSPLASSINTNQNIEKIDLLVSLQNQGNNLTGSF

SEQ ID NO: 57952 - protein, 1549 aa, Homo sapiens
  Payload ID: 11364
  Gene Symbol: NFAT5
  Gene Name: nuclear factor of activated T-cells 5, tonicity-responsive
  Uniprot ID: O94916
  ENSP ID: ENSP00000486610
MPSDFISLLSADLDLESPKSLYSRDSLKLHPSQNFHRAGLLEESVYDLLPKELQLPPSRETSVASMSQTSGGEAGSPPPAVVAADASSAPSSSSMGGACSSFTTSSSPTIYSTSVTDSKAMQVESCSSAVGVSNRGVSEKQLTSNTVQQHPSTPKRHTVLYISPPPEDLLDNSRMSCQDEGCGLESEQSCSMWMEDSPSNFSNMSTSSYNDNTEVPRKSRKRNPKQRPGVKRRDCEESNMDIFDADSAKAPHYVLSQLTTDNKGNSKAGNGTLENQKGTGVKKSPMLCGQYPVKSEGKELKIVVQPETQHRARYLTEGSRGSVKDRTQQGFPTVKLEGHNEPVVLQVFVGNDSGRVKPHGFYQACRVTGRNTTPCKEVDIEGTTVIEVGLDPSNNMTLAVDCVGILKLRNADVEARIGIAGSKKKSTRARLVFRVNIMRKDGSTLTLQTPSSPILCTQPAGVPEILKKSLHSCSVKGEEEVFLIGKNFLKGTKVIFQENVSDENSWKSEAEIDMELFHQNHLIVKVPPYHDQHITLPVSVGIYVVTNAGRSHDVQPFTYTPDPAAAGALNVNVKKEISSPARPCSFEEAMKAMKTTGCNLDKVNIIPNALMTPLIPSSMIKSEDVTPMEVTAEKRSSTIFKTTKSVGSTQQTLENISNIAGNGSFSSPSSSHLPSENEKQQQIQPKAYNPETLTTIQTQDISQPGTFPAVSASSQLPNSDALLQQATQFQTRETQSREILQSDGTVVNLSQLTEASQQQQQSPLQEQAQTLQQQISSNIFPSPNSVSQLQNTIQQLQAGSFTGSTASGSSGSVDLVQQVLEAQQQLSSVLFSAPDGNENVQEQLSADIFQQVSQIQSGVSPGMFSSTEPTVHTRPDNLLPGRAESVHPQSENTLSNQQQQQQQQQQVMESSAAMVMEMQQSICQAAAQIQSELFPSTASANGNLQQSPVYQQTSHMMSALSTNEDMQMQCELFSSPPAVSGNETSTTTTQQVATPGTTMFQTSSSGDGEETGTQAKQIQNSVFQTMVQMQHSGDNQPQVNLFSSTKSMMSVQNSGTQQQGNGLFQQGNEMMSLQSGNFLQQSSHSQAQLFHPQNPIADAQNLSQETQGSLFHSPNPIVHSQTSTTSSEQMQPPMFHSQSTIAVLQGSSVPQDQQSTNIFLSQSPMNNLQTNTVAQEAFFAAPNSISPLQSTSNSEQQAAFQQQAPISHIQTPMLSQEQAQPPQQGLFQPQVALGSLPPNPMPQSQQGTMFQSQHSIVAMQSNSPSQEQQQQQQQQQQQQQQQQQSILFSNQNTMATMASPKQPPPNMIFNPNQNPMANQEQQNQSIFHQQSNMAPMNQEQQPMQFQSQSTVSSLQNPGPTQSESSQTPLFHSSPQIQLVQGSPSSQEQQVTLFLSPASMSALQTSINQQDMQQSPLYSPQNNMPGIQGATSSPQPQATLFHNTAGGTMNQLQNSPGSSQQTSGMFLFGIQNNCSQLLTSGPATLPDQLMAISQPGQPQNEGQPPVTTLLSQQMPENSPLASSINTNQNIEKIDLLVSLQNQGNNLTGSF

SEQ ID NO: 57953 - protein, 825 aa, Homo sapiens
  Payload ID: 11365
  Gene Symbol: NFATC1
  Gene Name: nuclear factor of activated T-cells, cytoplasmic, calcineurin-dependent 1
  Uniprot ID: O95644
  ENSP ID: ENSP00000253506
MPSTSFPVPSKFPLGPAAAVFGRGETLGPAPRAGGTMKSAEEEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQ

SEQ ID NO: 57954 - protein, 812 aa, Homo sapiens
  Payload ID: 11365
  Gene Symbol: NFATC1
  Gene Name: nuclear factor of activated T-cells, cytoplasmic, calcineurin-dependent 1
  Uniprot ID: O95644
  ENSP ID: ENSP00000316553
MTGLEDQEFDFEFLFEFNQRDEGAAAAAPEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQ

SEQ ID NO: 57955 - protein, 930 aa, Homo sapiens
  Payload ID: 11365
  Gene Symbol: NFATC1
  Gene Name: nuclear factor of activated T-cells, cytoplasmic, calcineurin-dependent 1
  Uniprot ID: O95644
  ENSP ID: ENSP00000327850
MTGLEDQEFDFEFLFEFNQRDEGAAAAAPEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQVSAPPSSSCPPGLEHSLCPSSPSPPLPPATQEPTCLQPCSPACPPATGRPQHLPSTVRRDESPTAGPRLLPEVHEDGSPNLAPIPVTVKREPEELDQLYLDDVNEIIRNDLSSTSTHS

SEQ ID NO: 57956 - protein, 353 aa, Homo sapiens
  Payload ID: 11365
  Gene Symbol: NFATC1
  Gene Name: nuclear factor of activated T-cells, cytoplasmic, calcineurin-dependent 1
  Uniprot ID: O95644
  ENSP ID: ENSP00000380892
MLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQ

SEQ ID NO: 57957 - protein, 943 aa, Homo sapiens
  Payload ID: 11365
  Gene Symbol: NFATC1
  Gene Name: nuclear factor of activated T-cells, cytoplasmic, calcineurin-dependent 1
  Uniprot ID: O95644
  ENSP ID: ENSP00000389377
MPSTSFPVPSKFPLGPAAAVFGRGETLGPAPRAGGTMKSAEEEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQVSAPPSSSCPPGLEHSLCPSSPSPPLPPATQEPTCLQPCSPACPPATGRPQHLPSTVRRDESPTAGPRLLPEVHEDGSPNLAPIPVTVKREPEELDQLYLDDVNEIIRNDLSSTSTHS

SEQ ID NO: 57958 - protein, 471 aa, Homo sapiens
  Payload ID: 11365
  Gene Symbol: NFATC1
  Gene Name: nuclear factor of activated T-cells, cytoplasmic, calcineurin-dependent 1
  ENSP ID: ENSP00000439992
MLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPRPYYSQQLAMPPDPSSCLVAGFPPCPQRSTLMPAAPGVSPKLHDLSPAAYTKGVASPGHCHLGLPQPAGEAPAVQDVPRPVATHPGSPGQPPPALLPQQVSAPPSSSCPPGLEHSLCPSSPSPPLPPATQEPTCLQPCSPACPPATGRPQHLPSTVRRDESPTAGPRLLPEVHEDGSPNLAPIPVTVKREPEELDQLYLDDVNEIIRNDLSSTSTHS

SEQ ID NO: 57959 - protein, 713 aa, Homo sapiens
  Payload ID: 11365
  Gene Symbol: NFATC1
  Gene Name: nuclear factor of activated T-cells, cytoplasmic, calcineurin-dependent 1
  Uniprot ID: O95644
  ENSP ID: ENSP00000442435
MPSTSFPVPSKFPLGPAAAVFGRGETLGPAPRAGGTMKSAEEEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVNEIIRNDLSSTSTHS

SEQ ID NO: 57960 - protein, 716 aa, Homo sapiens
  Payload ID: 11365
  Gene Symbol: NFATC1
  Gene Name: nuclear factor of activated T-cells, cytoplasmic, calcineurin-dependent 1
  Uniprot ID: O95644
  ENSP ID: ENSP00000466194
MPSTSFPVPSKFPLGPAAAVFGRGETLGPAPRAGGTMKSAEEEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANGNAIFLTVSREHERVGCFF

SEQ ID NO: 57961 - protein, 700 aa, Homo sapiens
  Payload ID: 11365
  Gene Symbol: NFATC1
  Gene Name: nuclear factor of activated T-cells, cytoplasmic, calcineurin-dependent 1
  Uniprot ID: O95644
  ENSP ID: ENSP00000466489
MTGLEDQEFDFEFLFEFNQRDEGAAAAAPEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVNEIIRNDLSSTSTHS

SEQ ID NO: 57962 - protein, 703 aa, Homo sapiens
  Payload ID: 11365
  Gene Symbol: NFATC1
  Gene Name: nuclear factor of activated T-cells, cytoplasmic, calcineurin-dependent 1
  Uniprot ID: O95644
  ENSP ID: ENSP00000467181
MTGLEDQEFDFEFLFEFNQRDEGAAAAAPEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANGNAIFLTVSREHERVGCFF

SEQ ID NO: 57963 - protein, 71 aa, Homo sapiens
  Payload ID: 11365
  Gene Symbol: NFATC1
  Gene Name: nuclear factor of activated T-cells, cytoplasmic, calcineurin-dependent 1
  ENSP ID: ENSP00000467615
MTGLEDQEFDFEFLFEFNQRDEGAAAAAPARPCPPWTGSCRPTQARMSFGLRCSPSPTTEPTTRRRAAGGP

SEQ ID NO: 57964 - protein, 639 aa, Homo sapiens
  Payload ID: 11365
  Gene Symbol: NFATC1
  Gene Name: nuclear factor of activated T-cells, cytoplasmic, calcineurin-dependent 1
  ENSP ID: ENSP00000468111
MPSTSFPVPSKFPLGPAAAVFGRGETLGPAPRAGGTMKSAEEEHYGYASSNVSPALPLPTAHSTLPAPCHNLQTSTPGIIPPADHPSGYGAALDGGPAGYFLSSGHTRPDGAPALESPRIEITSCLGLYHNNNQFFHDVEVEDVLPSSKRSPSTATLSLPSLEAYRDPSCLSPASSLSSRSCNSEASSYESNYSYPYASPQTSPWQSPCVSPKTTDPEEGFPRGLGACTLLGSPRHSPSTSPRASVTEESWLGARSSRPASPCNKRKYSLNGRQPPYSPHHSPTPSPHGSPRVSVTDDSWLGNTTQYTSSAIVAAINALTTDSSLDLGDGVPVKSRKTTLEQPPSVALKVEPVGEDLGSPPPPADFAPEDYSSFQHIRKGGFCDQYLAVPQHPYQWAKPKPLSPTSYMSPTLPALDWQLPSHSGPYELRIEVQPKSHHRAHYETEGSRGAVKASAGGHPIVQLHGYLENEPLMLQLFIGTADDRLLRPHAFYQVHRITGKTVSTTSHEAILSNTKVLEIPLLPENSMRAVIDCAGILKLRNSDIELRKGETDIGRKNTRPSAQLRSCLWWRSRARTAIRSWAGRRWSCLATTSCRTPRSFSWRKPQMATMSGRWKRKLTGTCASRILWWLRSRHFGIRG

SEQ ID NO: 57965 - protein, 921 aa, Homo sapiens
  Payload ID: 11366
  Gene Symbol: NFATC2
  Gene Name: nuclear factor of activated T-cells, cytoplasmic, calcineurin-dependent 2
  Uniprot ID: Q13469
  ENSP ID: ENSP00000360619
MNAPERQPQPDGGDAPGHEPGGSPQDELDFSILFDYEYLNPNEEEPNAHKVASPPSGPAYPDDVLDYGLKPYSPLASLSGEPPGRFGEPDRVGPQKFLSAAKPAGASGLSPRIEITPSHELIQAVGPLRMRDAGLLVEQPPLAGVAASPRFTLPVPGFEGYREPLCLSPASSGSSASFISDTFSPYTSPCVSPNNGGPDDLCPQFQNIPAHYSPRTSPIMSPRTSLAEDSCLGRHSPVPRPASRSSSPGAKRRHSCAEALVALPPGASPQRSRSPSPQPSSHVAPQDHGSPAGYPPVAGSAVIMDALNSLATDSPCGIPPKMWKTSPDPSPVSAAPSKAGLPRHIYPAVEFLGPCEQGERRNSAPESILLVPPTWPKPLVPAIPICSIPVTASLPPLEWPLSSQSGSYELRIEVQPKPHHRAHYETEGSRGAVKAPTGGHPVVQLHGYMENKPLGLQIFIGTADERILKPHAFYQVHRITGKTVTTTSYEKIVGNTKVLEIPLEPKNNMRATIDCAGILKLRNADIELRKGETDIGRKNTRVRLVFRVHIPESSGRIVSLQTASNPIECSQRSAHELPMVERQDTDSCLVYGGQQMILTGQNFTSESKVVFTEKTTDGQQIWEMEATVDKDKSQPNMLFVEIPEYRNKHIRTPVKVNFYVINGKRKRSQPQHFTYHPVPAIKTEPTDEYDPTLICSPTHGGLGSQPYYPQHPMVAESPSCLVATMAPCQQFRTGLSSPDARYQQQNPAAVLYQRSKSLSPSLLGYQQPALMAAPLSLADAHRSVLVHAGSQGQSSALLHPSPTNQQASPVIHYSPTNQQLRCGSHQEFQHIMYCENFAPGTTRPGPPPVSQGQRLSPGSYPTVIQQQNATSQRAAKNGPPVSDQKEVLPAGVTIKQEQNLDQTYLDDELIDTHLSWIQNIL

SEQ ID NO: 57966 - protein, 925 aa, Homo sapiens
  Payload ID: 11366
  Gene Symbol: NFATC2
  Gene Name: nuclear factor of activated T-cells, cytoplasmic, calcineurin-dependent 2
  Uniprot ID: Q13469
  ENSP ID: ENSP00000379330
MNAPERQPQPDGGDAPGHEPGGSPQDELDFSILFDYEYLNPNEEEPNAHKVASPPSGPAYPDDVLDYGLKPYSPLASLSGEPPGRFGEPDRVGPQKFLSAAKPAGASGLSPRIEITPSHELIQAVGPLRMRDAGLLVEQPPLAGVAASPRFTLPVPGFEGYREPLCLSPASSGSSASFISDTFSPYTSPCVSPNNGGPDDLCPQFQNIPAHYSPRTSPIMSPRTSLAEDSCLGRHSPVPRPASRSSSPGAKRRHSCAEALVALPPGASPQRSRSPSPQPSSHVAPQDHGSPAGYPPVAGSAVIMDALNSLATDSPCGIPPKMWKTSPDPSPVSAAPSKAGLPRHIYPAVEFLGPCEQGERRNSAPESILLVPPTWPKPLVPAIPICSIPVTASLPPLEWPLSSQSGSYELRIEVQPKPHHRAHYETEGSRGAVKAPTGGHPVVQLHGYMENKPLGLQIFIGTADERILKPHAFYQVHRITGKTVTTTSYEKIVGNTKVLEIPLEPKNNMRATIDCAGILKLRNADIELRKGETDIGRKNTRVRLVFRVHIPESSGRIVSLQTASNPIECSQRSAHELPMVERQDTDSCLVYGGQQMILTGQNFTSESKVVFTEKTTDGQQIWEMEATVDKDKSQPNMLFVEIPEYRNKHIRTPVKVNFYVINGKRKRSQPQHFTYHPVPAIKTEPTDEYDPTLICSPTHGGLGSQPYYPQHPMVAESPSCLVATMAPCQQFRTGLSSPDARYQQQNPAAVLYQRSKSLSPSLLGYQQPALMAAPLSLADAHRSVLVHAGSQGQSSALLHPSPTNQQASPVIHYSPTNQQLRCGSHQEFQHIMYCENFAPGTTRPGPPPVSQGQRLSPGSYPTVIQQQNATSQRAAKNGPPVSDQKEVLPAGVTIKQEQNLDQTYLDDVNEIIRKEFSGPPARNQT

SEQ ID NO: 57967 - protein, 901 aa, Homo sapiens
  Payload ID: 11366
  Gene Symbol: NFATC2
  Gene Name: nuclear factor of activated T-cells, cytoplasmic, calcineurin-dependent 2
  Uniprot ID: Q13469
  ENSP ID: ENSP00000396471
MQREAAFRLGHCHPLRIMGSVDQEEPNAHKVASPPSGPAYPDDVLDYGLKPYSPLASLSGEPPGRFGEPDRVGPQKFLSAAKPAGASGLSPRIEITPSHELIQAVGPLRMRDAGLLVEQPPLAGVAASPRFTLPVPGFEGYREPLCLSPASSGSSASFISDTFSPYTSPCVSPNNGGPDDLCPQFQNIPAHYSPRTSPIMSPRTSLAEDSCLGRHSPVPRPASRSSSPGAKRRHSCAEALVALPPGASPQRSRSPSPQPSSHVAPQDHGSPAGYPPVAGSAVIMDALNSLATDSPCGIPPKMWKTSPDPSPVSAAPSKAGLPRHIYPAVEFLGPCEQGERRNSAPESILLVPPTWPKPLVPAIPICSIPVTASLPPLEWPLSSQSGSYELRIEVQPKPHHRAHYETEGSRGAVKAPTGGHPVVQLHGYMENKPLGLQIFIGTADERILKPHAFYQVHRITGKTVTTTSYEKIVGNTKVLEIPLEPKNNMRATIDCAGILKLRNADIELRKGETDIGRKNTRVRLVFRVHIPESSGRIVSLQTASNPIECSQRSAHELPMVERQDTDSCLVYGGQQMILTGQNFTSESKVVFTEKTTDGQQIWEMEATVDKDKSQPNMLFVEIPEYRNKHIRTPVKVNFYVINGKRKRSQPQHFTYHPVPAIKTEPTDEYDPTLICSPTHGGLGSQPYYPQHPMVAESPSCLVATMAPCQQFRTGLSSPDARYQQQNPAAVLYQRSKSLSPSLLGYQQPALMAAPLSLADAHRSVLVHAGSQGQSSALLHPSPTNQQASPVIHYSPTNQQLRCGSHQEFQHIMYCENFAPGTTRPGPPPVSQGQRLSPGSYPTVIQQQNATSQRAAKNGPPVSDQKEVLPAGVTIKQEQNLDQTYLDDELIDTHLSWIQNIL

SEQ ID NO: 57968 - protein, 702 aa, Homo sapiens
  Payload ID: 11366
  Gene Symbol: NFATC2
  Gene Name: nuclear factor of activated T-cells, cytoplasmic, calcineurin-dependent 2
  Uniprot ID: Q13469
  ENSP ID: ENSP00000477142
MSPRTSLAEDSCLGRHSPVPRPASRSSSPGAKRRHSCAEALVALPPGASPQRSRSPSPQPSSHVAPQDHGSPAGYPPVAGSAVIMDALNSLATDSPCGIPPKMWKTSPDPSPVSAAPSKAGLPRHIYPAVEFLGPCEQGERRNSAPESILLVPPTWPKPLVPAIPICSIPVTASLPPLEWPLSSQSGSYELRIEVQPKPHHRAHYETEGSRGAVKAPTGGHPVVQLHGYMENKPLGLQIFIGTADERILKPHAFYQVHRITGKTVTTTSYEKIVGNTKVLEIPLEPKNNMRATIDCAGILKLRNADIELRKGETDIGRKNTRVRLVFRVHIPESSGRIVSLQTASNPIECSQRSAHELPMVERQDTDSCLVYGGQQMILTGQNFTSESKVVFTEKTTDGQQIWEMEATVDKDKSQPNMLFVEIPEYRNKHIRTPVKVNFYVINGKRKRSQPQHFTYHPVPAIKTEPTDEYDPTLICSPTHGGLGSQPYYPQHPMVAESPSCLVATMAPCQQFRTGLSSPDARYQQQNPAAVLYQRSKSLSPSLLGYQQPALMAAPLSLADAHRSVLVHAGSQGQSSALLHPSPTNQQASPVIHYSPTNQQLRCGSHQEFQHIMYCENFAPGTTRPGPPPVSQGQRLSPGSYPTVIQQQNATSQRAAKNGPPVSDQKEVLPAGVTIKQEQNLDQTYLDDELIDTHLSWIQNIL

SEQ ID NO: 57969 - protein, 702 aa, Homo sapiens; identical to SEQ ID NO: 57968
  Payload ID: 11366
  Gene Symbol: NFATC2
  Gene Name: nuclear factor of activated T-cells, cytoplasmic, calcineurin-dependent 2
  Uniprot ID: Q13469
  ENSP ID: ENSP00000477342

SEQ ID NO: 57970 - protein, 905 aa, Homo sapiens
  Payload ID: 11366
  Gene Symbol: NFATC2
  Gene Name: nuclear factor of activated T-cells, cytoplasmic, calcineurin-dependent 2
  Uniprot ID: Q13469
  ENSP ID: ENSP00000477370
MQREAAFRLGHCHPLRIMGSVDQEEPNAHKVASPPSGPAYPDDVLDYGLKPYSPLASLSGEPPGRFGEPDRVGPQKFLSAAKPAGASGLSPRIEITPSHELIQAVGPLRMRDAGLLVEQPPLAGVAASPRFTLPVPGFEGYREPLCLSPASSGSSASFISDTFSPYTSPCVSPNNGGPDDLCPQFQNIPAHYSPRTSPIMSPRTSLAEDSCLGRHSPVPRPASRSSSPGAKRRHSCAEALVALPPGASPQRSRSPSPQPSSHVAPQDHGSPAGYPPVAGSAVIMDALNSLATDSPCGIPPKMWKTSPDPSPVSAAPSKAGLPRHIYPAVEFLGPCEQGERRNSAPESILLVPPTWPKPLVPAIPICSIPVTASLPPLEWPLSSQSGSYELRIEVQPKPHHRAHYETEGSRGAVKAPTGGHPVVQLHGYMENKPLGLQIFIGTADERILKPHAFYQVHRITGKTVTTTSYEKIVGNTKVLEIPLEPKNNMRATIDCAGILKLRNADIELRKGETDIGRKNTRVRLVFRVHIPESSGRIVSLQTASNPIECSQRSAHELPMVERQDTDSCLVYGGQQMILTGQNFTSESKVVFTEKTTDGQQIWEMEATVDKDKSQPNMLFVEIPEYRNKHIRTPVKVNFYVINGKRKRSQPQHFTYHPVPAIKTEPTDEYDPTLICSPTHGGLGSQPYYPQHPMVAESPSCLVATMAPCQQFRTGLSSPDARYQQQNPAAVLYQRSKSLSPSLLGYQQPALMAAPLSLADAHRSVLVHAGSQGQSSALLHPSPTNQQASPVIHYSPTNQQLRCGSHQEFQHIMYCENFAPGTTRPGPPPVSQGQRLSPGSYPTVIQQQNATSQRAAKNGPPVSDQKEVLPAGVTIKQEQNLDQTYLDDVNEIIRKEFSGPPARNQT

SEQ ID NO: 57971 - protein, 419 aa, Homo sapiens
  Payload ID: 11367
  Gene Symbol: NFATC2IP
  Gene Name: nuclear factor of activated T-cells, cytoplasmic, calcineurin-dependent 2 interacting protein
  Uniprot ID: Q8NCF5
  ENSP ID: ENSP00000324792
MAEPVGKRGRWSGGSGAGRGGRGGWGGRGRRPRAQRSPSRGTLDVVSVDLVTDSDEEILEVATARGAADEVEVEPPEPPGPVASRDNSNSDSEGEDRRPAGPPREPVRRRRRLVLDPGEAPLVPVYSGKVKSSLRLIPDDLSLLKLYPPGDEEEAELADSSGLYHEGSPSPGSPWKTKLRTKDKEEKKKTEFLDLDNSPLSPPSPRTKSRTHTRALKKLSEVNKRLQDLRSCLSPKPPQGQEQQGQEDEVVLVEGPTLPETPRLFPLKIRCRADLVRLPLRMSEPLQSVVDHMATHLGVSPSRILLLFGETELSPTATPRTLKLGVADIIDCVVLTSSPEATETSQQLQLRVQGKEKHQTLEVSLSRDSPLKTLMSHYEEAMGLSGRKLSFFFDGTKLSGRELPADLGMESGDLIEVWG

SEQ ID NO: 57972 - protein, 127 aa, Homo sapiens
  Payload ID: 11367
  Gene Symbol: NFATC2IP
  Gene Name: nuclear factor of activated T-cells, cytoplasmic, calcineurin-dependent 2 interacting protein
  Uniprot ID: Q8NCF5
  ENSP ID: ENSP00000454958
MATHLGVSPSRILLLFGETELSPTATPRTLKLGVADIIDCVVLTSSPEATETSQQLQLRVQGKEKHQTLEVSLSRDSPLKTLMSHYEEAMGLSGRKLSFFFDGTKLSGRELPADLGMESGDLIEVWG

SEQ ID NO: 57973 - protein, 140 aa, Homo sapiens
  Payload ID: 11367
  Gene Symbol: NFATC2IP
  Gene Name: nuclear factor of activated T-cells, cytoplasmic, calcineurin-dependent 2 interacting protein
  ENSP ID: ENSP00000456948
MRKSEPLQSVVDHMATHLGVSPSRILLLFGETELSPTATPRTLKLGVADIIDCVVLTSSPEATETSQQLQLRVQGKEKHQTLEVSLSRDSPLKTLMSHYEEAMGLSGRKLSFFFDGTKLSGRELPADLGMESGDLIEVWG

SEQ ID NO: 57974 - protein, 1065 aa, Homo sapiens
  Payload ID: 11368
  Gene Symbol: NFATC3
  Gene Name: nuclear factor of activated T-cells, cytoplasmic, calcineurin-dependent 3
  Uniprot ID: Q12968
  ENSP ID: ENSP00000264008
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDDLFTSNNFDLLQLRPTFWPVPAGRYLRNLE

SEQ ID NO: 57975 - protein, 1075 aa, Homo sapiens
  Payload ID: 11368
  Gene Symbol: NFATC3
  Gene Name: nuclear factor of activated T-cells, cytoplasmic, calcineurin-dependent 3
  Uniprot ID: Q12968
  ENSP ID: ENSP00000300659
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDVNEIIGRDMSQISVSQGAGVSRQAPLPSPESLDLGRSDGL

SEQ ID NO: 57976 - protein, 1068 aa, Homo sapiens
  Payload ID: 11368
  Gene Symbol: NFATC3
  Gene Name: nuclear factor of activated T-cells, cytoplasmic, calcineurin-dependent 3
  Uniprot ID: Q12968
  ENSP ID: ENSP00000331324
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDDQFISDLEHQPSGSAEKWPNHSVLSCPAPFWRI

SEQ ID NO: 57977 - protein, 38 aa, Homo sapiens
  Payload ID: 11368
  Gene Symbol: NFATC3
  Gene Name: nuclear factor of activated T-cells, cytoplasmic, calcineurin-dependent 3
  ENSP ID: ENSP00000445670
MTTANCGAHDELDFKLVFGEDGAPAPPPPGSRPAAPGL

SEQ ID NO: 57978 - protein, 38 aa, Homo sapiens; identical to SEQ ID NO: 57977
  Payload ID: 11368
  Gene Symbol: NFATC3
  Gene Name: nuclear factor of activated T-cells, cytoplasmic, calcineurin-dependent 3
  ENSP ID: ENSP00000454451

SEQ ID NO: 57979 - protein, 38 aa, Homo sapiens; identical to SEQ ID NO: 57977
  Payload ID: 11368
  Gene Symbol: NFATC3
  Gene Name: nuclear factor of activated T-cells, cytoplasmic, calcineurin-dependent 3
  ENSP ID: ENSP00000455113

SEQ ID NO: 57980 - protein, 1053 aa, Homo sapiens
  Payload ID: 11368
  Gene Symbol: NFATC3
  Gene Name: nuclear factor of activated T-cells, cytoplasmic, calcineurin-dependent 3
  ENSP ID: ENSP00000456120
  MOD_RES (1)..(1): Any amino acid
XLDDRRPITLCVCVRARVCDLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDDQFISDLEHQPSGSAEKWPNHSVLSCPAPFWRI

SEQ ID NO: 57981 - protein, 41 aa, Homo sapiens
  Payload ID: 11368
  Gene Symbol: NFATC3
  Gene Name: nuclear factor of activated T-cells, cytoplasmic, calcineurin-dependent 3
  ENSP ID: ENSP00000456307
MTTANCGAHDELDFKLVFGEDGAPAPPPPGSRPAAHLHYLH

SEQ ID NO: 57982 - protein, 1060 aa, Homo sapiens
  Payload ID: 11368
  Gene Symbol: NFATC3
  Gene Name: nuclear factor of activated T-cells, cytoplasmic, calcineurin-dependent 3
  ENSP ID: ENSP00000456379
  MOD_RES (1)..(1): Any amino acid
XLDDRRPITLCVCVRARVCDLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDVNEIIGRDMSQISVSQGAGVSRQAPLPSPESLDLGRSDGL

SEQ ID NO: 57983 - protein, 167 aa, Homo sapiens
  Payload ID: 11368
  Gene Symbol: NFATC3
  Gene Name: nuclear factor of activated T-cells, cytoplasmic, calcineurin-dependent 3
  ENSP ID: ENSP00000457441
LKKDSCGDQFLSVPSPFTWSKPKPGHTPIFRTSSLPPLDWPLPAHFGQCELKIEVQPKTHHRAHYETEGSRGAVKASTGGHPVVKESKIRSSFDVVFDAQLLLSMGKKKVYGKHSRYLTTLTWKLLSIITTYNFLATSSHMALLTCRSTGKSSPWLGSLSSSKLCIL

SEQ ID NO: 57984 - protein, 1047 aa, Homo sapiens
  Payload ID: 11368
  Gene Symbol: NFATC3
  Gene Name: nuclear factor of activated T-cells, cytoplasmic, calcineurin-dependent 3
  ENSP ID: ENSP00000460533
MTTANCGAHDELDFKLVFGEDGAPAPPPPGSRPADLEPDDCASIYIFNVDPPPSTLTTPLCLPHHGLPSHSSVLSPSFQLQSHKNYEGTCEIPESKYSPLGGPKPFECPSIQITSISPNCHQELDAHEDDLQINDPEREFLERPSRDHLYLPLEPSYRESSLSPSPASSISSRSWFSDASSCESLSHIYDDVDSELNEAAARFTLGSPLTSPGGSPGGCPGEETWHQQYGLGHSLSPRQSPCHSPRSSVTDENWLSPRPASGPSSRPTSPCGKRRHSSAEVCYAGSLSPHHSPVPSPGHSPRGSVTEDTWLNASVHGGSGLGPAVFPFQYCVETDIPLKTRKTSEDQAAILPGKLELCSDDQGSLSPARETSIDDGLGSQYPLKKDSCGDQFLSVPSPFTWSKPKPGHTPIFRTSSLPPLDWPLPAHFGQCELKIEVQPKTHHRAHYETEGSRGAVKASTGGHPVVKLLGYNEKPINLQMFIGTADDRYLRPHAFYQVHRITGKTVATASQEIIIASTKVLEIPLLPENNMSASIDCAGILKLRNSDIELRKGETDIGRKNTRVRLVFRVHIPQPSGKVLSLQIASIPVECSQRSAQELPHIEKYSINSCSVNGGHEMVVTGSNFLPESKIIFLEKGQDGRPQWEVEGKIIREKCQGAHIVLEVPPYHNPAVTAAVQVHFYLCNGKRKKSQSQRFTYTPVLMKQEHREEIDLSSVPSLPVPHPAQTQRPSSDSGCSHDSVLSGQRSLICSIPQTYASMVTSSHLPQLQCRDESVSKEQHMIPSPIVHQPFQVTPTPPVGSSYQPMQTNVVYNGPTCLPINAASSQEFDSVLFQQDATLSGLVNLGCQPLSSIPFHSSNSGSTGHLLAHTPHSVHTLPHLQSMGYHCSNTGQRSLSSPVADQITGQPSSQLQPITYGPSHSGSATTASPAASHPLASSPLSGPPSPQLQPMPYQSPSSGTASSPSPATRMHSGQHSTQAQSTGQGGLSAPSSLICHSLCDPASFPPDGATVSIKPEPEDREPNFATIGLQDITLDDGFVKAEKPLSHD

SEQ ID NO: 57985 - protein, 902 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000250373
MGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 57986 - protein, 914 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000388668
MLSGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 57987 - protein, 964 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000388910
MITTLPSLLPASLASISHRVTNLPSNSLSHNPGLSKPDFPGNSSPGLPSSSSPGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 57988 - protein, 889 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000396788
MPASISSIFPGPTLLLSCGSEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 57989 - protein, 933 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000439350
MADGGADSAAQRLPEGPGRVAPGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 57990 - protein, 832 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000450469
MHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 57991 - protein, 901 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000450590
MGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 57992 - protein, 807 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000450644
MLSGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 57993 - protein, 890 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000450686
MPASISSIFPGPTLLLSCGSEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 57994 - protein, 724 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000450733
MHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 57995 - protein, 329 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000450810
MFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 57996 - protein, 794 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000451151
MGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 57997 - protein, 437 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000451183
MFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 57998 - protein, 915 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000451224
MLSGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 57999 - protein, 831 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000451284
MHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 58000 - protein, 436 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000451395
MFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 58001 - protein, 782 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000451454
MPASISSIFPGPTLLLSCGSEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 58002 - protein, 82 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000451496
MDFSPPRPPYPSYPHEDPACETPYLSEGFGYGMPPLYPQTGPPPSYRPGLRMFPETRGTTVSEIIGRDLSGFPAPPGEEPPA

SEQ ID NO: 58003 - protein, 826 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000451502
MADGGADSAAQRLPEGPGRVAPGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 58004 - protein, 190 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000451590
MDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 58005 - protein, 189 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000451801
MDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEGGCGTGGCECECVQEIALHVC

SEQ ID NO: 58006 - protein, 143 aa, Homo sapiens
  Payload ID: 11369
  Gene Symbol: NFATC4
  Gene Name: nuclear factor of activated T-cells, cytoplasmic, calcineurin-dependent 4
  ENSP ID: ENSP00000451853
MGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSP

SEQ ID NO: 58007 - protein, 139 aa, Homo sapiens
  Payload ID: 11369
  Gene Symbol: NFATC4
  Gene Name: nuclear factor of activated T-cells, cytoplasmic, calcineurin-dependent 4
  ENSP ID: ENSP00000451992
MGAASCEDEELEFKLVFGEEKEAPPLGAGGLGEELDSEDAPPCCRLALGEPPPYGAAPIGIPRPPPPRPGMHSPPPRPAPSPGTWESQPARTSALPPLDWPLPSQYEQLELRIEVQPRAHHRAHYETEGSRGAVKAAPG

SEQ ID NO: 58008 - protein, 857 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000452039
MITTLPSLLPASLASISHRVTNLPSNSLSHNPGLSKPDFPGNSSPGLPSSSSPGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTVSEIIGRDLSGFPAPPGEEPPA

SEQ ID NO: 58009 - protein, 934 aa, Homo sapiens
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000452270
MADGGADSAAQRLPEGPGRVAPGRDLGAPAGSMGAASCEDEELEFKLVFGEEKEAPPLGAGGLGEELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPRASPRPWTPEDPWSLYGPSPGGRGPEDSWLLLSAPGPTPASPRPASPCGKRRYSSSGTPSSASPALSRRGSLGEEGSEPPPPPPLPLARDPGSPGPFDYVGAPPAESIPQKTRRTSSEQAVALPRSEEPASCNGKLPLGAEESVAPPGGSRKEVAGMDYLAVPSPLAWSKARIGGHSPIFRTSALPPLDWPLPSQYEQLELRIEVQPRAHHRAHYETEGSRGAVKAAPGGHPVVKLLGYSEKPLTLQMFIGTADERNLRPHAFYQVHRITGKMVATASYEAVVSGTKVLEMTLLPENNMAANIDCAGILKLRNSDIELRKGETDIGRKNTRVRLVFRVHVPQGGGKVVSVQAASVPIECSQRSAQELPQVEAYSPSACSVRGGEELVLTGSNFLPDSKVVFIERGPDGKLQWEEEATVNRLQSNEVTLTLTVPEYSNKRVSRPVQVYFYVSNGRRKRSPTQSFRFLPVICKEEPLPDSSLRGFPSASATPFGTDMDFSPPRPPYPSYPHEDPACETPYLSEGFGYGMPPLYPQTGPPPSYRPGLRMFPETRGTTGCAQPPAVSFLPRPFPSDPYGGRGSSFSLGLPFSPPAPFRPPPLPASPPLEGPFPSQSDVHPLPAEGYNKVGPGYGPGEGAPEQEKSRGGYSSGFRDSVPIQGITLEEVSEIIGRDLSGFPAPPGEEPPA

SEQ ID NO: 58010 - protein, 832 aa, Homo sapiens; identical to SEQ ID NO: 57990
  Payload ID: 11369
  Gene Symbol: NFATC4
  Gene Name: nuclear factor of activated T-cells, cytoplasmic, calcineurin-dependent 4
  Uniprot ID: Q14934
  ENSP ID: ENSP00000452349

SEQ ID NO: 58011 - protein, 196 aa, Homo sapiens
  Payload ID: 11369
  Gene Symbol: NFATC4
  Gene Name: nuclear factor of activated T-cells, cytoplasmic, calcineurin-dependent 4
  ENSP ID: ENSP00000452352
MPASISSIFPELDSEDAPPCCRLALGEPPPYGAAPIGIPRPPPPRPGMHSPPPRPAPSPGTWESQPARSVRLGGPGGGAGGAGGGRVLECPSIRITSISPTPEPPAALEDNPDAWGDGSPRDYPPPEGFGGYREAGGQGGGAFFSPSPGSSSLSSWSFFSDASDEAALYAACDEVESELNEAASRFGLGSPLPSPR

SEQ ID NO: 58012 - protein, 969 aa, Homo sapiens
  Payload ID: 11370
  Gene Symbol: NFKB1
  Gene Name: nuclear factor of kappa light polypeptide gene enhancer in B-cells 1
  Uniprot ID: P19838
  ENSP ID: ENSP00000226574
MAEDDPYLGRPEQMFHLDPSLTHTIFNPEVFQPQMALPTADGPYLQILEQPKQRGFRFRYVCEGPSHGGLPGASSEKNKKSYPQVKICNYVGPAKVIVQLVTNGKNIHLHAHSLVGKHCEDGICTVTAGPKDMVVGFANLGILHVTKKKVFETLEARMTEACIRGYNPGLLVHPDLAYLQAEGGGDRQLGDREKELIRQAALQQTKEMDLSVVRLMFTAFLPDSTGSFTRRLEPVVSDAIYDSKAPNASNLKIVRMDRTAGCVTGGEEIYLLCDKVQKDDIQIRFYEEEENGGVWEGFGDFSPTDVHRQFAIVFKTPKYKDINITKPASVFVQLRRKSDLETSEPKPFLYYPEIKDKEEVQRKRQKLMPNFSDSFGGGSGAGAGGGGMFGSGGGGGGTGSTGPGYSFPHYGFPTYGGITFHPGTTKSNAGMKHGTMDTESKKDPEGCDKSDDKNTVNLFGKVIETTEQDQEPSEATVGNGEVTLTYATGTKEESAGVQDNLFLEKAMQLAKRHANALFDYAVTGDVKMLLAVQRHLTAVQDENGDSVLHLAIIHLHSQLVRDLLEVTSGLISDDIINMRNDLYQTPLHLAVITKQEDVVEDLLRAGADLSLLDRLGNSVLHLAAKEGHDKVLSILLKHKKAALLLDHPNGDGLNAIHLAMMSNSLPCLLLLVAAGADVNAQEQKSGRTALHLAVEHDNISLAGCLLLEGDAHVDSTTYDGTTPLHIAAGRGSTRLAALLKAAGADPLVENFEPLYDLDDSWENAGEDEGVVPGTTPLDMATSWQVFDILNGKPYEPEFTSDDLLAQGDMKQLAEDVKLQLYKLLEIPDPDKNWATLAQKLGLGILNNAFRLSPAPSKTLMDNYEVSGGTVRELVEALRQMGYTEAIEVIQAASSPVKTTSQAHSLPLSPASTRQQIDELRDSDSVCDSGVETSFRKLSFTESLTSGASLLTLNKMPHDYGQEGPLEGKI

SEQ ID NO: 58013 - protein, 968 aa, Homo sapiens
  Payload ID: 11370
  Gene Symbol: NFKB1
  Gene Name: nuclear factor of kappa light polypeptide gene enhancer in B-cells 1
  Uniprot ID: P19838
  ENSP ID: ENSP00000378297
MAEDDPYLGRPEQMFHLDPSLTHTIFNPEVFQPQMALPTDGPYLQILEQPKQRGFRFRYVCEGPSHGGLPGASSEKNKKSYPQVKICNYVGPAKVIVQLVTNGKNIHLHAHSLVGKHCEDGICTVTAGPKDMVVGFANLGILHVTKKKVFETLEARMTEACIRGYNPGLLVHPDLAYLQAEGGGDRQLGDREKELIRQAALQQTKEMDLSVVRLMFTAFLPDSTGSFTRRLEPVVSDAIYDSKAPNASNLKIVRMDRTAGCVTGGEEIYLLCDKVQKDDIQIRFYEEEENGGVWEGFGDFSPTDVHRQFAIVFKTPKYKDINITKPASVFVQLRRKSDLETSEPKPFLYYPEIKDKEEVQRKRQKLMPNFSDSFGGGSGAGAGGGGMFGSGGGGGGTGSTGPGYSFPHYGFPTYGGITFHPGTTKSNAGMKHGTMDTESKKDPEGCDKSDDKNTVNLFGKVIETTEQDQEPSEATVGNGEVTLTYATGTKEESAGVQDNLFLEKAMQLAKRHANALFDYAVTGDVKMLLAVQRHLTAVQDENGDSVLHLAIIHLHSQLVRDLLEVTSGLISDDIINMRNDLYQTPLHLAVITKQEDVVEDLLRAGADLSLLDRLGNSVLHLAAKEGHDKVLSILLKHKKAALLLDHPNGDGLNAIHLAMMSNSLPCLLLLVAAGADVNAQEQKSGRTALHLAVEHDNISLAGCLLLEGDAHVDSTTYDGTTPLHIAAGRGSTRLAALLKAAGADPLVENFEPLYDLDDSWENAGEDEGVVPGTTPLDMATSWQVFDILNGKPYEPEFTSDDLLAQGDMKQLAEDVKLQLYKLLEIPDPDKNWATLAQKLGLGILNNAFRLSPAPSKTLMDNYEVSGGTVRELVEALRQMGYTEAIEVIQAASSPVKTTSQAHSLPLSPASTRQQIDELRDSDSVCDSGVETSFRKLSFTESLTSGASLLTLNKMPHDYGQEGPLEGKI

SEQ ID NO: 58014 - protein, 74 aa, Homo sapiens
  Payload ID: 11370
  Gene Symbol: NFKB1
  Gene Name: nuclear factor of kappa light polypeptide gene enhancer in B-cells 1
  ENSP ID: ENSP00000420904
MKRTTSFRMAEDDPYLGRPEQMFHLDPSLTHTIFNPEVFQPQMALPTDGPYLQILEQPKQRGFRFRYVCEGPSH

SEQ ID NO: 58015 - protein, 144 aa, Homo sapiens
  Payload ID: 11370
  Gene Symbol: NFKB1
  Gene Name: nuclear factor of kappa light polypeptide gene enhancer in B-cells 1
  ENSP ID: ENSP00000423877
MAEDDPYLGRPEQMFHLDPSLTHTIFNPEVFQPQMALPTADGPYLQILEQPKQRGFRFRYVCEGPSHGGLPGASSEKNKKSYPQVKICNYVGPAKVIVQLVTNGKNIHLHAHSLVGKHCEDGICTVTAGPKDMVVGFANLGILH

SEQ ID NO: 58016 - protein, 968 aa, Homo sapiens; identical to SEQ ID NO: 58013
  Payload ID: 11370
  Gene Symbol: NFKB1
  Gene Name: nuclear factor of kappa light polypeptide gene enhancer in B-cells 1
  Uniprot ID: P19838
  ENSP ID: ENSP00000424790

SEQ ID NO: 58017 - protein, 196 aa, Homo sapiens
  Payload ID: 11370
  Gene Symbol: NFKB1
  Gene Name: nuclear factor of kappa light polypeptide gene enhancer in B-cells 1
  ENSP ID: ENSP00000424815
MDLSVVRLMFTAFLPDSTGSFTRRLEPVVSDAIYDSKAPNASNLKIVRMDRTAGCVTGGEEIYLLCDKVQKDDIQIRFYEEEENGGVWEGFGDFSPTDVHRQFAIVFKTPKYKDINITKPASVFVQLRRKSDLETSEPKPFLYYPEIKDKEEVQRKRQKLMPNFSDSFGGGSGAGAGGGGMFGSGGGGGGTGSTGP

SEQ ID NO: 58018 - protein, 198 aa, Homo sapiens
  Payload ID: 11370
  Gene Symbol: NFKB1
  Gene Name: nuclear factor of kappa light polypeptide gene enhancer in B-cells 1
  ENSP ID: ENSP00000426147
MKRTTSFRMAEDDPYLGRPEQMFHLDPSLTHTIFNPEVFQPQMALPTADGPYLQILEQPKQRGFRFRYVCEGPSHGGLPGASSEKNKKSYPQVKICNYVGPAKVIVQLVTNGKNIHLHAHSLVGKHCEDGICTVTAGPKDMVVGFANLGILHVTKKKVFETLEARMTEACIRGYNPGLLVHPDLAYLQAEGGGDRQLG

SEQ ID NO: 58019 - protein, 788 aa, Homo sapiens
  Payload ID: 11370
  Gene Symbol: NFKB1
  Gene Name: nuclear factor of kappa light polypeptide gene enhancer in B-cells 1
  Uniprot ID: P19838
  ENSP ID: ENSP00000469340
MNGLCCMALDREKELIRQAALQQTKEMDLSVVRLMFTAFLPDSTGSFTRRLEPVVSDAIYDSKAPNASNLKIVRMDRTAGCVTGGEEIYLLCDKVQKDDIQIRFYEEEENGGVWEGFGDFSPTDVHRQFAIVFKTPKYKDINITKPASVFVQLRRKSDLETSEPKPFLYYPEIKDKEEVQRKRQKLMPNFSDSFGGGSGAGAGGGGMFGSGGGGGGTGSTGPGYSFPHYGFPTYGGITFHPGTTKSNAGMKHGTMDTESKKDPEGCDKSDDKNTVNLFGKVIETTEQDQEPSEATVGNGEVTLTYATGTKEESAGVQDNLFLEKAMQLAKRHANALFDYAVTGDVKMLLAVQRHLTAVQDENGDSVLHLAIIHLHSQLVRDLLEVTSGLISDDIINMRNDLYQTPLHLAVITKQEDVVEDLLRAGADLSLLDRLGNSVLHLAAKEGHDKVLSILLKHKKAALLLDHPNGDGLNAIHLAMMSNSLPCLLLLVAAGADVNAQEQKSGRTALHLAVEHDNISLAGCLLLEGDAHVDSTTYDGTTPLHIAAGRGSTRLAALLKAAGADPLVENFEPLYDLDDSWENAGEDEGVVPGTTPLDMATSWQVFDILNGKPYEPEFTSDDLLAQGDMKQLAEDVKLQLYKLLEIPDPDKNWATLAQKLGLGILNNAFRLSPAPSKTLMDNYEVSGGTVRELVEALRQMGYTEAIEVIQAASSPVKTTSQAHSLPLSPASTRQQIDELRDSDSVCDSGVETSFRKLSFTESLTSGASLLTLNKMPHDYGQEGPLEGKI

SEQ ID NO: 58020 - protein, 899 aa, Homo sapiens
  Payload ID: 11371
  Gene Symbol: NFKB2
  Gene Name: nuclear factor of kappa light polypeptide gene enhancer in B-cells 2 (p49/p100)
  Uniprot ID: Q00653
  ENSP ID: ENSP00000189444
MESCYNPGLDGIIEYDDFKLNSSIVEPKEPAPETADGPYLVIVEQPKQRGFRFRYGCEGPSHGGLPGASSEKGRKTYPTVKICNYEGPAKIEVDLVTHSDPPRAHAHSLVGKQCSELGICAVSVGPKDMTAQFNNLGVLHVTKKNMMGTMIQKLQRQRLRSRPQGLTEAEQRELEQEAKELKKVMDLSIVRLRFSAFLRASDGSFSLPLKPVISQPIHDSKSPGASNLKISRMDKTAGSVRGGDEVYLLCDKVQKDDIEVRFYEDDENGWQAFGDFSPTDVHKQYAIVFRTPPYHKMKIERPVTVFLQLKRKRGGDVSDSKQFTYYPLVEDKEEVQRKRRKALPTFSQPFGGGSHMGGGSGGAAGGYGGAGGGGSLGFFPSSLAYSPYQSGAGPMGCYPGGGGGAQMAATVPSRDSGEEAAEPSAPSRTPQCEPQAPEMLQRAREYNARLFGLAQRSARALLDYGVTADARALLAGQRHLLTAQDENGDTPLHLAIIHGQTSVIEQIVYVIHHAQDLGVVNLTNHLHQTPLHLAVITGQTSVVSFLLRVGADPALLDRHGDSAMHLALRAGAGAPELLRALLQSGAPAVPQLLHMPDFEGLYPVHLAVRARSPECLDLLVDSGAEVEATERQGGRTALHLATEMEELGLVTHLVTKLRANVNARTFAGNTPLHLAAGLGYPTLTRLLLKAGADIHAENEEPLCPLPSPPTSDSDSDSEGPEKDTRSSFRGHTPLDLTCSTKVKTLLLNAAQNTMEPPLTPPSPAGPGLSLGDTALQNLEQLLDGPEAQGSWAELAERLGLRSLVDTYRQTTSPSGSLLRSYELAGGDLAGLLEALSDMGLEEGVRLLRGPETRDKLPSTEVKEDSAYGSQSVEQEAEKLGPPPEPPGGLCHGHPQPQVH

SEQ ID NO: 58021 - protein, 900 aa, Homo sapiens
  Payload ID: 11371
  Gene Symbol: NFKB2
  Gene Name: nuclear factor of kappa light polypeptide gene enhancer in B-cells 2 (p49/p100)
  Uniprot ID: Q00653
  ENSP ID: ENSP00000358983
MESCYNPGLDGIIEYDDFKLNSSIVEPKEPAPETADGPYLVIVEQPKQRGFRFRYGCEGPSHGGLPGASSEKGRKTYPTVKICNYEGPAKIEVDLVTHSDPPRAHAHSLVGKQCSELGICAVSVGPKDMTAQFNNLGVLHVTKKNMMGTMIQKLQRQRLRSRPQGLTEAEQRELEQEAKELKKVMDLSIVRLRFSAFLRASDGSFSLPLKPVISQPIHDSKSPGASNLKISRMDKTAGSVRGGDEVYLLCDKVQKDDIEVRFYEDDENGWQAFGDFSPTDVHKQYAIVFRTPPYHKMKIERPVTVFLQLKRKRGGDVSDSKQFTYYPLVEDKEEVQRKRRKALPTFSQPFGGGSHMGGGSGGAAGGYGGAGGGGSLGFFPSSLAYSPYQSGAGPMGCYPGGGGGAQMAATVPSRDSGEEAAEPSAPSRTPQCEPQAPEMLQRAREYNARLFGLAQRSARALLDYGVTADARALLAGQRHLLTAQDENGDTPLHLAIIHGQTSVIEQIVYVIHHAQDLGVVNLTNHLHQTPLHLAVITGQTSVVSFLLRVGADPALLDRHGDSAMHLALRAGAGAPELLRALLQSGAPAVPQLLHMPDFEGLYPVHLAVRARSPECLDLLVDSGAEVEATERQGGRTALHLATEMEELGLVTHLVTKLRANVNARTFAGNTPLHLAAGLGYPTLTRLLLKAGADIHAENEEPLCPLPSPPTSDSDSDSEGPEKDTRSSFRGHTPLDLTCSTKVKTLLLNAAQNTMEPPLTPPSPAGPGLSLGDTALQNLEQLLDGPEAQGSWAELAERLGLRSLVDTYRQTTSPSGSLLRSYELAGGDLAGLLEALSDMGLEEGVRLLRGPETRDKLPSTAEVKEDSAYGSQSVEQEAEKLGPPPEPPGGLCHGHPQPQVH

SEQ ID NO: 58022 - protein, 899 aa, Homo sapiens; identical to SEQ ID NO: 58020
  Payload ID: 11371
  Gene Symbol: NFKB2
  Gene Name: nuclear factor of kappa light polypeptide gene enhancer in B-cells 2 (p49/p100)
  Uniprot ID: Q00653
  ENSP ID: ENSP00000410256

SEQ ID NO: 58023 - protein, 22 aa, Homo sapiens
  Payload ID: 11371
  Gene Symbol: NFKB2
  Gene Name: nuclear factor of kappa light polypeptide gene enhancer in B-cells 2 (p49/p100)
  ENSP ID: ENSP00000470826
MESCYNPGLDGIIEYDDFKLNS

SEQ ID NO: 58024 - protein, 68 aa, Homo sapiens
  Payload ID: 11371
  Gene Symbol: NFKB2
  Gene Name: nuclear factor of kappa light polypeptide gene enhancer in B-cells 2 (p49/p100)
  ENSP ID: ENSP00000471586
MESCYNPGLDGIIEYDDFKLNSSIVEPKEPAPETADGPYLVIVEQPKQRGFRFRYGCEGPSHGGLPGA

SEQ ID NO: 58025 - protein, 415 aa, Homo sapiens
  Payload ID: 11371
  Gene Symbol: NFKB2
  Gene Name: nuclear factor of kappa light polypeptide gene enhancer in B-cells 2 (p49/p100)
  ENSP ID: ENSP00000480211
MESCYNPGLDGIIEYDDFKLNSSIVEPKEPAPETADGPYLVIVEQPKQRGFRFRYGCEGPSHGGLPGASSEKGRKTYPTVKICNYEGPAKIEVDLVTHSDPPRAHAHSLVGKQCSELGICAVSVGPKDMTAQFNNLGVLHVTKKNMMGTMIQKLQRQRLRSRPQGLTEAEQRELEQEAKELKKVMDLSIVRLRFSAFLRASDGSFSLPLKPVISQPIHDSKSPGASNLKISRMDKTAGSVRGGDEVYLLCDKVQKDDIEVRFYEDDENGWQAFGDFSPTDVHKQYAIVFRTPPYHKMKIERPVTVFLQLKRKRGGDVSDSKQFTYYPLVEDKEEVQRKRRKALPTFSQPFGGGSHMGGGSGGAAGGYGGAGGGEGVLMEGGVKVREAVEEKNLGRPGVVAHACNPAFGRPRQAIT

SEQ ID NO: 58026 - protein, 317 aa, Homo sapiens
  Payload ID: 11372
  Gene Symbol: NFKBIA
  Gene Name: nuclear factor of kappa light polypeptide gene enhancer in B-cells inhibitor, alpha
  Uniprot ID: P25963
  ENSP ID: ENSP00000216797
MFQAAERPQEWAMEGPRDGLKKERLLDDRHDSGLDSMKDEEYEQMVKELQEIRLEPQEVPRGSEPWKQQLTEDGDSFLHLAIIHEEKALTMEVIRQVKGDLAFLNFQNNLQQTPLHLAVITNQPEIAEALLGAGCDPELRDFRGNTPLHLACEQGCLASVGVLTQSCTTPHLHSILKATNYNGHTCLHLASIHGYLGIVELLVSLGADVNAQEPCNGRTALHLAVDLQNPDLVSLLLKCGADVNRVTYQGYSPYQLTWGRPSTRIQQQLGQLTLENLQMLPESEDEESYDTESEFTEFTEDELPYDDCVFGGQRLTL

SEQ ID NO: 58027 - protein, 227 aa, Homo sapiens
  Payload ID: 11372
  Gene Symbol: NFKBIA
  Gene Name: nuclear factor of kappa light polypeptide gene enhancer in B-cells inhibitor, alpha
  ENSP ID: ENSP00000450514
MEVIRQVKGDLAFLNFQNNLQQTPLHLAVITNQPEIAEALLGAGCDPELRDFRGNTPLHLACEQGCLASVGVLTQSCTTPHLHSILKATNYNGHTCLHLASIHGYLGIVELLVSLGADVNAQEPCNGRTALHLAVDLQNPDLVSLLLKCGADVNRVTYQGYSPYQLTWGRPSTRIQQQLGQLTLENLQMLPESEDEESYDTESEFTEFTEDELPYDDCVFGGQRLTL

SEQ ID NO: 58028 - protein, 82 aa, Homo sapiens
  Payload ID: 11372
  Gene Symbol: NFKBIA
  Gene Name: nuclear factor of kappa light polypeptide gene enhancer in B-cells inhibitor, alpha
  ENSP ID: ENSP00000450537
MFQAAERPQEWAMEGPRDGLKKERLLDDRHDSGLDSMKDEEYEQMVKELQEIRLEPQEVPRGSEPWKQQLTEDGDSLHSTWL

SEQ ID NO: 58029 - protein, 274 aa, Homo sapiens
  Payload ID: 11372
  Gene Symbol: NFKBIA
  Gene Name: nuclear factor of kappa light polypeptide gene enhancer in B-cells inhibitor, alpha
  ENSP ID: ENSP00000451257
MFQAAERPQEWAMEGPRDGLKKERLLDDRHDSGLDSMKDEEYEQMVKELQEIRLEPQEVPRGSEPWKQQLTEDGDSFLHLAIIHEEKALTMEVIRQVKGDLAFLNFQNNLQQTPLHLAVITNQPEIAEALLGAGCDPELRDFRGNTPLHLACEQGCLASVGVLTQSCTTPHLHSILKATNYNGHTCLHLASIHGYLGIVELLVSLGADVNAQLTWGRPSTRIQQQLGQLTLENLQMLPESEDEESYDTESEFTEFTEDELPYDDCVFGGQRLTL

SEQ ID NO: 58030 - protein, 68 aa, Homo sapiens
  Payload ID: 11372
  Gene Symbol: NFKBIA
  Gene Name: nuclear factor of kappa light polypeptide gene enhancer in B-cells inhibitor, alpha
  ENSP ID: ENSP00000451281
MFQAAERPQEWAMEGPRDGLKKERLLDDRHDSGLDSMKDEEYEQMLTEDGDSFLHLAIIHEEKALTME

SEQ ID NO: 58031 - protein, 356 aa, Homo sapiens
  Payload ID: 11373
  Gene Symbol: NFKBIB
  Gene Name: nuclear factor of kappa light polypeptide gene enhancer in B-cells inhibitor, beta
  Uniprot ID: Q15653
  ENSP ID: ENSP00000312988
MAGVACLGKAADADEWCDSGLGSLGPDAAAPGGPGLGAELGPGLSWAPLVFGYVTEDGDTALHLAVIHQHEPFLDFLLGFSAGTEYMDLQNDLGQTALHLAAILGETSTVEKLYAAGAGLCVAERRGHTALHLACRVGAHACARALLQPRPRRPREAPDTYLAQGPDRTPDTNHTPVALYPDSDLEKEEEESEEDWKLQLEAENYEGHTPLHVAVIHKDVEMVRLLRDAGADLDKPEPTCGRSPLHLAVEAQAADVLELLLRAGANPAARMYGGRTPLGSAMLRPNPILARLLRAHGAPEPEGEDEKSGPCSSSSDSDSGDEGDEYDDIVVHSSRSQTRLPPTPASKPLPDDPRPV

SEQ ID NO: 58032 - protein, 270 aa, Homo sapiens
  Payload ID: 11373
  Gene Symbol: NFKBIB
  Gene Name: nuclear factor of kappa light polypeptide gene enhancer in B-cells inhibitor, beta
  ENSP ID: ENSP00000375929
MDLQNDLGQTALHLAAILGETSTVEKLYAAGAGLCVAERRGHTALHLACRVGAHACARALLQPRPRRPREAPDTYLAQGPDRTPDTNHTPVALYPDSDLEKEEEESEEDWKLQLEAENYEGHTPLHVAVIHKDVEMVRLLRDAGADLDKPEPTCGRSPLHLAVEAQAADVLELLLRAGANPAARMYGGRTPLGSAMLRPNPILARLLRAHGAPEPEGEDEKSGPCSSSSDSDSGDEGDEYDDIVVHSSRSQTRLPPTPASKPLPDDPRPV

SEQ ID NO: 58033 - protein, 65 aa, Homo sapiens
  Payload ID: 11373
  Gene Symbol: NFKBIB
  Gene Name: nuclear factor of kappa light polypeptide gene enhancer in B-cells inhibitor, beta
  ENSP ID: ENSP00000438598
MAGVACLGKAADADEWCDSGLGSLGPDAAAPGGPGLGAELGPGLSWAPLVFGYVTEDGDTLLGRH

SEQ ID NO: 58034 - protein, 149 aa, Homo sapiens
  Payload ID: 11373
  Gene Symbol: NFKBIB
  Gene Name: nuclear factor of kappa light polypeptide gene enhancer in B-cells inhibitor, beta
  ENSP ID: ENSP00000458685
MNGFSAGTEYMDLQNDLGQTALHLAAILGETSTVEKLYAAGAGLCVAERRGHTALHLACRVGAHACARALLQPRPRRPREAPDTYLAQGPDRTPDTNHTPVALYPDSDLEKEEEESEEDWKLQLEAENYEGHTPLHVAVIHKDVEMVRL

SEQ ID NO: 58035 - protein, 338 aa, Homo sapiens
  Payload ID: 11373
  Gene Symbol: NFKBIB
  Gene Name: nuclear factor of kappa light polypeptide gene enhancer in B-cells inhibitor, beta
  Uniprot ID: Q15653
  ENSP ID: ENSP00000459728
MAGVACLGKAADADEWCDSGLGSLGPDAAAPGGPGLGAELGPGLSWAPLVFGYVTEDGDTALHLAVIHQHEPFLDFLLGFSAGTEYMDLQNDLGQTALHLAAILGETSTVEKLYAAGAGLCVAERRGHTALHLACRVGAHACARALLQPRPRRPREAPDTYLAQGPDRTPDTNHTPVALYPDSDLEKEEEESEEDWKLQLEAENYEGHTPLHVAVIHKDVEMVRLLRDAGADLDKPEPTCGRSPLHLAVEAQAADVLELLLRAGANPAARMYGGRTPLGSAMLRPNPILARLLRAHGAPEPEGEDEKSGPCSSSSDSDSGDEGVSQEERQGSPAGGSG

SEQ ID NO: 58036 - protein, 233 aa, Homo sapiens
  Payload ID: 11373
  Gene Symbol: NFKBIB
  Gene Name: nuclear factor of kappa light polypeptide gene enhancer in B-cells inhibitor, beta
  ENSP ID: ENSP00000461617
MDLQNDLGQTALHLAAILGETSTVEKLYAAGAGLCVAERRGHTALHLACRVGAHACARALLQPRPRRPREAPDTYLAQGPDRTPDTNHTPVALYPDSDLEKEEEESEEDWKLQLEAENYEGHTPLHVAVIHKDVEMVRLLRDAGADLDKPEPTCGRSPLHLAVEAQAADVLELLLRAGANPAARMYGGRTPLGSAMLRPNPILARLLRAHGAPEPEGEDEKSGPCSSSSDSDS

SEQ ID NO: 58037 - protein, 149 aa, Homo sapiens; identical to SEQ ID NO: 58034
  Payload ID: 11373
  Gene Symbol: NFKBIB
  Gene Name: Nuclear factor of kappa light polypeptide gene enhancer in B-cells inhibitor, beta
  ENSP ID: ENSP00000489042

SEQ ID NO: 58038 - protein, 65 aa, Homo sapiens; identical to SEQ ID NO: 58033
  Payload ID: 11373
  Gene Symbol: NFKBIB
  Gene Name: Nuclear factor of kappa light polypeptide gene enhancer in B-cells inhibitor, beta
  ENSP ID: ENSP00000489085

SEQ ID NO: 58039 - protein, 356 aa, Homo sapiens; identical to SEQ ID NO: 58031
  Payload ID: 11373
  Gene Symbol: NFKBIB
  Gene Name: Nuclear factor of kappa light polypeptide gene enhancer in B-cells inhibitor, beta
  ENSP ID: ENSP00000489138

SEQ ID NO: 58040 - protein, 338 aa, Homo sapiens; identical to SEQ ID NO: 58035
  Payload ID: 11373
  Gene Symbol: NFKBIB
  Gene Name: Nuclear factor of kappa light polypeptide gene enhancer in B-cells inhibitor, beta
  ENSP ID: ENSP00000489145

SEQ ID NO: 58041 - protein, 270 aa, Homo sapiens; identical to SEQ ID NO: 58032
  Payload ID: 11373
  Gene Symbol: NFKBIB
  Gene Name: Nuclear factor of kappa light polypeptide gene enhancer in B-cells inhibitor, beta
  ENSP ID: ENSP00000489191

SEQ ID NO: 58042 - protein, 233 aa, Homo sapiens; identical to SEQ ID NO: 58036
  Payload ID: 11373
  Gene Symbol: NFKBIB
  Gene Name: Nuclear factor of kappa light polypeptide gene enhancer in B-cells inhibitor, beta
  ENSP ID: ENSP00000489318

SEQ ID NO: 58043 - protein, 313 aa, Homo sapiens
  Payload ID: 11374
  Gene Symbol: NFKBID
  Gene Name: nuclear factor of kappa light polypeptide gene enhancer in B-cells inhibitor, delta
  Uniprot ID: Q8NI38
  ENSP ID: ENSP00000380109
MEAGPWRVSAPPSGPPQFPAVVPGPSLEVARAHMLALGPQQLLAQDEEGDTLLHLFAARGLRWAAYAAAEVLQVYRRLDIREHKGKTPLLVAAAANQPLIVEDLLNLGAEPNAADHQGRSVLHVAATYGLPGVLLAVLNSGVQVDLEARDFEGLTPLHTAILALNVAMRPSDLCPRVLSTQARDRLDCVHMLLQMGANHTSQEIKSNKTVLHLAVQAANPTLVQLLLELPRGDLRTFVNMKAHGNTALHMAAALPPGPAQEAIVRHLLAAGADPTLRNLENEQPVHLLRPGPGPEGLRQLLKRSRVAPPGLSS

SEQ ID NO: 58044 - protein, 150 aa, Homo sapiens
  Payload ID: 11374
  Gene Symbol: NFKBID
  Gene Name: nuclear factor of kappa light polypeptide gene enhancer in B-cells inhibitor, delta
  ENSP ID: ENSP00000465684
MEDPPDTQFYVGSSLPQAGPWRVSAPPSGPPQFPAVVPGPSLEVARAHMLALGPQQLLAQDEEGDTLLHLFAARGLRWAAYAAAEVLQVYRRLDIREHKGKTPLLVAAAANQPLIVEDLLNLGAEPNAADHQGRSVLHVAATYGLPGVLL

SEQ ID NO: 58045 - protein, 65 aa, Homo sapiens
  Payload ID: 11374
  Gene Symbol: NFKBID
  Gene Name: nuclear factor of kappa light polypeptide gene enhancer in B-cells inhibitor, delta
  ENSP ID: ENSP00000467127
  MOD_RES (1)..(1): Any amino acid
XSGVQVDLEARDFEGLTPLHTAILALNVAMRPSDLCPRVLSTQARDRLDCVHMLLQMGANHTSQR

SEQ ID NO: 58046 - protein, 313 aa, Homo sapiens; identical to SEQ ID NO: 58043
  Payload ID: 11374
  Gene Symbol: NFKBID
  Gene Name: nuclear factor of kappa light polypeptide gene enhancer in B-cells inhibitor, delta
  Uniprot ID: Q8NI38
  ENSP ID: ENSP00000475712

SEQ ID NO: 58047 - protein, 500 aa, Homo sapiens
  Payload ID: 11375
  Gene Symbol: NFKBIE
  Gene Name: nuclear factor of kappa light polypeptide gene enhancer in B-cells inhibitor, epsilon
  Uniprot ID: O00221
  ENSP ID: ENSP00000275015
MNQRRSESRPGNHRLQAYAEPGKGDSGGAGPLSGSARRGRGGGGAIRVRRPCWSGGAGRGGGPAWAVRLPTVTAGWTWPALRTLSSLRAGPSEPHSPGRRPPRAGRPLCQADPQPGKAARRSLEPDPAQTGPRPARAAGMSEARKGPDEAEESQYDSGIESLRSLRSLPESTSAPASGPSDGSPQPCTHPPGPVKEPQEKEDADGERADSTYGSSSLTYTLSLLGGPEAEDPAPRLPLPHVGALSPQQLEALTYISEDGDTLVHLAVIHEAPAVLLCCLALLPQEVLDIQNNLYQTALHLAVHLDQPGAVRALVLKGASRALQDRHGDTALHVACQRQHLACARCLLEGRPEPGRGTSHSLDLQLQNWQGLACLHIATLQKNQPLMELLLRNGADIDVQEGTSGKTALHLAVETQERGLVQFLLQAGAQVDARMLNGCTPLHLAAGRGLMGISSTLCKAGADSLLRNVEDETPQDLTEESLVLLPFDDLKISGKLLLCTD

SEQ ID NO: 58048 - protein, 55 aa, Homo sapiens
  Payload ID: 11375
  Gene Symbol: NFKBIE
  Gene Name: nuclear factor of kappa light polypeptide gene enhancer in B-cells inhibitor, epsilon
  ENSP ID: ENSP00000394658
GRGLMGISSTLCKAGADSLLRNVEDETPQDLTEESLVLLPFDDLKISGKLLLCTD

SEQ ID NO: 58049 - protein, 141 aa, Homo sapiens
  Payload ID: 11375
  Gene Symbol: NFKBIE
  Gene Name: nuclear factor of kappa light polypeptide gene enhancer in B-cells inhibitor, epsilon
  ENSP ID: ENSP00000454778
MSEARKGPDEAEESQYDSGIESLRSLRSLPESTSAPASGPSDGSPQPCTHPPGPVKEPQEKEDADGERADSTYGSSSLTYTLSLLGGPEAEDPAPRLPLPHVGALSPQQLEALTYISEDGDTQHSIWLYIWTNRAQFGHWC

SEQ ID NO: 58050 - protein, 499 aa, Homo sapiens
  Payload ID: 11375
  Gene Symbol: NFKBIE
  Gene Name: nuclear factor of kappa light polypeptide gene enhancer in B-cells inhibitor, epsilon
  ENSP ID: ENSP00000479764
MNQRRSESRPGNHRLQAYAEPGKGDSGGAGPLSGSARRGRGGGGAIRVRRPCWSGGAGRGGGPAWAVRLPTVTAGWTWPALRTLSSLRAGPSEPHSPGRRPPRAGRPLCQADPQPGKAARRSLEPDPAQTGPRPARAAGMSEARKGPDEAEESQYDSGIESLRSLRSLPESTSAPASGPSDGSPQPCTHPPGPVKEPQEKEDADGERADSTYGSSSLTYTLSLLGGPEAEDPAPRLPLPHVGALSPQQLEALTYISEDGDTLVHLAVIHEAPAVLLCCLALLPQEVLDIQNNLYQTALHLAVHLDQPGAVRALVLKGASRALQDRHGDTALHVACQRQTWPVPAACWKGGQPGRGTSHSLDLQLQNWQGLACLHIATLQKNQPLMELLLRNGADIDVQEGTSGKTALHLAVETQERGLVQFLLQAGAQVDARMLNGCTPLHLAAGRGLMGISSTLCKAGADSLLRNVEDETPQDLTEESLVLLPFDDLKISGKLLLCTD

SEQ ID NO: 58051 - protein, 361 aa, Homo sapiens
  Payload ID: 11375
  Gene Symbol: NFKBIE
  Gene Name: nuclear factor of kappa light polypeptide gene enhancer in B-cells inhibitor, epsilon
  ENSP ID: ENSP00000480216
MSEARKGPDEAEESQYDSGIESLRSLRSLPESTSAPASGPSDGSPQPCTHPPGPVKEPQEKEDADGERADSTYGSSSLTYTLSLLGGPEAEDPAPRLPLPHVGALSPQQLEALTYISEDGDTLVHLAVIHEAPAVLLCCLALLPQEVLDIQNNLYQTALHLAVHLDQPGAVRALVLKGASRALQDRHGDTALHVACQRQHLACARCLLEGRPEPGRGTSHSLDLQLQNWQGLACLHIATLQKNQPLMELLLRNGADIDVQEGTSGKTALHLAVETQERGLVQFLLQAGAQVDARMLNGCTPLHLAAGRGLMGISSTLCKAGADSLLRNVEDETPQDLTEESLVLLPFDDLKISGKLLLCTD

SEQ ID NO: 58052 - protein, 596 aa, Homo sapiens
  Payload ID: 11376
  Gene Symbol: NFKBIZ
  Gene Name: nuclear factor of kappa light polypeptide gene enhancer in B-cells inhibitor, zeta
  Uniprot ID: Q9BYH8
  ENSP ID: ENSP00000325593
MIVDKLLDDSRGGEGLRDAAGGCGLMTSPLNLSYFYGASPPAAAPGACDASCSVLGPSAPGSPGSDSSDFSSASSVSSCGAVESRSRGGARAERQPVEPHMGVGRQQRGPFQGVRVKNSVKELLLHIRSHKQKASGQAVDDFKTQGVNIEQFRELKNTVSYSGKRKGPDSLSDGPACKRPALLHSQFLTPPQTPTPGESMEDVHLNEPKQESSADLLQNIINIKNECSPVSLNTVQTSSSVQQQNDAHLHSFSMMPSSACEAMVGHEMASDSSNTSLPFSNMGNPMNTTQLGKSLFQWQVEQEESKLANISQDQFLSKDADGDTFLHIAVAQGRRALSYVLARKMNALHMLDIKEHNGQSAFQVAVAANQHLIVQDLVNIGAQVNTTDCWGRTPLHVCAEKGHSQVLQAIQKGAVGSNQFVDLEATNYDGLTPLHCAVIAHNAVVHELQRNQQPHSPEVQELLLKNKSLVDTIKCLIQMGAAVEAKDRKSGRTALHLAAEEANLELIRLFLELPSCLSFVNAKAYNGNTALHVAASLQYRLTQLDAVRLLMRKGADPSTRNLENEQPVHLVPDGPVGEQIRRILKGKSIQQRAPPY

SEQ ID NO: 58053 - protein, 718 aa, Homo sapiens
  Payload ID: 11376
  Gene Symbol: NFKBIZ
  Gene Name: nuclear factor of kappa light polypeptide gene enhancer in B-cells inhibitor, zeta
  Uniprot ID: Q9BYH8
  ENSP ID: ENSP00000325663
MIVDKLLDDSRGGEGLRDAAGGCGLMTSPLNLSYFYGASPPAAAPGACDASCSVLGPSAPGSPGSDSSDFSSASSVSSCGAVESRSRGGARAERQPVEPHMGVGRQQRGPFQGVRVKNSVKELLLHIRSHKQKASGQAVDDFKTQGVNIEQFRELKNTVSYSGKRKGPDSLSDGPACKRPALLHSQFLTPPQTPTPGESMEDVHLNEPKQESSADLLQNIINIKNECSPVSLNTVQVSWLNPVVVPQSSPAEQCQDFHGGQVFSPPQKCQPFQVRGSQQMIDQASLYQYSPQNQHVEQQPHYTHKPTLEYSPFPIPPQSPAYEPNLFDGPESQFCPNQSLVSLLGDQRESENIANPMQTSSSVQQQNDAHLHSFSMMPSSACEAMVGHEMASDSSNTSLPFSNMGNPMNTTQLGKSLFQWQVEQEESKLANISQDQFLSKDADGDTFLHIAVAQGRRALSYVLARKMNALHMLDIKEHNGQSAFQVAVAANQHLIVQDLVNIGAQVNTTDCWGRTPLHVCAEKGHSQVLQAIQKGAVGSNQFVDLEATNYDGLTPLHCAVIAHNAVVHELQRNQQPHSPEVQELLLKNKSLVDTIKCLIQMGAAVEAKDRKSGRTALHLAAEEANLELIRLFLELPSCLSFVNAKAYNGNTALHVAASLQYRLTQLDAVRLLMRKGADPSTRNLENEQPVHLVPDGPVGEQIRRILKGKSIQQRAPPY

SEQ ID NO: 58054 - protein, 618 aa, Homo sapiens
  Payload ID: 11376
  Gene Symbol: NFKBIZ
  Gene Name: nuclear factor of kappa light polypeptide gene enhancer in B-cells inhibitor, zeta
  Uniprot ID: Q9BYH8
  ENSP ID: ENSP00000377618
MGVGRQQRGPFQGVRVKNSVKELLLHIRSHKQKASGQAVDDFKTQGVNIEQFRELKNTVSYSGKRKGPDSLSDGPACKRPALLHSQFLTPPQTPTPGESMEDVHLNEPKQESSADLLQNIINIKNECSPVSLNTVQVSWLNPVVVPQSSPAEQCQDFHGGQVFSPPQKCQPFQVRGSQQMIDQASLYQYSPQNQHVEQQPHYTHKPTLEYSPFPIPPQSPAYEPNLFDGPESQFCPNQSLVSLLGDQRESENIANPMQTSSSVQQQNDAHLHSFSMMPSSACEAMVGHEMASDSSNTSLPFSNMGNPMNTTQLGKSLFQWQVEQEESKLANISQDQFLSKDADGDTFLHIAVAQGRRALSYVLARKMNALHMLDIKEHNGQSAFQVAVAANQHLIVQDLVNIGAQVNTTDCWGRTPLHVCAEKGHSQVLQAIQKGAVGSNQFVDLEATNYDGLTPLHCAVIAHNAVVHELQRNQQPHSPEVQELLLKNKSLVDTIKCLIQMGAAVEAKDRKSGRTALHLAAEEANLELIRLFLELPSCLSFVNAKAYNGNTALHVAASLQYRLTQLDAVRLLMRKGADPSTRNLENEQPVHLVPDGPVGEQIRRILKGKSIQQRAPPY

SEQ ID NO: 58055 - protein, 129 aa, Homo sapiens
  Payload ID: 11376
  Gene Symbol: NFKBIZ
  Gene Name: nuclear factor of kappa light polypeptide gene enhancer in B-cells inhibitor, zeta
  ENSP ID: ENSP00000418498
MGVGRQQRGPFQGVRVKNSVKELLLHIRSHKQKASGQAVDDFKTQGVNIEQFRELKNTVSYSGKRKGPDSLSDGPACKRPALLHSQFLTPPQTPTPGESMEDVHLNEPKQESSADLLQNIINIKNECSP

SEQ ID NO: 58056 - protein, 110 aa, Homo sapiens
  Payload ID: 11376
  Gene Symbol: NFKBIZ
  Gene Name: nuclear factor of kappa light polypeptide gene enhancer in B-cells inhibitor, zeta
  ENSP ID: ENSP00000418502
MIVDKLLDDSRGGEGLRDAAGGCGLMTSPLNLSYFYGASPPAAAPGACDASCSVLGPSAPGSPGSDSSDFSSASSVSSCGAVESRSRGGARAERQPVEPHMGVGRQQRGP

SEQ ID NO: 58057 - protein, 601 aa, Homo sapiens
  Payload ID: 11376
  Gene Symbol: NFKBIZ
  Gene Name: nuclear factor of kappa light polypeptide gene enhancer in B-cells inhibitor, zeta
  ENSP ID: ENSP00000419800
MGVGRQQRGPFQGVRVKNSVKELLLHIRSHKQKASGQAVDDFKTQGVNIEQFRELKNTVSYSGKRKGPDSLSDGPACKRPALLHSQFLTPPQTPTPGESMEDVHLNEPKQESSADLLQNIINIKNECSPVSLNTVQVSWLNPVVVPQSSPAEQCQDFHGGQVFSPPQKCQPFQVRGSQQMIDQASLYQYSPQNQHVEQQPHYTHKPTLEYSPFPIPPQSPAYEPNLFDGPESQFCPNQSLVSLLGDQRESENIANPMQTSSSVQQQNDAHLHSFSMMPSSACEAMVGHEMASDSSNTSLPFSNMGNPMNTTQLGKSLFQWQVEQEESKLANISQDQFLSKDADGDTFLHIAVAQGRRALSYVLARKMNALHMLDIKEHNGQSAFQVAVAANQHLIVQDLVNIGAQVNTTDCWGRTPLHVCAEKGHSQVLQAIQKGAVGSNQFVDLEATNYDGLTPLHCAVIAHNAVVHELQRNQQPHSPEVQELLLKNKSLVDTIKCLIQMGAAVEAKDRKSGRTALHLAAEEANLELIRLFLELPSCLSFVNAKAYNGNTALHVAASLQYRLTQLDAVRLLMRKGADPSTRNLENEQPVHLVPDGPVGEQ

SEQ ID NO: 58058 - protein, 130 aa, Homo sapiens
  Payload ID: 11376
  Gene Symbol: NFKBIZ
  Gene Name: nuclear factor of kappa light polypeptide gene enhancer in B-cells inhibitor, zeta
  ENSP ID: ENSP00000420700
  MOD_RES (1)..(1): Any amino acid
XLTPLHCAVIAHNAVVHELQRNQQPHSPEVQELLLKNKSLVDTIKCLIQMGAAVEAKAYNGNTALHVAASLQYRLTQLDAVRLLMRKGADPSTRNLENEQPVHLVPDGPVGEQIRRILKGKSIQQRAPPY

SEQ ID NO: 58059 - protein, 366 aa, Homo sapiens
  Payload ID: 11377
  Gene Symbol: NFKBIL1
  Gene Name: nuclear factor of kappa light polypeptide gene enhancer in B-cells inhibitor-like 1
  ENSP ID: ENSP00000365315
MSNPSPQVPEEEASTSVCRPKSSMASTSRRQRRERRFRRYLSAGRLVRAQALLQRHPGLDVDAGQPPPLHRACARHDAPALCLLLRLGADPAHQDRHGDTALHAAARQGPDAYTDFFLPLLSRCPSAMGIKNKDGETPGQILGWGPPWDSAEEEEEDDASKEREWRQKLQGDASHETQEPESFSAWSDRLAREHAQKCQQQQREAEGSRRPPRAEGSSQSWRQQEEEQRLFRERARAKEEELRESRARRAQEALGDREPKPTRAGPREEHPRGAGRGSLWRFGDVPWPCPGGGDPEAMAAALVARGPPLEEQGALRRYLRVQQVRWHPDRFLQRFRSQIETWELGRVMGAVTALSQALNRHAEALK

SEQ ID NO: 58060 - protein, 358 aa, Homo sapiens
  Payload ID: 11377
  Gene Symbol: NFKBIL1
  Gene Name: nuclear factor of kappa light polypeptide gene enhancer in B-cells inhibitor-like 1
  ENSP ID: ENSP00000365316
MASTSRRQRRERRFRRYLSAGRLVRAQALLQRHPGLDVDAGQPPPLHRACARHDAPALCLLLRLGADPAHQDRHGDTALHAAARQGPDAYTDFFLPLLSRCPSAMGIKNKDGETPGQILGWGPPWDSAEEEEEDDASKEREWRQKLQGELEDEWQEVMGRFEGDASHETQEPESFSAWSDRLAREHAQKCQQQQREAEGSRRPPRAEGSSQSWRQQEEEQRLFRERARAKEEELRESRARRAQEALGDREPKPTRAGPREEHPRGAGRGSLWRFGDVPWPCPGGGDPEAMAAALVARGPPLEEQGALRRYLRVQQVRWHPDRFLQRFRSQIETWELGRVMGAVTALSQALNRHAEALK

SEQ ID NO: 58061 - protein, 381 aa, Homo sapiens
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENSP ID: ENSP00000365318
MSNPSPQVPEEEASTSVCRPKSSMASTSRRQRRERRFRRYLSAGRLVRAQALLQRHPGLDVDAGQPPPLHRACARHDAPALCLLLRLGADPAHQDRHGDTALHAAARQGPDAYTDFFLPLLSRCPSAMGIKNKDGETPGQILGWGPPWDSAEEEEEDDASKEREWRQKLQGELEDEWQEVMGRFEGDASHETQEPESFSAWSDRLAREHAQKCQQQQREAEGSRRPPRAEGSSQSWRQQEEEQRLFRERARAKEEELRESRARRAQEALGDREPKPTRAGPREEHPRGAGRGSLWRFGDVPWPCPGGGDPEAMAAALVARGPPLEEQGALRRYLRVQQVRWHPDRFLQRFRSQIETWELGRVMGAVTALSQALNRHAEALK

SEQ ID NO: 58062 - protein, 366 aa, Homo sapiens [sequence omitted]

SEQ ID NO: 58063 - protein, 358 aa, Homo sapiens
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENSP ID: ENSP00000383137
MASTSRRQRRERRFRRYLSAGRLVRAQALLQRHPGLDVDAGQPPPLHRACARHDAPALCLLLRLGADPAHQDRHGDTALHAAARQGPDAYTDFFLPLLSRCPSAMGIKNKDGETPGQILGWGPPWDSAEEEEEDDASKEREWRQKLQGELEDEWQEVMGRFEGDASHETQEPESFSAWSDRLAREHAQKCQQQQREAEGSCRPPRAEGSSQSWRQQEEEQRLFRERARAKEEELRESRARRAQEALGDREPKPTRAGPREEHPRGAGRGSLWRFGDVPWPCPGGGDPEAMAAALVARGPPLEEQGALRRYLRVQQVRWHPDRFLQRFRSQIETWELGRVMGAVTALSQALNRHAEALK

SEQ ID NO: 58064 - protein, 381 aa, Homo sapiens
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENSP ID: ENSP00000383142
MSNPSPQVPEEEASTSVCRPKSSMASTSRRQRRERRFRRYLSAGRLVRAQALLQRHPGLDVDAGQPPPLHRACARHDAPALCLLLRLGADPAHQDRHGDTALHAAARQGPDAYTDFFLPLLSRCPSAMGIKNKDGETPGQILGWGPPWDSAEEEEEDDASKEREWRQKLQGELEDEWQEVMGRFEGDASHETQEPESFSAWSDRLAREHAQKCQQQQREAEGSCRPPRAEGSSQSWRQQEEEQRLFRERARAKEEELRESRARRAQEALGDREPKPTRAGPREEHPRGAGRGSLWRFGDVPWPCPGGGDPEAMAAALVARGPPLEEQGALRRYLRVQQVRWHPDRFLQRFRSQIETWELGRVMGAVTALSQALNRHAEALK

SEQ ID NO: 58065 - protein, 381 aa, Homo sapiens; identical to SEQ ID NO: 58064
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENSP ID: ENSP00000394486

SEQ ID NO: 58066 - protein, 381 aa, Homo sapiens; identical to SEQ ID NO: 58064
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENSP ID: ENSP00000395544

SEQ ID NO: 58067 - protein, 358 aa, Homo sapiens; identical to SEQ ID NO: 58063
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENSP ID: ENSP00000395977

SEQ ID NO: 58068 - protein, 381 aa, Homo sapiens; identical to SEQ ID NO: 58064
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENSP ID: ENSP00000396656

SEQ ID NO: 58069 - protein, 366 aa, Homo sapiens [sequence omitted]

SEQ ID NO: 58070 - protein, 358 aa, Homo sapiens; identical to SEQ ID NO: 58063
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENSP ID: ENSP00000401830

SEQ ID NO: 58071 - protein, 366 aa, Homo sapiens [sequence omitted]

SEQ ID NO: 58072 - protein, 358 aa, Homo sapiens; identical to SEQ ID NO: 58063
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENSP ID: ENSP00000407809

SEQ ID NO: 58073 - protein, 381 aa, Homo sapiens; identical to SEQ ID NO: 58064
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENSP ID: ENSP00000408426

SEQ ID NO: 58074 - protein, 358 aa, Homo sapiens; identical to SEQ ID NO: 58063
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENSP ID: ENSP00000411174

SEQ ID NO: 58075 - protein, 381 aa, Homo sapiens; identical to SEQ ID NO: 58064
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENSP ID: ENSP00000411611

SEQ ID NO: 58076 - protein, 366 aa, Homo sapiens [sequence omitted]

SEQ ID NO: 58077 - protein, 358 aa, Homo sapiens; identical to SEQ ID NO: 58063
  Payload ID: 11377
  Gene Symbol: NFKBIL1
  Gene Name: nuclear factor of kappa light polypeptide gene enhancer in B-cells inhibitor-like 1
  Uniprot ID: Q9UBC1
  ENSP ID: ENSP00000413952

SEQ ID NO: 58078 - protein, 366 aa, Homo sapiens [sequence omitted]

SEQ ID NO: 58079 - protein, 366 aa, Homo sapiens [sequence omitted]

SEQ ID NO: 58080 - protein, 222 aa, Homo sapiens
  Payload ID: 11377
  Gene Symbol: NFKBIL1
  Gene Name: nuclear factor of kappa light polypeptide gene enhancer in B-cells inhibitor-like 1
  ENSP ID: ENSP00000433434
MSNPSPQVPEEEASTSVCRPKSSMASTSRRQRRERRFRRYLSAGRLVRAQALLQRHPGLDVDAGQPPPLHRACARHDAPALCLLLRLGADPAHQDRHGDTALHAAARQGPDAYTDFFLPLLSRCPSAMGIKNKDGETPGQILGWGPPWDSAEEEEEDDASKEREWRQKLQGELEDEWQEVMGRFEGEKSTAIHSCPSPLAAFHLHECVTLGSSAPSSVLPCF

SEQ ID NO: 58081 - protein, 125 aa, Homo sapiens
  Payload ID: 11377
  Gene Symbol: NFKBIL1
  Gene Name: nuclear factor of kappa light polypeptide gene enhancer in B-cells inhibitor-like 1
  ENSP ID: ENSP00000435404
MSNPSPQVPEEEASTSVCRPKSSMASTSRRQRRERRFRRYLSAGRLVRAQALLQRHPGLDVDAGQPPPLHRACARHDAPALCLLLRLGADPAHQDRHGDTALHAAARQGPDGQQSFGKSLLCRRP

SEQ ID NO: 58082 - protein, 125 aa, Homo sapiens; identical to SEQ ID NO: 58081
  Payload ID: 11377
  Gene Symbol: NFKBIL1
  Gene Name: nuclear factor of kappa light polypeptide gene enhancer in B-cells inhibitor-like 1
  ENSP ID: ENSP00000437148

SEQ ID NO: 58083 - protein, 1299 aa, Homo sapiens [sequence omitted]

SEQ ID NO: 58084 - protein, 92 aa, Homo sapiens
  Payload ID: 11378
  Gene Symbol: NFRKB
  Gene Name: nuclear factor related to kappaB binding protein
  ENSP ID: ENSP00000431247
MDSLDHMLTDPLELGPCGDGHGTRIMEDCLLGGTRVSLPEDLLEDPEIFFDVVSLSTWQEVLSDSQREHLQQFLPQFPEDSAEQQNELILAL

SEQ ID NO: 58085 - protein, 188 aa, Homo sapiens
  Payload ID: 11378
  Gene Symbol: NFRKB
  Gene Name: nuclear factor related to kappaB binding protein
  ENSP ID: ENSP00000431854
MDSLDHMLTDPLELGPCGDGHGTRIMEDCLLGGTRVSLPEDLLEDPEIFFDVVSLSTWQEVLSDSQREHLQQFLPQFPEDSAEQQNELILALFSGENFRFGNPLHIAQKLFRDGHFNPEVVKYRQLCFKSQYKRYLNSQQQYFHRLLKQILASRSDLLEMARRSGPALPFRQKRPSPSRTPEEREWRT

SEQ ID NO: 58086 - protein, 122 aa, Homo sapiens
  Payload ID: 11378
  Gene Symbol: NFRKB
  Gene Name: nuclear factor related to kappaB binding protein
  ENSP ID: ENSP00000432520
MDSLDHMLTDPLELGPCGDGHGTRIMEDCLLGGTRVSLPEDLLEDPEIFFDVVSLSTWQEVLSDSQREHLQQFLPQFPEDSAEQQNELILALFSGENFRFGNPLHIAQKLFRDTEAAKSGFV

SEQ ID NO: 58087 - protein, 987 aa, Homo sapiens
  Payload ID: 11378
  Gene Symbol: NFRKB
  Gene Name: nuclear factor related to kappaB binding protein
  ENSP ID: ENSP00000432606
MDSLDHMLTDPLELGPCGDGHGTRIMEDCLLGGTRVSLPEDLLEDPEIFFDVVSLSTWQEVLSDSQREHLQQFLPQFPEDSAEQQNELILALFSGENFRFGNPLHIAQKLFRDGHFNPEVVKYRQLCFKSQYKRYLNSQQQYFHRLLKQILASRSDLLEMARRSGPALPFRQKRPSPSRTPEEREWRTQQRYLKVLREVKEECGDTALSSDEEATLDLQEQFSFEDLSSWLPSSPARSPSPAVPLRVVPTLSTTDMKTADKVELGDSDLKIMLKKHHEKRKHQPDHPDLLTGDLTLNDIMTRVNAGRKGSLAALYDLAVLKKKVKEKEEKKKKKIKTIKSEAEDLAEPLSSTEGVAPLSQAPSPLAIPAIKEEPLEDLKPCLGINEISSSFFSLLLEILLLESQASLPMLEERVLDWQSSPASSLNSWFSAAPNWAELVLPALQYLAGESRAVPSSFSPFVEFKEKTQQWKLLGQSQDNEKELAALFQLWLETKDQAFCKKMKTAQMPQHLSLGRTDYVVRPSTGEEKRVFQEQERYRYSQPHKAFTFRMHGFESVVGPVKGVFDKETSLNKAREHSLLRSDRPAYVTILSLVRDAAARLPNGEGTRAEICELLKDSQFLAPDVTSTQVNTVVSGALDRLHYEKDPCVKYDIGRKLWIYLHRDRSEEEFERIHQAQAAAAKARKALQQKPKPPSKVKSSSKESSIKVLSSGPSEQSQMSLSDSSMPPTPVTPVTPTTPALPAIPISPPPVSAVNKSGPSTVSEPAKSSSGVLLVSSPTMPHLGTMLSPASSQTAPSSQAAARVVSHSGSAGLSQVRVVAQPSLPAVPQQSGGPAQTLPQMPAGPQIRVPATATQTKVVPQTVMATVPVKAQTTAATVQRPGPGQTGLTVTSLPATASPVSKPATSSPGTSAPSASTAAVIQNVTGQNIIKQVAITGQLGVKPQTGNSIPLTATNFRIQGKDVLRLPPSSITTDAKGQTVLRITPDMM

SEQ ID NO: 58088 - protein, 1299 aa, Homo sapiens [sequence omitted]

SEQ ID NO: 58089 - protein, 147 aa, Homo sapiens
  Payload ID: 11378
  Gene Symbol: NFRKB
  Gene Name: nuclear factor related to kappaB binding protein
  ENSP ID: ENSP00000433730
MDSLDHMLTDPLELGPCGDGHGTRIMEDCLLGGTRVSLPEDLLEDPEIFFDVVSLSTWQEVLSDSQREHLQQFLPQFPEDSAEQQNELILALFSGENFRFGNPLHIAQKLFRDGHFNPEVVKYRQLCFKSQYKRYLNSQQQYFHRLL

SEQ ID NO: 58090 - protein, 46 aa, Homo sapiens
  Payload ID: 11378
  Gene Symbol: NFRKB
  Gene Name: nuclear factor related to kappaB binding protein
  ENSP ID: ENSP00000433764
MDSLDHMLTDPLELGPCGDGHGTRIMEDCLLGGTRVSLPEDLLEDV

SEQ ID NO: 58091 - protein, 188 aa, Homo sapiens; identical to SEQ ID NO: 58085
  Payload ID: 11378
  Gene Symbol: NFRKB
  Gene Name: nuclear factor related to kappaB binding protein
  ENSP ID: ENSP00000434326

SEQ ID NO: 58092 - protein, 1324 aa, Homo sapiens
  Payload ID: 11378
  Gene Symbol: NFRKB
  Gene Name: nuclear factor related to kappaB binding protein
  Uniprot ID: Q6P4R8
  ENSP ID: ENSP00000436926
MHVFVQSTCGEETMDSLDHMLTDPLELGPCGDGHGTRIMEDCLLGGTRVSLPEDLLEDPEIFFDVVSLSTWQEVLSDSQREHLQQFLPQFPEDSAEQQNELILALFSGENFRFGNPLHIAQKLFRDGHFNPEVVKYRQLCFKSQYKRYLNSQQQYFHRLLKQILASRSDLLEMARRSGPALPFRQKRPSPSRTPEEREWRTQQRYLKVLREVKEECGDTALSSDEEATLDLQEQFSFEDLSSWLPSSPARSPSPAVPLRVVPTLSTTDMKTADKVELGDSDLKIMLKKHHEKRKHQPDHPDLLTGDLTLNDIMTRVNAGRKGSLAALYDLAVLKKKVKEKEEKKKKKIKTIKSEAEDLAEPLSSTEGVAPLSQAPSPLAIPAIKEEPLEDLKPCLGINEISSSFFSLLLEILLLESQASLPMLEERVLDWQSSPASSLNSWFSAAPNWAELVLPALQYLAGESRAVPSSFSPFVEFKEKTQQWKLLGQSQDNEKELAALFQLWLETKDQAFCKQENEDSSDATTPVPRVRTDYVVRPSTGEEKRVFQEQERYRYSQPHKAFTFRMHGFESVVGPVKGVFDKETSLNKAREHSLLRSDRPAYVTILSLVRDAAARLPNGEGTRAEICELLKDSQFLAPDVTSTQVNTVVSGALDRLHYEKDPCVKYDIGRKLWIYLHRDRSEEEFERIHQAQAAAAKARKALQQKPKPPSKVKSSSKESSIKVLSSGPSEQSQMSLSDSSMPPTPVTPVTPTTPALPAIPISPPPVSAVNKSGPSTVSEPAKSSSGVLLVSSPTMPHLGTMLSPASSQTAPSSQAAARVVSHSGSAGLSQVRVVAQPSLPAVPQQSGGPAQTLPQMPAGPQIRVPATATQTKVVPQTVMATVPVKAQTTAATVQRPGPGQTGLTVTSLPATASPVSKPATSSPGTSAPSASTAAVIQNVTGQNIIKQVAITGQLGVKPQTGNSIPLTATNFRIQGKDVLRLPPSSITTDAKGQTVLRITPDMMATLAKSQVTTVKLTQDLFGTGGNTTGKGISATLHVTSNPVHAADSPAKASSASAPSSTPTGTTVVKVTPDLKPTEASSSAFRLMPALGVSVADQKGKSTVASSEAKPAATIRIVQGLGVMPPKAGQTITVATHAKQGASVASGSGTVHTSAVSLPSMNAAVSKTVAVASGAASTPISISTGAPTVRQVPVSTTVVSTSQAGKLPTRITVPLSVISQPMKGKSVVTAPIIKGNLGANLSGLGRNIILTTMPAGTKLIAGNKPVSFLTAQQLQQLQQQGQATQVRIQTVPASHLQQGTASGSSKAVSTVVVTTAPSPKQAPEQQ

SEQ ID NO: 58093 - protein, 373 aa, Homo sapiens
  Payload ID: 11379
  Gene Symbol: NFE2
  Gene Name: nuclear factor, erythroid 2
  Uniprot ID: Q16621
  ENSP ID: ENSP00000312436
MSPCPPQQSRNRVIQLSTSELGEMELTWQEIMSITELQGLNAPSEPSFEPQAPAPYLGPPPPTTYCPCSIHPDSGFPLPPPPYELPASTSHVPDPPYSYGNMAIPVSKPLSLSGLLSEPLQDPLALLDIGLPAGPPKPQEDPESDSGLSLNYSDAESLELEGTEAGRRRSEYVEMYPVEYPYSLMPNSLAHSNYTLPAAETPLALEPSSGPVRAKPTARGEAGSRDERRALAMKIPFPTDKIVNLPVDDFNELLARYPLTESQLALVRDIRRRGKNKVAAQNCRKRKLETIVQLERELERLTNERERLLRARGEADRTLEVMRQQLTELYRDIFQHLRDESGNSYSPEEYALQQAADGTIFLVPRGTKMEATD

SEQ ID NO: 58094 - protein, 373 aa, Homo sapiens; identical to SEQ ID NO: 58093
  Payload ID: 11379
  Gene Symbol: NFE2
  Gene Name: nuclear factor, erythroid 2
  Uniprot ID: Q16621
  ENSP ID: ENSP00000397185

SEQ ID NO: 58095 - protein, 373 aa, Homo sapiens; identical to SEQ ID NO: 58093
  Payload ID: 11379
  Gene Symbol: NFE2
  Gene Name: nuclear factor, erythroid 2
  Uniprot ID: Q16621
  ENSP ID: ENSP00000439120

SEQ ID NO: 58096 - protein, 343 aa, Homo sapiens
  Payload ID: 11379
  Gene Symbol: NFE2
  Gene Name: nuclear factor, erythroid 2
  ENSP ID: ENSP00000446929
MSPCPPQQSRNRVIQLSTSELGEMELTWQEIMSITELQGLNAPSEPSFEPQAPAPYLGPPPPTTYCPCSIHPDSGFPLPPPPYELPASTSHVPDPPYSYGNMAIPVSKPLSLSGLLSEPLQDPLALLDIGLPAGPPKPQEDPESDSGLSLNYSDAESLELEGTEAGRRRSEYVEMYPVEYPYSLMPNSLAHSNYTLPAAETPLALEPSSGPVRAKPTARGEAGSRDERRALAMKIPFPTDKIVNLPVDDFNELLARYPLTESQLALVRDIRRRGKNKVAAQNCRKRKLETIVQLERELERLTNERERLLRARGEADRTLEVMRQQLTELYRDIFQHLRDESGN

SEQ ID NO: 58097 - protein, 373 aa, Homo sapiens; identical to SEQ ID NO: 58093
  Payload ID: 11379
  Gene Symbol: NFE2
  Gene Name: nuclear factor, erythroid 2
  Uniprot ID: Q16621
  ENSP ID: ENSP00000447558

SEQ ID NO: 58098 - protein, 742 aa, Homo sapiens
  Payload ID: 11380
  Gene Symbol: NFE2L1
  Gene Name: nuclear factor, erythroid 2-like 1
  Uniprot ID: Q14494
  ENSP ID: ENSP00000350072
MLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTEVNAWLVHRDPEGSVSGSQPNSGLALESSSGLQDVTGPDNGVRESETEQGFGEDLEDLGAVAPPVSGDLTKEDIDLIDILWRQDIDLGAGREVFDYSHRQKEQDVEKELRDGGEQDTWAGEGAEALARNLLVDGETGESFPAQFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 58099 - protein, 772 aa, Homo sapiens
  Payload ID: 11380
  Gene Symbol: NFE2L1
  Gene Name: nuclear factor, erythroid 2-like 1
  Uniprot ID: Q14494
  ENSP ID: ENSP00000354855
MLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTEVNAWLVHRDPEGSVSGSQPNSGLALESSSGLQDVTGPDNGVRESETEQGFGEDLEDLGAVAPPVSGDLTKEDIDLIDILWRQDIDLGAGREVFDYSHRQKEQDVEKELRDGGEQDTWAGEGAEALARNLLVDGETGESFPAQVPSGEDQTALSLEECLRLLEATCPFGENAEFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 58100 - protein, 761 aa, Homo sapiens
  Payload ID: 11380
  Gene Symbol: NFE2L1
  Gene Name: nuclear factor, erythroid 2-like 1
  ENSP ID: ENSP00000355190
MLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTEVNAWLVHRDPEGSVSGSQPNSGLALESSSGLQDVTGPDNGVRESETEQGFGEDLEDLGAVAPPVSGDLTKEDIDLGAGREVFDYSHRQKEQDVEKELRDGGEQDTWAGEGAEALARNLLVDGETGESFPAQVPSGEDQTALSLEECLRLLEATCPFGENAEFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 58101 - protein, 616 aa, Homo sapiens
  Payload ID: 11380
  Gene Symbol: NFE2L1
  Gene Name: nuclear factor, erythroid 2-like 1
  ENSP ID: ENSP00000445811
MTRLDRSSHSGGGHAKGSRPLNSLLAGHRVAQPASAPGSRASVQDIDLIDILWRQDIDLGAGREVFDYSHRQKEQDVEKELRDGGEQDTWAGEGAEALARNLLVDGETGESFPAQFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 58102 - protein, 742 aa, Homo sapiens; identical to SEQ ID NO: 58098
  Payload ID: 11380
  Gene Symbol: NFE2L1
  Gene Name: nuclear factor, erythroid 2-like 1
  Uniprot ID: Q14494
  ENSP ID: ENSP00000461960

SEQ ID NO: 58103 - protein, 133 aa, Homo sapiens
  Payload ID: 11380
  Gene Symbol: NFE2L1
  Gene Name: nuclear factor, erythroid 2-like 1
  ENSP ID: ENSP00000461971
SEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEELCGAKADRGEGMDL

SEQ ID NO: 58104 - protein, 9 aa, Homo sapiens
  Payload ID: 11380
  Gene Symbol: NFE2L1
  Gene Name: nuclear factor, erythroid 2-like 1
  ENSP ID: ENSP00000462003
MLSLKKYLT

SEQ ID NO: 58105 - protein, 3 aa, Homo sapiens
  Payload ID: 11380
  Gene Symbol: NFE2L1
  Gene Name: nuclear factor, erythroid 2-like 1
  ENSP ID: ENSP00000462253
MLS

SEQ ID NO: 58106 - protein, 63 aa, Homo sapiens
  Payload ID: 11380
  Gene Symbol: NFE2L1
  Gene Name: nuclear factor, erythroid 2-like 1
  ENSP ID: ENSP00000462444
MTRLDRSSHSGGGHAKGSRPLNSLLAGHRVAQPASAPGSRASVQDIDLIDILWRQDIDLGAGR

SEQ ID NO: 58107 - protein, 62 aa, Homo sapiens
  Payload ID: 11380
  Gene Symbol: NFE2L1
  Gene Name: nuclear factor, erythroid 2-like 1
  ENSP ID: ENSP00000462610
MSIMEMQAMEVNTSASEILYSAPPGDPLSTNYSLAPNTPINQNVSLHQASLGGCSQDFLLFS

SEQ ID NO: 58108 - protein, 19 aa, Homo sapiens
  Payload ID: 11380
  Gene Symbol: NFE2L1
  Gene Name: nuclear factor, erythroid 2-like 1
  ENSP ID: ENSP00000462971
MSIMEMQAMEVNTSASEIL

SEQ ID NO: 58109 - protein, 573 aa, Homo sapiens
  Payload ID: 11380
  Gene Symbol: NFE2L1
  Gene Name: nuclear factor, erythroid 2-like 1
  ENSP ID: ENSP00000463291
MGWESHLTAASADIDLGAGREVFDYSHRQKEQDVEKELRDGGEQDTWAGEGAEALARNLLVDGETGESFPAQFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 58110 - protein, 82 aa, Homo sapiens
  Payload ID: 11380
  Gene Symbol: NFE2L1
  Gene Name: nuclear factor, erythroid 2-like 1
  ENSP ID: ENSP00000463657
MLSLKKYLTEGLLQFTILLSLIGVRVDVDTYLTSQLPPLREIILGPSSAYTQTQFHNLRNTLDGYGIHPKSIDLDNYFTARR

SEQ ID NO: 58111 - protein, 47 aa, Homo sapiens
  Payload ID: 11380
  Gene Symbol: NFE2L1
  Gene Name: nuclear factor, erythroid 2-like 1
  ENSP ID: ENSP00000463744
MSIMEMQAMEVNTSASEILYSAPPGDPLSTNYSLAPNTPINQNVSLH

SEQ ID NO: 58112 - protein, 161 aa, Homo sapiens
  Payload ID: 11380
  Gene Symbol: NFE2L1
  Gene Name: nuclear factor, erythroid 2-like 1
  ENSP ID: ENSP00000463836
MTRLDRSSHSGGGHAKGSRPLNSLLAGHRVAQPASAPGSRASVQDIDLGAGREVFDYSHRQKEQDVEKELRDGGEQDTWAGEGAEALARNLLVDGETGESFPAQFPADISSITEAVPSESEPPALQNNLLSPLLTGTESPFDLEQQWQDLMSIMEMQAMEV

SEQ ID NO: 58113 - protein, 99 aa, Homo sapiens
  Payload ID: 11380
  Gene Symbol: NFE2L1
  Gene Name: nuclear factor, erythroid 2-like 1
  ENSP ID: ENSP00000463960
MLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTE

SEQ ID NO: 58114 - protein, 23 aa, Homo sapiens
  Payload ID: 11380
  Gene Symbol: NFE2L1
  Gene Name: nuclear factor, erythroid 2-like 1
  ENSP ID: ENSP00000464018
MSIMEMQAMEVNTSASEILYSAP

SEQ ID NO: 58115 - protein, 111 aa, Homo sapiens
  Payload ID: 11380
  Gene Symbol: NFE2L1
  Gene Name: nuclear factor, erythroid 2-like 1
  ENSP ID: ENSP00000464203
MTRLDRSSHSGGGHAKGSRPLNSLLAGHRVAQPASAPGSRASVQDIDLIDILWRQDIDLGAGREVFDYSHRQKEQDVEKELRDGGEQDTWAGEGAEALARNLLVDGETGES

SEQ ID NO: 58116 - protein, 584 aa, Homo sapiens
  Payload ID: 11380
  Gene Symbol: NFE2L1
  Gene Name: nuclear factor, erythroid 2-like 1
  ENSP ID: ENSP00000464446
MGWESHLTAASADIDLIDILWRQDIDLGAGREVFDYSHRQKEQDVEKELRDGGEQDTWAGEGAEALARNLLVDGETGESFPAQFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 58117 - protein, 605 aa, Homo sapiens
  Payload ID: 11381
  Gene Symbol: NFE2L2
  Gene Name: nuclear factor, erythroid 2-like 2
  Uniprot ID: Q16236
  ENSP ID: ENSP00000380252
MMDLELPPPGLPSQQDMDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 58118 - protein, 589 aa, Homo sapiens
  Payload ID: 11381
  Gene Symbol: NFE2L2
  Gene Name: nuclear factor, erythroid 2-like 2
  Uniprot ID: Q16236
  ENSP ID: ENSP00000380253
MDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 58119 - protein, 68 aa, Homo sapiens
  Payload ID: 11381
  Gene Symbol: NFE2L2
  Gene Name: nuclear factor, erythroid 2-like 2
  ENSP ID: ENSP00000391291
MMDLELPPPGLPSQQDMDLIDNYHFYSSIPSMEKEVGNCSPHFLNAFEDSFSSILSTEDPNQLTVNSL

SEQ ID NO: 58120 - protein, 265 aa, Homo sapiens
  Payload ID: 11381
  Gene Symbol: NFE2L2
  Gene Name: nuclear factor, erythroid 2-like 2
  ENSP ID: ENSP00000391590
MDLIDILWRQDIDLGVSREVFDFSQRRKEYELEKQKKLEKERQEQLQKEQEKAFFAQLQLDEETAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKE

SEQ ID NO: 58121 - protein, 280 aa, Homo sapiens
  Payload ID: 11381
  Gene Symbol: NFE2L2
  Gene Name: nuclear factor, erythroid 2-like 2
  ENSP ID: ENSP00000400073
MDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSIS

SEQ ID NO: 58122 - protein, 141 aa, Homo sapiens
  Payload ID: 11381
  Gene Symbol: NFE2L2
  Gene Name: nuclear factor, erythroid 2-like 2
  ENSP ID: ENSP00000410015
MDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVRYKITWLIEKLHHNYKITIYSM

SEQ ID NO: 58123 - protein, 582 aa, Homo sapiens
  Payload ID: 11381
  Gene Symbol: NFE2L2
  Gene Name: nuclear factor, erythroid 2-like 2
  Uniprot ID: Q16236
  ENSP ID: ENSP00000411575
MDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNESLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 58124 - protein, 234 aa, Homo sapiens
  Payload ID: 11381
  Gene Symbol: NFE2L2
  Gene Name: nuclear factor, erythroid 2-like 2
  ENSP ID: ENSP00000412191
MDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAF

SEQ ID NO: 58125 - protein, 47 aa, Homo sapiens
  Payload ID: 11381
  Gene Symbol: NFE2L2
  Gene Name: nuclear factor, erythroid 2-like 2
  ENSP ID: ENSP00000416308
TSVAQVAPVDLDGMQQDIEQVWEELLSIPELQWRQGFTMLTRVVWNS

SEQ ID NO: 58126 - protein, 265 aa, Homo sapiens
  Payload ID: 11381
  Gene Symbol: NFE2L2
  Gene Name: nuclear factor, erythroid 2-like 2
  ENSP ID: ENSP00000464920
MIVSFLRPPQTCGTDMDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQL

SEQ ID NO: 58127 - protein, 589 aa, Homo sapiens; identical to SEQ ID NO: 58118
  Payload ID: 11381
  Gene Symbol: NFE2L2
  Gene Name: nuclear factor, erythroid 2-like 2
  Uniprot ID: Q16236
  ENSP ID: ENSP00000467401

SEQ ID NO: 58128 - protein, 146 aa, Homo sapiens
  Payload ID: 11381
  Gene Symbol: NFE2L2
  Gene Name: nuclear factor, erythroid 2-like 2
  ENSP ID: ENSP00000468089
MDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQA

SEQ ID NO: 58129 - protein, 694 aa, Homo sapiens
  Payload ID: 11382
  Gene Symbol: NFE2L3
  Gene Name: nuclear factor, erythroid 2-like 3
  Uniprot ID: Q9Y4A8
  ENSP ID: ENSP00000056233
MKHLKRWWSAGGGLLHLTLLLSLAGLRVDLDLYLLLPPPTLLQDELLFLGGPASSAYALSPFSASGGWGRAGHLHPKGRELDPAAPPEGQLLREVRALGVPFVPRTSVDAWLVHSVAAGSADEAHGLLGAAAASSTGGAGASVDGGSQAVQGGGGDPRAARSGPLDAGEEEKAPAEPTAQVPDAGGCASEENGVLREKHEAVDHSSQHEENEERVSAQKENSLQQNDDDENKIAEKPDWEAEKTTESRNERHLNGTDTSFSLEDLFQLLSSQPENSLEGISLGDIPLPGSISDGMNSSAHYHVNFSQAISQDVNLHEAILLCPNNTFRRDPTARTSQSQEPFLQLNSHTTNPEQTLPGTNLTGFLSPVDNHMRNLTSQDLLYDLDINIFDEINLMSLATEDNFDPIDVSQLFDEPDSDSGLSLDSSHNNTSVIKSNSSHSVCDEGAIGYCTDHESSSHHDLEGAVGGYYPEPSKLCHLDQSDSDFHGDLTFQHVFHNHTYHLQPTAPESTSEPFPWPGKSQKIRSRYLEDTDRNLSRDEQRAKALHIPFSVDEIVGMPVDSFNSMLSRYYLTDLQVSLIRDIRRRGKNKVAAQNCRKRKLDIILNLEDDVCNLQAKKETLKREQAQCNKAINIMKQKLHDLYHDIFSRLRDDQGRPVNPNHYALQCTHDGSILIVPKELVASGHKKETQKGKRK

SEQ ID NO: 58130 - protein, 83 aa, Homo sapiens
  Payload ID: 11382
  Gene Symbol: NFE2L3
  Gene Name: nuclear factor, erythroid 2-like 3
  ENSP ID: ENSP00000475463
NEERVSAQKENSLQQNDDDENKIAEKPDWEAEKTTESRNERHLNGTDTSFSLEDLFQLLSSQPENSLEVIGTLAFILAGTYLH

SEQ ID NO: 58131 - protein, 462 aa, Homo sapiens
  Payload ID: 11383
  Gene Symbol: NFIL3
  Gene Name: nuclear factor, interleukin 3 regulated
  Uniprot ID: Q16649
  ENSP ID: ENSP00000297689
MQLRKMQTVKKEQASLDASSNVDKMMVLNSALTEVSEDSTTGEELLLSEGSVGKNKSSACRRKREFIPDEKKDAMYWEKRRKNNEAAKRSREKRRLNDLVLENKLIALGEENATLKAELLSLKLKFGLISSTAYAQEIQKLSNSTAVYFQDYQTSKSNVSSFVDEHEPSMVSSSCISVIKHSPQSSLSDVSEVSSVEHTQESSVQGSCRSPENKFQIIKQEPMELESYTREPRDDRGSYTASIYQNYMGNSFSGYSHSPPLLQVNRSSSNSPRTSETDDGVVGKSSDGEDEQQVPKGPIHSPVELKHVHATVVKVPEVNSSALPHKLRIKAKAMQIKVEAFDNEFEATQKLSSPIDMTSKRHFELEKHSAPSMVHSSLTPFSVQVTNIQDWSLKSEHWHQKELSGKTQNSFKTGVVEMKDSGYKVSDPENLYLKQGIANLSAEVVSLKRLIATQPISASDSG

SEQ ID NO: 58132 - protein, 495 aa, Homo sapiens
  Payload ID: 11384
  Gene Symbol: NUFIP1
  Gene Name: nuclear fragile X mental retardation protein interacting protein 1
  Uniprot ID: Q9UHK0
  ENSP ID: ENSP00000368459
MAEPTSDFETPIGWHASPELTPTLGPLSDTAPPRDSWMFWAMLPPPPPPLTSSLPAAGSKPSSESQPPMEAQSLPGAPPPFDAQILPGAQPPFDAQSPLDSQPQPSGQPWNFHASTSWYWRQSSDRFPRHQKSFNPAVKNSYYPRKYDAKFTDFSLPPSRKQKKKKRKEPVFHFFCDTCDRGFKNQEKYDKHMSEHTKCPELDCSFTAHEKIVQFHWRNMHAPGMKKIKLDTPEEIARWREERRKNYPTLANIERKKKLKLEKEKRGAVLTTTQYGKMKGMSRHSQMAKIRSPGKNHKWKNDNSRQRAVTGSGSHLCDLKLEGPPEANADPLGVLINSDSESDKEEKPQHSVIPKEVTPALCSLMSSYGSLSGSESEPEETPIKTEADVLAENQVLDSSAPKSPSQDVKATVRNFSEAKSENRKKSFEKTNPKRKKDYHNYQTLFEPRTHHPYLLEMLLAPDIRHERNVILQCVRYIIKKDFFGLDTNSAKSKDV

SEQ ID NO: 58133 - protein, 695 aa, Homo sapiens
  Payload ID: 11385
  Gene Symbol: NUFIP2
  Gene Name: nuclear fragile X mental retardation protein interacting protein 2
  Uniprot ID: Q7Z417
  ENSP ID: ENSP00000225388
MEEKPGQPQPQHHHSHHHPHHHPQQQQQQPHHHHHYYFYNHSHNHHHHHHHQQPHQYLQHGAEGSPKAQPKPLKHEQKHTLQQHQETPKKKTGYGELNGNAGEREISLKNLSSDEATNPISRVLNGNQQVVDTSLKQTVKANTFGKAGIKTKNFIQKNSMDKKNGKSYENKSGENQSVDKSDTIPIPNGVVTNNSGYITNGYMGKGADNDGSGSESGYTTPKKRKARRNSAKGCENLNIVQDKIMQQETSVPTLKQGLETFKPDYSEQKGNRVDGSKPIWKYETGPGGTSRGKPAVGDMLRKSSDSKPGVSSKKFDDRPKGKHASAVASKEDSWTLFKPPPVFPVDNSSAKIVPKISYASKVKENLNKTIQNSSVSPTSSSSSSSSTGETQTQSSSRLSQVPMSALKSVTSANFSNGPVLAGTDGNVYPPGGQPLLTTAANTLTPISSGTDSVLQDMSLTSAAVEQIKTSLFIYPSNMQTMLLSTAQVDLPSQTDQQNLGDIFQNQWGLSFINEPSAGPETVTGKSSEHKVMEVTFQGEYPATLVSQGAEIIPSGTEHPVFPKAYELEKRTSPQVLGSILKSGTTSESGALSLEPSHIGDLQKADTSSQGALVFLSKDYEIESQNPLASPTNTLLGSAKEQRYQRGLERNDSWGSFDLRAAIVYHTKEMESIWNLQKQDPKRIITYNEAMDSPDQ

SEQ ID NO: 58134 - protein, 120 aa, Homo sapiens
  Payload ID: 11385
  Gene Symbol: NUFIP2
  Gene Name: nuclear fragile X mental retardation protein interacting protein 2
  Uniprot ID: Q7Z417
  ENSP ID: ENSP00000463450
MEEKPGQPQPQHHHSHHHPHHHPQQQQQQPHHHHHYYFYNHSHNHHHHHHHQQPHQYLQHGAEGSPKAQPKPLKHEQKHTLQQHQETPKKKTEMESIWNLQKQDPKRIITYNEAMDSPDQ

SEQ ID NO: 58135 - protein, 76 aa, Homo sapiens
  Payload ID: 11386
  Gene Symbol: NUGGC
  Gene Name: nuclear GTPase, germinal center associated
  ENSP ID: ENSP00000388515
MAETKDVFGQEPHPVEDDLYKERTRKRRKSDRDQRFRAFPSMEQSALKEYTSFGDLVLYPCQVPAGDISLLIPDEK

SEQ ID NO: 58136 - protein, 796 aa, Homo sapiens
  Payload ID: 11386
  Gene Symbol: NUGGC
  Gene Name: nuclear GTPase, germinal center associated
  Uniprot ID: Q68CJ6
  ENSP ID: ENSP00000408697
MAETKDVFGQEPHPVEDDLYKERTRKRRKSDRDQRFRAFPSMEQSALKEYEKLESRTRRVLSNTYQKLIQSVFLDDSIPNGVKYLINRLLALIEKPTVDPIYIALFGSTGAGKSSLINAIIQQAMFLPVSGESICTSCIVQVSSGCCVQYEAKIHLLSDQEWREELKNLTKLLHRTEELSREEADAWNRDEAVEEATWKLQMIYGNGAESKNYEELLRAKPKRKIPTSRVITLKAEEAEELSIKLDPYIRTQRRDWDGEAAEMRIWPLIKHVEVTLPKSDLIPEGVVLVDIPGTGDFNSKRDEMWKKTIDKCSVIWVISDIERVSGGQAHEDLLNESIKACQRGFCRDVALVVTKMDKLHLPEYLRERKAGNQAIQSQREAVLERNEMIKLQRTRILKEKLKRKLPADFKVLEASDLVYTVSAQEYWQQALLTEEETEIPKLREYIRKSLLDKKKRTVTKYVTEAFGLLLLTDSFNSTQNLPNEHLHMSVLRRFAEEKVELLEKAIAQCFACMEQPLQEGVRTARTSYRCILRACLVRSKGNQGFHQTLKAVCLKNGIYASRTLARIDLNEALTQPVYDQIDPVFGSIFRTGKPTGSALMPHIDAFKQSLQEKMTEIGIRSGWKYDSCKKNFLIQEISAILGGLEDHILRRKRRIYESLTASVQSDLKLCYEEAAQITGKKACERMKDAIRRGVDRQVAEGMFERAQERMQHQFQQLKTGIVEKVKGSITTMLALASSQGDGLYKELADVGSEYKEMEKLHRSLREVAENARLRKGMQEFLLRASPSKAGPPGTSL

SEQ ID NO: 58137 - protein, 979 aa, Homo sapiens
  Payload ID: 11387
  Gene Symbol: NUMA1
  Gene Name: nuclear mitotic apparatus protein 1
  Uniprot ID: Q14980
  ENSP ID: ENSP00000260051
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 58138 - protein, 2101 aa, Homo sapiens
  Payload ID: 11387
  Gene Symbol: NUMA1
  Gene Name: nuclear mitotic apparatus protein 1
  Uniprot ID: Q14980
  ENSP ID: ENSP00000351851
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 58139 - protein, 91 aa, Homo sapiens
  Payload ID: 11387
  Gene Symbol: NUMA1
  Gene Name: nuclear mitotic apparatus protein 1
  ENSP ID: ENSP00000357955
MTLHATRGAALLSWVNSLHVADPVEAVLQLQDCSIFIKIIDRIHGTEEGQQILKQPVSERLDFVCSFLQKNRKHPSSPECLVSAQKVLEGS

SEQ ID NO: 58140 - protein, 2115 aa, Homo sapiens
  Payload ID: 11387
  Gene Symbol: NUMA1
  Gene Name: nuclear mitotic apparatus protein 1
  Uniprot ID: Q14980
  ENSP ID: ENSP00000377298
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEQLEVFQREQTKQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 58141 - protein, 75 aa, Homo sapiens
  Payload ID: 11387
  Gene Symbol: NUMA1
  Gene Name: nuclear mitotic apparatus protein 1
  ENSP ID: ENSP00000438318
MTLHATRGAALLSWVNSLHVADPVEAVLQLQDCSIFIKIIDRIHGTEEGQQILKQPVSERLDFVCSFLQKNRKHP

SEQ ID NO: 58142 - protein, 82 aa, Homo sapiens
  Payload ID: 11387
  Gene Symbol: NUMA1
  Gene Name: nuclear mitotic apparatus protein 1
  ENSP ID: ENSP00000438331
MTLHATRGAALLSWVNSLHVADPVEAVLQLQDCSIFIKIIDRIHGTEEGQQILKQPVSERLDFVCSFLQKNRKHPSSPECLV

SEQ ID NO: 58143 - protein, 159 aa, Homo sapiens
  Payload ID: 11387
  Gene Symbol: NUMA1
  Gene Name: nuclear mitotic apparatus protein 1
  ENSP ID: ENSP00000438589
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPST

SEQ ID NO: 58144 - protein, 174 aa, Homo sapiens
  Payload ID: 11387
  Gene Symbol: NUMA1
  Gene Name: nuclear mitotic apparatus protein 1
  ENSP ID: ENSP00000438821
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQ

SEQ ID NO: 58145 - protein, 159 aa, Homo sapiens; identical to SEQ ID NO: 58143
  Payload ID: 11387
  Gene Symbol: NUMA1
  Gene Name: nuclear mitotic apparatus protein 1
  ENSP ID: ENSP00000439092

SEQ ID NO: 58146 - protein, 109 aa, Homo sapiens
  Payload ID: 11387
  Gene Symbol: NUMA1
  Gene Name: nuclear mitotic apparatus protein 1
  ENSP ID: ENSP00000439576
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMS

SEQ ID NO: 58147 - protein, 201 aa, Homo sapiens
  Payload ID: 11387
  Gene Symbol: NUMA1
  Gene Name: nuclear mitotic apparatus protein 1
  ENSP ID: ENSP00000439759
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSP

SEQ ID NO: 58148 - protein, 964 aa, Homo sapiens
  Payload ID: 11387
  Gene Symbol: NUMA1
  Gene Name: nuclear mitotic apparatus protein 1
  ENSP ID: ENSP00000440954
  MOD_RES (1)..(1): Any amino acid
XRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITRHKALMTIIPDLSPNNPLSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 58149 - protein, 72 aa, Homo sapiens
  Payload ID: 11387
  Gene Symbol: NUMA1
  Gene Name: nuclear mitotic apparatus protein 1
  ENSP ID: ENSP00000441598
MTLHATRGAALLSWVNSLHVADPVEAVLQLQDCSIFIKIIDRIHGTEEGQQILKQPVSERLDFVCSFLQKNR

SEQ ID NO: 58150 - protein, 61 aa, Homo sapiens
  Payload ID: 11387
  Gene Symbol: NUMA1
  Gene Name: nuclear mitotic apparatus protein 1
  ENSP ID: ENSP00000441674
MTLHATRGAALLSWVNSLHVADPVEAVLQLQDCSIFIKIIDRIHGTEEGQQILKQPVSERL

SEQ ID NO: 58151 - protein, 56 aa, Homo sapiens
  Payload ID: 11387
  Gene Symbol: NUMA1
  Gene Name: nuclear mitotic apparatus protein 1
  ENSP ID: ENSP00000442331
MTLHATRGAALLSWVNSLHVADPVEAVLQLQDCSIFIKIIDRIHGTEEGQQILKQP

SEQ ID NO: 58152 - protein, 220 aa, Homo sapiens
  Payload ID: 11387
  Gene Symbol: NUMA1
  Gene Name: nuclear mitotic apparatus protein 1
  ENSP ID: ENSP00000442761
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLK

SEQ ID NO: 58153 - protein, 691 aa, Homo sapiens
  Payload ID: 11387
  Gene Symbol: NUMA1
  Gene Name: nuclear mitotic apparatus protein 1
  ENSP ID: ENSP00000442936
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKE

SEQ ID NO: 58154 - protein, 146 aa, Homo sapiens
  Payload ID: 11387
  Gene Symbol: NUMA1
  Gene Name: nuclear mitotic apparatus protein 1
  ENSP ID: ENSP00000444175
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNED

SEQ ID NO: 58155 - protein, 59 aa, Homo sapiens
  Payload ID: 11387
  Gene Symbol: NUMA1
  Gene Name: nuclear mitotic apparatus protein 1
  ENSP ID: ENSP00000444831
MTLHATRGAALLSWVNSLHVADPVEAVLQLQDCSIFIKIIDRIHGTEEGQQILKQPVSE

SEQ ID NO: 58156 - protein, 851 aa, Homo sapiens
  Payload ID: 11387
  Gene Symbol: NUMA1
  Gene Name: nuclear mitotic apparatus protein 1
  ENSP ID: ENSP00000444880
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQE

SEQ ID NO: 58157 - protein, 353 aa, Homo sapiens
  Payload ID: 11387
  Gene Symbol: NUMA1
  Gene Name: nuclear mitotic apparatus protein 1
  ENSP ID: ENSP00000446396
  MOD_RES (1)..(1): Any amino acid
XELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITRSGGSLPPYVCLWSACCLSGCILVR

SEQ ID NO: 58158 - protein, 2101 aa, Homo sapiens; identical to SEQ ID NO: 58138
  Payload ID: 11387
  Gene Symbol: NUMA1
  Gene Name: nuclear mitotic apparatus protein 1
  Uniprot ID: Q14980
  ENSP ID: ENSP00000478624

SEQ ID NO: 58159 - protein, 979 aa, Homo sapiens; identical to SEQ ID NO: 58137
  Payload ID: 11387
  Gene Symbol: NUMA1
  Gene Name: nuclear mitotic apparatus protein 1
  Uniprot ID: Q14980
  ENSP ID: ENSP00000480172

SEQ ID NO: 58160 - protein, 2099 aa, Homo sapiens
  Payload ID: 11387
  Gene Symbol: NUMA1
  Gene Name: nuclear mitotic apparatus protein 1
  ENSP ID: ENSP00000481541
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEEGCACCRQRQPATVPELQNAALLCGRRCRASGREKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 58161 - protein, 1156 aa, Homo sapiens
  Payload ID: 11388
  Gene Symbol: NPAP1
  Gene Name: nuclear pore associated protein 1
  Uniprot ID: Q9NZP6
  ENSP ID: ENSP00000333735
MGNLLSKFRPGCRRRPLPGPGRGAPAPLSRDASPPGRAHSVPTPRPFRGLFRRNARRRPSAASIFVAPKRPCPLPRAAAAPLGVLPAVGWGLAIRKTPMLPARNPPRFGHPSSVRIPPPSRMFTLLLPSPREPAVKARKPIPATLLEETEVWAQEGPRRVKKDEDPVQIEGEDDEKRTPLSSGEASSTSRSQGTQGDVASFRCSPGPLEGNVYHKFSENSMSEKAQASPASSCLEGPAMPSTHSQAGCARHLGKPDPDATAPPEPAVGCSLLQQKLAAEVLNEEPPPSSLGLPIPLMSGKRMPDEKPFCIPPRSAAPPRAARNRPCKRKMSIPLLLPLPPSLPLLWDRGELPPPAKLPCLSVEGDLHTLEKSPEYKRNSRILEDKTETMTNSSITQPAPSFSQPVQTTDSLPLTTYTSQVSAPLPIPDLADLATGPLILPIPPLSTTPKMDEKIAFTIPNSPLALPADLVPILGDQSNEKGGSYNSVVGAAPLTSDPPTPPSSTPSFKPPVTRESPISMCVDSPPPLSFLTLLPVPSTGTSVITSKPMNSTSVISTVTTNASAHLTSQTAVDPEVVNMDTTAPSQVVIFTSSLSSRVSSLPNSQIHCSAEQRHPGKTSVYTSPLPFIFHNTTPSFNQLFGKEATPQPKFEAPDGQPQKASLPSACVFLSLPIIPPPDTSTLVNSASTASSSKPPIETNAMHTTPPSKAVILQSASVSKKYLPFYLGLPGSGNTQPSGNTASVQGSTSLPAQSVRAPATASNHPLNPGATPQPKFGAPDGPQQKTSLPSAHDFLSLPIMVPPDTSTLVSSASAASLSKPAIDTSDMNTTPPSKTVILQSTFVSRKEEYIRFYMGLPGSGNTLHSDSIASAQVSTSFPAQADRRPTTTSSHPLNTGSISHSTLGATDGQQKSDSSFILGNPATPAPVIGLTSPSVQPLSGSIIPPGFAELTSPYTALGTPVNAEPVEGHNASAFPNGTAKTSGFRIATGMPGTGDSTLLVGNTIPGPQVIMGPGTPMDGGSIGFSMSAPGPSSTSGELNIGQGQSGTPSTTSVFPFGQAAWDPTGHSMAAAPQGASNIPVFGYTSAAAYIPGLDPPTQNSCSGMGGDGTRSIVGGPCVPAFQQCILQHTWTERKFYTSSTHYYGQETYVRRHVCFQLP

SEQ ID NO: 58162 - protein, 350 aa, Homo sapiens
  Payload ID: 11389
  Gene Symbol: NPIPA1
  Gene Name: nuclear pore complex interacting protein family, member A1
  Uniprot ID: Q9UND3
  ENSP ID: ENSP00000331843
MFCCLGYEWLSGGCKTWHSAWVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRVRMAAVEHRHSSGLPYWPYLTAETLKNRMGHQPPPPTQQHSIIDNSLSLKTPSECLLTPLPPSALPSADDNLKTPAECLLYPLPPSADDNLKTPPECLLTPLPPSAPPSVDDNLKTPPECVCSLPFHPQRMIISRN

SEQ ID NO: 58163 - protein, 219 aa, Homo sapiens
  Payload ID: 11389
  Gene Symbol: NPIPA1
  Gene Name: nuclear pore complex interacting protein family, member A1
  ENSP ID: ENSP00000410814
MRVRWLLFWLLFWLLLGFISHQSTCVSRWVLWLLFWLLLGFISHQSTCVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALR

SEQ ID NO: 58164 - protein, 185 aa, Homo sapiens
  Payload ID: 11389
  Gene Symbol: NPIPA1
  Gene Name: nuclear pore complex interacting protein family, member A1
  ENSP ID: ENSP00000445593
  MOD_RES (1)..(1): Any amino acid
XTKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRVSLLVFLAFGHSLPGQDMDTFFSLRLCAQALQREMAERKAAYKHHSPIPVGNRVAQKHLHPHPVGPPSNILSVRGSVFVIANGP

SEQ ID NO: 58165 - protein, 232 aa, Homo sapiens
  Payload ID: 11389
  Gene Symbol: NPIPA1
  Gene Name: nuclear pore complex interacting protein family, member A1
  ENSP ID: ENSP00000484994
MFCCLGYEWLSGGCKTWHSAWVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRCTYNLVLPGSEKKYYSHA

SEQ ID NO: 58166 - protein, 369 aa, Homo sapiens
  Payload ID: 11389
  Gene Symbol: NPIPA1
  Gene Name: nuclear pore complex interacting protein family, member A1
  ENSP ID: ENSP00000487754
MFCCLGYEWLSGGCKTWHSAWVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRVRMAAVEHRHSSGLPYWPYLTAETLKNRMGHQPPPPTQQHSIIDNSLSLKTPSERLLYPLPPSADDNLKTPPECLLTPLPPSALPSADDNLKTPAECLLYPLPPSADDNLKTPPECLFTPLPPSAPPSVDDNLKTPPECVCSLPFHPQRMIISRN

SEQ ID NO: 58167 - protein, 218 aa, Homo sapiens
  Payload ID: 11389
  Gene Symbol: NPIPA1
  Gene Name: nuclear pore complex interacting protein family, member A1
  ENSP ID: ENSP00000487760
RVRWLLFWLLFWLLLGFISHQSTCVSRWVLWLLFWLLLGFISHQSTCVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALR

SEQ ID NO: 58168 - protein, 185 aa, Homo sapiens; identical to SEQ ID NO: 58164
  Payload ID: 11389
  Gene Symbol: NPIPA1
  Gene Name: nuclear pore complex interacting protein family, member A1
  ENSP ID: ENSP00000488834
  MOD_RES (1)..(1): Any amino acid

SEQ ID NO: 58169 - protein, 369 aa, Homo sapiens
  Payload ID: 11390
  Gene Symbol: NPIPA2
  Gene Name: nuclear pore complex interacting protein family, member A2
  Uniprot ID: E9PIF3
  ENSP ID: ENSP00000432029
MVKLSIVLTPRFLSHDQGQLTKELQQHVKSVTCPCEYLRKVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKICKMKVTTKVNRHDKINGKRKTAKEHLRKLSMKEREHGEKERQVSEAEENGKLDMKEIHTYMEMFQRAQALRRRAEDYYRCKITPSARKPLCNRVRMAAAEHRHSSGLPYWPYLTAETLKNRMGHQPPPPTQQHSIIDNSLSLKTPPECLLTPLPPSALPSADDNLKTPAECLLYPLPPSADDNLKTPPECLLTPLPPSAPPSADDNLKTPPKCVCSLPFHPQRMIISRN

SEQ ID NO: 58170 - protein, 317 aa, Homo sapiens
  Payload ID: 11390
  Gene Symbol: NPIPA2
  Gene Name: nuclear pore complex interacting protein family, member A2
  ENSP ID: ENSP00000432767
MVKLSIVLTPRFLSHDQGQLTKELQQHVKSVTCPCEYLRKVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKICKMKVTTKVNRHDKINGKRKTAKEHLRKLSMKEREHGEKERQVSEAEENGKLDMKEIHTYMEMFQRAQALRRRAEDYYRCKITPSARKPLCNRVSLLVFLAFGHSLPGQDMDTFFSLRLCAQALQREMAERKAAYKHHSPIPVGNRVAQKHLHPHPVGPPSNILSVRGSVFVIANGP

SEQ ID NO: 58171 - protein, 350 aa, Homo sapiens
  Payload ID: 11390
  Gene Symbol: NPIPA2
  Gene Name: nuclear pore complex interacting protein family, member A2
  ENSP ID: ENSP00000446882
MFCCLGYEWLSGGCKTWHSAWVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKICKMKVTTKVNRHDKINGKRKTAKEHLRKLSMKEREHGEKERQVSEAEENGKLDMKEIHTYMEMFQRAQALRRRAEDYYRCKITPSARKPLCNRVRMAAAEHRHSSGLPYWPYLTAETLKNRMGHQPPPPTQQHSIIDNSLSLKTPPECLLTPLPPSALPSADDNLKTPAECLLYPLPPSADDNLKTPPECLLTPLPPSAPPSADDNLKTPPKCVCSLPFHPQRMIISRN

SEQ ID NO: 58172 - protein, 317 aa, Homo sapiens; identical to SEQ ID NO: 58170
  Payload ID: 11391
  Gene Symbol: NPIPA3
  Gene Name: nuclear pore complex interacting protein family, member A3
  ENSP ID: ENSP00000434172

SEQ ID NO: 58173 - protein, 369 aa, Homo sapiens
  Payload ID: 11391
  Gene Symbol: NPIPA3
  Gene Name: nuclear pore complex interacting protein family, member A3
  ENSP ID: ENSP00000437133
MVKLSIVLTPRFLSHDQGQLTKELQQHVKSVTCPCEYLRKVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKICKMKVTTKVNRHDKINGKRKTAKEHLRKLSMKEREHGEKERQVSEAEENGKLDMKEIHTYMEMFQRAQALRRRAEDYYRCKITPSARKPLCNRVRMAAAEHRHSSGLPYWPYLTAETLKNRMGHQPPPPTQQHSIIDNSLSLKTPPECLLTPLPPSALPSADDNLKTPAECLLYPLPPSADDNLKTPPECLLTPLPPSAPPSVDDNLKTPPKCVCSLPFHPQRMIISRN

SEQ ID NO: 58174 - protein, 350 aa, Homo sapiens
  Payload ID: 11391
  Gene Symbol: NPIPA3
  Gene Name: nuclear pore complex interacting protein family, member A3
  Uniprot ID: F8WFD2
  ENSP ID: ENSP00000448841
MFCCLGYEWLSGGCKTWHSAWVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKICKMKVTTKVNRHDKINGKRKTAKEHLRKLSMKEREHGEKERQVSEAEENGKLDMKEIHTYMEMFQRAQALRRRAEDYYRCKITPSARKPLCNRVRMAAAEHRHSSGLPYWPYLTAETLKNRMGHQPPPPTQQHSIIDNSLSLKTPPECLLTPLPPSALPSADDNLKTPAECLLYPLPPSADDNLKTPPECLLTPLPPSAPPSVDDNLKTPPKCVCSLPFHPQRMIISRN

SEQ ID NO: 58175 - protein, 350 aa, Homo sapiens
  Payload ID: 11391
  Gene Symbol: NPIPA3
  Gene Name: nuclear pore complex interacting protein family, member A3
  ENSP ID: ENSP00000479725
MFCCLGYEWLSGGCKTWHSAWVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKICKMKVTTKVNRHDKINGKRKTAKEHLRKLSMKEREHGEKERQVSEAEENGKLDMKEIHTYMEMFQRAQALRRRAEDYYRCKITPSARKPLCNRVRMAAAEHRHSSGLPYWPYLTAETLKNRMGHQPPPPTQQHSIIDNSLSLKTPPECLLYPLPPSADDNLKTPPECLLTPLPPSAPPSADDNLKTPPECLLTPLPPSAPPSADDNLKTPPKCVCSLPFHPQRMIISRN

SEQ ID NO: 58176 - protein, 350 aa, Homo sapiens; identical to SEQ ID NO: 58171
  Payload ID: 11391
  Gene Symbol: NPIPA3
  Gene Name: nuclear pore complex interacting protein family, member A3
  ENSP ID: ENSP00000483111

SEQ ID NO: 58177 - protein, 350 aa, Homo sapiens; identical to SEQ ID NO: 58171
  Payload ID: 11391
  Gene Symbol: NPIPA3
  Gene Name: nuclear pore complex interacting protein family, member A3
  ENSP ID: ENSP00000484195

SEQ ID NO: 58178 - protein, 369 aa, Homo sapiens; identical to SEQ ID NO: 58169
  Payload ID: 11391
  Gene Symbol: NPIPA3
  Gene Name: nuclear pore complex interacting protein family, member A3
  ENSP ID: ENSP00000487879

SEQ ID NO: 58179 - protein, 317 aa, Homo sapiens; identical to SEQ ID NO: 58170
  Payload ID: 11391
  Gene Symbol: NPIPA3
  Gene Name: nuclear pore complex interacting protein family, member A3
  ENSP ID: ENSP00000488574

SEQ ID NO: 58180 - protein, 350 aa, Homo sapiens
  Payload ID: 11392
  Gene Symbol: NPIPA5
  Gene Name: nuclear pore complex interacting protein family, member A5
  Uniprot ID: E9PKD4
  ENSP ID: ENSP00000433597
MFCCLGYEWLSGGCKTWHSAWVINTLADHRHRGTDFGGSPWLLIITVFLRSYKFAISLCTSYLCVSFLKTIFPSQNGHDGSTDVQQRARRSNCRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRVRMAAVEHRHSSGLPYWPYLTAETLKNRMGHQPPPPTQQHSIIDNSLSLKTPSERLLYPLPPSADDNLKTPPECLLTPLPPSALPSADDNLKTPAECLLTPLPPSAPPSADDNLKTPPECVCSLPFHPQRMIISRN

SEQ ID NO: 58181 - protein, 317 aa, Homo sapiens
  Payload ID: 11392
  Gene Symbol: NPIPA5
  Gene Name: nuclear pore complex interacting protein family, member A5
  ENSP ID: ENSP00000435611
MVKLSIVLTPRFLSHDQGQLTKELQQHVKSVTCPCEYLRKVINTLADHRHRGTDFGGSPWLLIITVFLRSYKFAISLCTSYLCVSFLKTIFPSQNGHDGSTDVQQRARRSNCRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRVSLLVFLAFGHSLPGQDMDTFFSLRLCAQALQREMAERKAAYKHHSPIPVGNRVAQKHLHPHPVGPPSNILSVRGSIFVIANGP

SEQ ID NO: 58182 - protein, 232 aa, Homo sapiens; identical to SEQ ID NO: 1177
  Payload ID: 11392
  Gene Symbol: NPIPA5
  Gene Name: nuclear pore complex interacting protein family, member A5
  Uniprot ID: E9PKD4
  ENSP ID: ENSP00000441072

SEQ ID NO: 58183 - protein, 350 aa, Homo sapiens
  Payload ID: 11392
  Gene Symbol: NPIPA5
  Gene Name: nuclear pore complex interacting protein family, member A5
  ENSP ID: ENSP00000488135
MFCCLGYEWLSGGCKTWHSAWVINTLADHRHRGTDFGGSPWLLIITVFLRSYKFAISLCTSYLCVSFLKTIFPSQNGHDGSTDVQQRARRSNCRRQEGIKIVLEDIFTLWRQVETKVRAKIRKMKVTTKVNCHDKINGKRKTAKEHLRKLSMKEREHGEKERQVSEAEENGKLDMKEIHTYMEMFQRARALRRRAEDYYRCKITPSARKPLCNRVRMAAVEHRHSSGLPYWPYLTAETLKNRMGHQPPPPTQQHSIIDNSLSLKTPSERLLYPLPPSADDNLKTPPECLLTPLPPSALPSADDNLKTPAECLLTPLPPSAPPSADDNLKTPPECVCSLPFHPQRMIISRN

SEQ ID NO: 58184 - protein, 56 aa, Homo sapiens
  Payload ID: 11393
  Gene Symbol: NPIPA7
  Gene Name: nuclear pore complex interacting protein family, member A7
  ENSP ID: ENSP00000343256
  MOD_RES (1)..(1): Any amino acid
XKWEIGYERNTHLHGNVSTCASVAAAGRGLLQMQNHPFCKKASLQPVHLQFGITWE

SEQ ID NO: 58185 - protein, 369 aa, Homo sapiens
  Payload ID: 11393
  Gene Symbol: NPIPA7
  Gene Name: nuclear pore complex interacting protein family, member A7
  Uniprot ID: E9PJI5
  ENSP ID: ENSP00000431814
MFCCLGYEWLSGGCTTWHSAWVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKIRKMKVTTKVNRHDKINGKRKTAKEHLRKLSMKEREHREEERQVSEAEENGKLDMKEIHTYMEMFQRAQALRRRAEDYYRCKITPSARKPLCNRVRMAAVEHRHSSGLPYWPYLTAETLKNRMGHQPPPPTQQHSIIDNSLSLKTPSECVLYPLPPSADDNLKTPPECLLTPLPPSALPSADDNLKTPAECLLYPLPPSADDNLKTPPECLLTPLPPSAPPSADDNLKTPPECVCSLPFHPQRMIISRN

SEQ ID NO: 58186 - protein, 369 aa, Homo sapiens; identical to SEQ ID NO: 58185
  Payload ID: 11393
  Gene Symbol: NPIPA7
  Gene Name: nuclear pore complex interacting protein family, member A7
  Uniprot ID: E9PJI5
  ENSP ID: ENSP00000479584

SEQ ID NO: 58187 - protein, 369 aa, Homo sapiens; identical to SEQ ID NO: 58185
  Payload ID: 11394
  Gene Symbol: NPIPA8
  Gene Name: nuclear pore complex interacting protein family, member A8
  Uniprot ID: P0DM63
  ENSP ID: ENSP00000435325

SEQ ID NO: 58188 - protein, 369 aa, Homo sapiens; identical to SEQ ID NO: 58185
  Payload ID: 11394
  Gene Symbol: NPIPA8
  Gene Name: nuclear pore complex interacting protein family, member A8
  Uniprot ID: P0DM63
  ENSP ID: ENSP00000438887

SEQ ID NO: 58189 - protein, 130 aa, Homo sapiens
  Payload ID: 11394
  Gene Symbol: NPIPA8
  Gene Name: nuclear pore complex interacting protein family, member A8
  ENSP ID: ENSP00000439498
  MOD_RES (1)..(1): Any amino acid
XIKIVLEDIFTLWRQVETKVRAKIRKMKVTTKVNRHDKINGKRKTAKEHLRKLSMKEREHREEERQVSEAEENGKLDMKEIHTYMEMFQRAQALRRRAEDYYRCKITPSARKPLCNRCTYNLVLPGSEKK

SEQ ID NO: 58190 - protein, 1161 aa, Homo sapiens
  Payload ID: 11395
  Gene Symbol: NPIPB11
  Gene Name: nuclear pore complex interacting protein family, member B11
  Uniprot ID: E5RHQ5
  ENSP ID: ENSP00000430853
MVKLSIVLTPQFLSHDQGQLTKELQQHVKSVTCPCEYLRKVINTLADHHHRGTDFGGSPWLHIIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINRHDKINGKRKTARKQKMFQRAQELRRRAEDYHKCKIPPSARKALCNWVRMAAAEHRHSSGLPYWPYLTAETLKNRMGHQPPPPTQQHCITDNSLSLKTPLECLLTPLPPSADDNLKTPPECLLTPLPPSADDNLKTPPECLLTPLPPSAPPSAPPSADDNLKTRAECLLHPLPPSADDNLKTPSERQLTPLPPSAPPSADDNIKTTAERLRGPLPPSADDNLKTPSERQLTPLPPSAPPSADDNIKTPAEHLRGPLPPSADDNLKTPSERQLTPLPPSAPPSADDNIKTPAERLRGPLPPSADDNLKTPSERQLTPLPPSAPPSADDNIKTPAEHLRGPLPPSADDNLKTPSERQLTPLPPSAPPSADDNIKTTAEHLRGPLPPSADDNLKTPSERQLTPLPPSAPPSADDNIKTPAEHLQFRFHPQRMIISRDLPSVSSLPFHPQLHPQQMIISRYLLSICGFRFHRQRMIISRHLPSVSSLPFHPQLHPQQMIISRHLPSVCGGRFHPQPMIISRHLPSVSSLPFHPQLHPQQMIISRHLPSVCGGRFHPQPMIISRHLPSVSSLPFHPQLHPQQMIISRHLPSVCGGRFHPQPMIISRHLPSVSSLPFHPQLHPQQMIISRHLPSVCGGRFHPQPMIISRHLPSVSSLPFHPQLHPQQMIISRHLPSVCGGRFHPQPMIISRHLPSVSSLPFHPQLHPQQMIISRHLPSVCGERLWVPLPPSADDNLKTPSKRQLTPLPPSAPPSADDNIKTPAERLRGPLPPSADDNLKTPSKRQLTPLPPSAPPSADDNIKTPAERLRGPLPPSADDNLKTPSERQLTPLPPSAPPSADDNIKTPAERLRGPLPPSADDNLKTPSERQLTPLPPSAPTSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRLS

SEQ ID NO: 58191 - protein, 250 aa, Homo sapiens
  Payload ID: 11395
  Gene Symbol: NPIPB11
  Gene Name: nuclear pore complex interacting protein family, member B11
  ENSP ID: ENSP00000479201
MRGRWMLFWLLFGLLLEFISHQCIRVINTLADHHHRGTDFGGSPWLHIIIAFPTSYKVVITLWIVYLWVSLLKTIFWSRNGHDGSTDVQQRAWRSNRRRQEGNKIGLKDVITLRRHVETKVRAKIRKRKVTTKINRHDKINGKRKTARKQKMFQRAQELRRRAEDYHKCKIPPSARKALCNWVSLLVFLAFGHSLPGQDMDTFFSLQLCAQALQREMAERKAAYKHHSPIPVGNRVAQKHLHPHPVGPLI

SEQ ID NO: 58192 - protein, 443 aa, Homo sapiens
  Payload ID: 11396
  Gene Symbol: NPIPB15
  Gene Name: nuclear pore complex interacting protein family, member B15
  Uniprot ID: A6NHN6
  ENSP ID: ENSP00000411140
MRLRFWLLIWLLLGFISHQPTPVINSLAVYRHRETDFGVGVRDHPGQHGKTPSPQKLDNLIIIIIGFLRRDTFTILFCTSYLCVSFLKTIFWSRNGHDGSTDVQQRAWRSNRSRQKGLRSICMHTKKRVSSFRGNKIGLKDVITLRRHVETKVRAKIRKRKVTTKINRHDKINGKRKTARKQKMFQRAQELRRRAEDYHKCKIPPSARKPLCNWVRMAAAEHRHSSGLPCWPYLTAEALKNRMGRQPPPPTQQHSITDNSLSLKTPPECLLHPLPPSVDDNIKECPLAPLPPSVDDNLKEYLLVPLPPSPLPPSVDDNLKDCLFVPLPPSPLPPSVDDNLKTPPLATQEAEAEKPPKPKRWRVDEVEQSPKPKRRRADEVEQSPKPKRQREAEAQQLPKPKRRRLSKLRTRHCTQAWAIRINPWVEKKKKIKKQNKTHAPKTN

SEQ ID NO: 58193 - protein, 250 aa, Homo sapiens [sequence omitted]

SEQ ID NO: 58194 - protein, 251 aa, Homo sapiens
  Payload ID: 11397
  Gene Symbol: NPIPB3
  Gene Name: nuclear pore complex interacting protein family, member B3
  ENSP ID: ENSP00000413141
MPMRVPEEVTLRNPGSSGRKERPEAGTGSWLGRTRNQVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQH

SEQ ID NO: 58195 - protein, 97 aa, Homo sapiens
  Payload ID: 11397
  Gene Symbol: NPIPB3
  Gene Name: nuclear pore complex interacting protein family, member B3
  ENSP ID: ENSP00000436028
MFCCLGYEWLSGGCKTWHSAWVINTLADHHHRGTDFGGSPWLHVIIAFPTSYKVVITLWIVYLWVSLLKTIFWSRNGHDGSTDVQQRAWRSNRRRQE

SEQ ID NO: 58196 - protein, 104 aa, Homo sapiens
  Payload ID: 11397
  Gene Symbol: NPIPB3
  Gene Name: nuclear pore complex interacting protein family, member B3
  ENSP ID: ENSP00000439062
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQ

SEQ ID NO: 58197 - protein, 420 aa, Homo sapiens
  Payload ID: 11397
  Gene Symbol: NPIPB3
  Gene Name: nuclear pore complex interacting protein family, member B3
  Uniprot ID: Q92617
  ENSP ID: ENSP00000444096
MAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLLTPLPPSALPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 58198 - protein, 358 aa, Homo sapiens
  Payload ID: 11397
  Gene Symbol: NPIPB3
  Gene Name: nuclear pore complex interacting protein family, member B3
  ENSP ID: ENSP00000446048
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLLTPLPPSALPSA

SEQ ID NO: 58199 - protein, 162 aa, Homo sapiens
  Payload ID: 11398
  Gene Symbol: NPIPB4
  Gene Name: nuclear pore complex interacting protein family, member B4
  ENSP ID: ENSP00000339196
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIVLKDVITLRRHVETKVRAKIRKRKV

SEQ ID NO: 58200 - protein, 1138 aa, Homo sapiens
  Payload ID: 11398
  Gene Symbol: NPIPB4
  Gene Name: nuclear pore complex interacting protein family, member B4
  Uniprot ID: C9JG80
  ENSP ID: ENSP00000404439
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIVLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDKLKTPPECLLTPLPPSALPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAFHPQRMIISRHLPSVSSLPFHPQLHPQQMIISRYLLSVCGFRFHHQPMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 58201 - protein, 49 aa, Homo sapiens
  Payload ID: 11398
  Gene Symbol: NPIPB4
  Gene Name: nuclear pore complex interacting protein family, member B4
  ENSP ID: ENSP00000429523
MVKLSIVLTPQFLSHDQGQLTKELQQHVKSVTCPCEYLRKVDGRMATWM

SEQ ID NO: 58202 - protein, 148 aa, Homo sapiens
  Payload ID: 11398
  Gene Symbol: NPIPB4
  Gene Name: nuclear pore complex interacting protein family, member B4
  ENSP ID: ENSP00000429543
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIVLKDVITLRRH

SEQ ID NO: 58203 - protein, 49 aa, Homo sapiens; identical to SEQ ID NO: 58201
  Payload ID: 11398
  Gene Symbol: NPIPB4
  Gene Name: nuclear pore complex interacting protein family, member B4
  ENSP ID: ENSP00000433301

SEQ ID NO: 58204 - protein, 420 aa, Homo sapiens [sequence omitted]

SEQ ID NO: 58205 - protein, 49 aa, Homo sapiens; identical to SEQ ID NO: 58201
  Payload ID: 11398
  Gene Symbol: NPIPB4
  Gene Name: nuclear pore complex interacting protein family, member B4
  ENSP ID: ENSP00000439720

SEQ ID NO: 58206 - protein, 90 aa, Homo sapiens
  Payload ID: 11398
  Gene Symbol: NPIPB4
  Gene Name: nuclear pore complex interacting protein family, member B4
  ENSP ID: ENSP00000439732
MFCCLGYEWLSGGCKTWHSAWVINTLADHHHRGTDFGGSPWLHVIIAFPTSYKVVITLWIVYLWVSLLKTIFWSRNGHDGSTDVQQRAWR

SEQ ID NO: 58207 - protein, 29 aa, Homo sapiens
  Payload ID: 11398
  Gene Symbol: NPIPB4
  Gene Name: nuclear pore complex interacting protein family, member B4
  ENSP ID: ENSP00000442065
MVKLSIVLTPQFLSHDQGQLTKELQQHVK

SEQ ID NO: 58208 - protein, 40 aa, Homo sapiens
  Payload ID: 11398
  Gene Symbol: NPIPB4
  Gene Name: nuclear pore complex interacting protein family, member B4
  ENSP ID: ENSP00000442776
MVKLSIVLTPQFLSHDQGQLTKELQQHVKSVTCPCEYLRK

SEQ ID NO: 58209 - protein, 27 aa, Homo sapiens
  Payload ID: 11398
  Gene Symbol: NPIPB4
  Gene Name: nuclear pore complex interacting protein family, member B4
  ENSP ID: ENSP00000443445
MVKLSIVLTPQFLSHDQGQLTKELQQH

SEQ ID NO: 58210 - protein, 250 aa, Homo sapiens
  Payload ID: 11398
  Gene Symbol: NPIPB4
  Gene Name: nuclear pore complex interacting protein family, member B4
  ENSP ID: ENSP00000477616
MRVRWMLFWLLFGLLLEFISHQCISVINTLADHHHRGTDFGGSPWLHVIIAFPTSYKVVITLWIVYLWVSLLKTIFWSRNGHDGSTDVQQRAWRSNRRRQEGNKIVLKDVITLRRHVETKVRAKIRKRKVTTKINHHDKINGKRKTARKQKMFQRAQELRRRAEDYHKCKIPPSARKALCNWVSLLVFLAFGHSLPGQDMDTFFSLQLCAQALQREMAERKAAYKHHSPIPVGNRVAQKHLHPHPVGPLI

SEQ ID NO: 58211 - protein, 420 aa, Homo sapiens; identical to SEQ ID NO: 58197
  Payload ID: 11399
  Gene Symbol: NPIPB5
  Gene Name: nuclear pore complex interacting protein family, member B5
  ENSP ID: ENSP00000349936

SEQ ID NO: 58212 - protein, 1126 aa, Homo sapiens [sequence omitted]

SEQ ID NO: 58213 - protein, 49 aa, Homo sapiens; identical to SEQ ID NO: 58201
  Payload ID: 11399
  Gene Symbol: NPIPB5
  Gene Name: nuclear pore complex interacting protein family, member B5
  ENSP ID: ENSP00000428548

SEQ ID NO: 58214 - protein, 49 aa, Homo sapiens; identical to SEQ ID NO: 58201
  Payload ID: 11399
  Gene Symbol: NPIPB5
  Gene Name: nuclear pore complex interacting protein family, member B5
  ENSP ID: ENSP00000429898

SEQ ID NO: 58215 - protein, 1133 aa, Homo sapiens
  Payload ID: 11399
  Gene Symbol: NPIPB5
  Gene Name: nuclear pore complex interacting protein family, member B5
  Uniprot ID: A8MRT5
  ENSP ID: ENSP00000430633
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLLTPLPPSALPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTALPPSADDNIKTPAERLRGPLPPSADDNLKTPSERQLTPLPPSAPPSADDNIKTPAFHPQRMISRHLPSVSSLPFHPQLHPQQMIISRYLLSVCGFRFHHQPMIISRHLPSVSSLPFHPQLHPQQMIISRHLPSVCGGRFHPERMIISRHLPSVSSLPFHPQLHPQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGGRFHPQQMIISRHLPSVSSLPFHPQLHPQQMIISRHLPSVCGGRFHPQRMIISRHLPSVSSLPFHPQLHPQQMIISRHLPSVCGERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPPLATQEAEAEKPRKPKRQRAAEMEPPPEPKRRRVGDVEPSRKPKRRRAADVEPSSPEPKRRRVGDVEPSRKPKRRRAADVEPSSPEPKRRRVGDVEPSRKPKRRRAADVEPSLPEPKRRRLS

SEQ ID NO: 58216 - protein, 595 aa, Homo sapiens
  Payload ID: 11399
  Gene Symbol: NPIPB5
  Gene Name: nuclear pore complex interacting protein family, member B5
  ENSP ID: ENSP00000431553
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLRSICMHTKKRVSSFRGNKIGLKDVITLRRHVETKVRAKIRKRKVTTKINHHDKINGKRKTARKQKMFQRAQELRRRAEDYHKCKIPPSARKALCNWVRMAAAEHRHSSGLPYWPYLTAETLKNRMGHQPPPPTQQHSITDNSLSLKTPPECLLTPLPPSADDNLKTPPECVLTPLPPSADDNLKTPPECVLTPLPPSADDNLKTPPECLLTPLPPSADDNLKTPPECLLTPLPPSALPSAPPSADDNLKTRAECLLHPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTPLPPSAPPSADDNIKTPAERLRGPLPPSADDNLKTPSERQLTALPPSADDNIKTPAERLRGPLPPSADDNLKTPSERQLTPLPPSAPPSADDNIKTPAFHPQRMISRHLPSVSSLPF

SEQ ID NO: 58217 - protein, 40 aa, Homo sapiens; identical to SEQ ID NO: 58208
  Payload ID: 11399
  Gene Symbol: NPIPB5
  Gene Name: nuclear pore complex interacting protein family, member B5
  ENSP ID: ENSP00000439898

SEQ ID NO: 58218 - protein, 11 aa, Homo sapiens
  Payload ID: 11399
  Gene Symbol: NPIPB5
  Gene Name: nuclear pore complex interacting protein family, member B5
  ENSP ID: ENSP00000440137
MVKLSIVLTPQ

SEQ ID NO: 58219 - protein, 49 aa, Homo sapiens; identical to SEQ ID NO: 58201
  Payload ID: 11399
  Gene Symbol: NPIPB5
  Gene Name: nuclear pore complex interacting protein family, member B5
  ENSP ID: ENSP00000440316

SEQ ID NO: 58220 - protein, 1133 aa, Homo sapiens; identical to SEQ ID NO: 58215
  Payload ID: 11399
  Gene Symbol: NPIPB5
  Gene Name: nuclear pore complex interacting protein family, member B5
  Uniprot ID: A8MRT5
  ENSP ID: ENSP00000440703

SEQ ID NO: 58221 - protein, 78 aa, Homo sapiens
  Payload ID: 11399
  Gene Symbol: NPIPB5
  Gene Name: nuclear pore complex interacting protein family, member B5
  ENSP ID: ENSP00000441303
MVKLSIVLTPQFLSHDQGQLTKELQQHVKSVTCPCEYLRKVINTLADHHHRGTDFGGSPWLHVIIAFPTSYKVVITLW

SEQ ID NO: 58222 - protein, 40 aa, Homo sapiens; identical to SEQ ID NO: 58208
  Payload ID: 11399
  Gene Symbol: NPIPB5
  Gene Name: nuclear pore complex interacting protein family, member B5
  ENSP ID: ENSP00000441759

SEQ ID NO: 58223 - protein, 104 aa, Homo sapiens; identical to SEQ ID NO: 58196
  Payload ID: 11399
  Gene Symbol: NPIPB5
  Gene Name: nuclear pore complex interacting protein family, member B5
  ENSP ID: ENSP00000442912

SEQ ID NO: 58224 - protein, 119 aa, Homo sapiens
  Payload ID: 11399
  Gene Symbol: NPIPB5
  Gene Name: nuclear pore complex interacting protein family, member B5
  ENSP ID: ENSP00000442935
MVKLSIVLTPQFLSHDQGQLTKELQQHVKSVTCPCEYLRKVINTLADHHHRGTDFGGSPWLHVIIAFPTSYKVVITLWIVYLWVSLLKTIFWSRNGHDGSTDVQQRAWRSNRRRQEGLR

SEQ ID NO: 58225 - protein, 13 aa, Homo sapiens
  Payload ID: 11399
  Gene Symbol: NPIPB5
  Gene Name: nuclear pore complex interacting protein family, member B5
  ENSP ID: ENSP00000444299
MVKLSIVLTPQFL

SEQ ID NO: 58226 - protein, 595 aa, Homo sapiens; identical to SEQ ID NO: 58216
  Payload ID: 11399
  Gene Symbol: NPIPB5
  Gene Name: nuclear pore complex interacting protein family, member B5
  ENSP ID: ENSP00000445388

SEQ ID NO: 58227 - protein, 49 aa, Homo sapiens; identical to SEQ ID NO: 58201
  Payload ID: 11399
  Gene Symbol: NPIPB5
  Gene Name: nuclear pore complex interacting protein family, member B5
  ENSP ID: ENSP00000445754

SEQ ID NO: 58228 - protein, 68 aa, Homo sapiens
  Payload ID: 11399
  Gene Symbol: NPIPB5
  Gene Name: nuclear pore complex interacting protein family, member B5
  ENSP ID: ENSP00000449628
HVIIAFPTSYKVVITLWIVYLWVSLLKTIFWSRNGHDGSTDVQQRAWRSNRRRQEGFSPSPLLTLTKG

SEQ ID NO: 58229 - protein, 250 aa, Homo sapiens [sequence omitted]

SEQ ID NO: 58230 - protein, 425 aa, Homo sapiens
  Payload ID: 11400
  Gene Symbol: NPIPB6
  Gene Name: nuclear pore complex interacting protein family, member B6
  Uniprot ID: E9PJ23
  ENSP ID: ENSP00000431871
MVKLSIVLTPQFLSHDQSQLTKELQQHVKSVTCPCEYLRKVINSLAVYRHRETDFGVGVRDHPGQHGKTPSPQKLDNLIIIIIGFLRRYTFNILFCTSCLCVSFLKTIFWSRNGHDGSMDVQQRAWRSNRSRQKGLRSICMHTKKRVSSFRGNKIGLKDVITLRRHVETKVRAKIRKRKVTTKINRHDKINGKRKTARKQKMFQRAQELRRRAEDYHKCKIPPSARKPLCNWVRMVAAEHRHSSGLPYWPYLTAETLKNRMGRQPPPPTQQHSITDNSLSLKTPTECLLTPLPPSVDDNIKECPLAPLPPSPLPPSVDDNLKECLFVPLPPSPLPPSVDDNLKTPPLATQEAEVEKPPKPKRWRVDEVEQSPKPKRRRVDEVEQSPKPKRQREAEAQQLPKPKRRRLSKLRTRHCTQAWAIRINP

SEQ ID NO: 58231 - protein, 407 aa, Homo sapiens
  Payload ID: 11400
  Gene Symbol: NPIPB6
  Gene Name: nuclear pore complex interacting protein family, member B6
  ENSP ID: ENSP00000435924
MRLRFWLLIWLLLGFISHQPTPVINSLAVYRHRETDFGVGVRDHPGQHGKTPSPQKLDNLIIIIIGFLRRYTFNILFCTSCLCVSFLKTIFWSRNGHDGSMDVQQRAWRSNRSRQKGLRSICMHTKKRVSSFRGNKIGLKDVITLRRHVETKVRAKIRKRKVTTKINRHDKINGKRKTARKQKMFQRAQELRRRAEDYHKCKIPPSARKPLCNWVRMVAAEHRHSSGLPYWPYLTAETLKNRMGRQPPPPTQQHSITDNSLSLKTPTECLLTPLPPSVDDNIKECPLAPLPPSPLPPSVDDNLKECLFVPLPPSPLPPSVDDNLKTPPLATQEAEVEKPPKPKRWRVDEVEQSPKPKRRRVDEVEQSPKPKRQREAEAQQLPKPKRRRLSKLRTRHCTQAWAIRINP

SEQ ID NO: 58232 - protein, 414 aa, Homo sapiens
  Payload ID: 11401
  Gene Symbol: NPIPB7
  Gene Name: nuclear pore complex interacting protein family, member B7
  Uniprot ID: O75200
  ENSP ID: ENSP00000405348
MRLRFWLLIWLLLGFISHQPTPVINSLAVYRHRETDFGVGVRDHPGQHGKTPSPQKLDNLIIIIIGFLRRYTFNVLFCTSCLCVSFLKTIFWSRNGHDGSMDVQQRAWRSNRSRQKGLRSICMHTKKRVSSFRGNKIGLKDVITLRRHVETKVRAKIRKRKVTTKINRHDKINGKRKTARKQKMFQRAQELRRRAEDYHKCKIPPSARKPLCNWVRMAAAEHCHSSGLPYWLYLTAETLKNRMGRQPPPPTQQHSITDNSLSLKTPPECLLTPLPPSVDDNIKECPLAPLPPSPLPPSVDDNLKECLFVPLPPSPLPPSVDDNLKECLFVPLPPSPLPPSVDDNLKTPPLATQEAEVEKPPKPKRWRVDEVEQSPKPKRQREAEAQQLPKPKRRRLSKLRTRHCTQAWAIRINP

SEQ ID NO: 58233 - protein, 421 aa, Homo sapiens [sequence omitted]

SEQ ID NO: 58234 - protein, 144 aa, Homo sapiens
  Payload ID: 11402
  Gene Symbol: NPIPB8
  Gene Name: nuclear pore complex interacting protein family, member B8
  ENSP ID: ENSP00000434100
LKDVITLRRHVETKVRAKIRKRKVTTKINRHDKINGKRKTARKQKMFQRAQELRRRAEDYHKCKIPPSARKPLCNWVSLFVFLAFEHSLPGQDMDTFFSLQLCAQALQREMAERKAAYRHHSPIPVGNRVVQKHLHPHPVGPLI

SEQ ID NO: 58235 - protein, 432 aa, Homo sapiens
  Payload ID: 11402
  Gene Symbol: NPIPB8
  Gene Name: nuclear pore complex interacting protein family, member B8
  Uniprot ID: E9PQR5
  ENSP ID: ENSP00000434399
MVKLSIVLTPQFLSHDQGQLTKELQQHVKSVTCPCEYLRKVINSLAVYRHRETDFGVGVRDHPGQHGKTPSPQKLDNLIIIIIGFLRCYTFNILFCTSCLCVSFLKTIFWSRNGHDGSMDVQQRAWRSNRSRQKGLRSICMHTKKRVSSFRGNKIGLKDVITLRRHVETKVRAKIRKRKVTTKINRHDKINGKRKTARKQKMFQRAQELRRRAEDYHKCKIPPSARKPLCNWVRMAAAEHRHSSGLPYWLYLTAETLKNRMGRQPPPPTQQHSITDNSLSLKTPPECLLTPLPPSVDDNIKECPLAPLPPSPLPPSVDDNLKECLFVPLPPSPLPPSVDDNLKECLFVPLPPSPLPPSVDDNLKTPPLATQEAEVEKPPKPKRWRVDEVEQSPKPKRQREAEAQQLPKPKRRRLSKLRTRHCTQAWAIRINP

SEQ ID NO: 58236 - protein, 314 aa, Homo sapiens
  Payload ID: 11403
  Gene Symbol: NPIPB9
  Gene Name: nuclear pore complex interacting protein family, member B9
  ENSP ID: ENSP00000350444
MDVQQRAWRSNRSRQKGLRSICMHTKKRVSSFRGNKIGLKDVITLRRHVETKVRAKIRKRKVTTKINRHDKINGKRKTARKQKMFQRAQELRRRAEDYHKCKIPPSARKPLCNWVRMAAAEHRHSSGLPYWLYLTAETLKNRMGRQPPPPTQQHSITDNSLSLKTPPECLLTPLPPSVDDNIKECPLAPLPPSPLPPSVDDNLKECLFVPLPPSPLPPSVDDNLKECLFVPLPPSPLPPSVDDNLKTPPLATQEAEVEKPPKPKRWRVDEVEQSPKPKRQREAEAQQLPKPKRRRLSKLRTRHCTQAWAIRINP

SEQ ID NO: 58237 - protein, 429 aa, Homo sapiens
  Payload ID: 11403
  Gene Symbol: NPIPB9
  Gene Name: nuclear pore complex interacting protein family, member B9
  Uniprot ID: F8W1W9
  ENSP ID: ENSP00000446902
MPMRVPEEVTLRNPGSSGRKERPEAGTGSWLGRTRNQVINSLAVYRHRETDFGVGVRDHPGQHGKTPSPQKLDNLIIIIIGFLRRYTFNILFCTSCLCVSFLKTIFWSRNGHDGSMDVQQRAWRSNRSRQKGLRSICMHTKKRVSSFRGNKIGLKDVITLRRHVETKVRAKIRKRKVTTKINRHDKINGKRKTARKQKMFQRAQELRRRAEDYHKCKIPPSARKPLCNWVRMAAAEHRHSSGLPYWLYLTAETLKNRMGRQPPPPTQQHSITDNSLSLKTPPECLLTPLPPSVDDNIKECPLAPLPPSPLPPSVDDNLKECLFVPLPPSPLPPSVDDNLKECLFVPLPPSPLPPSVDDNLKTPPLATQEAEVEKPPKPKRWRVDEVEQSPKPKRQREAEAQQLPKPKRRRLSKLRTRHCTQAWAIRINP

SEQ ID NO: 58238 - protein, 408 aa, Homo sapiens
  Payload ID: 11404
  Gene Symbol: NARF
  Gene Name: nuclear prelamin A recognition factor
  Uniprot ID: Q9UHQ1
  ENSP ID: ENSP00000283996
MKCEHCTRKECSKKTKTDDQENVSADAPSPAQENGEKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSGEIAQIMEQGDLSVRDAAVDTLFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 58239 - protein, 456 aa, Homo sapiens
  Payload ID: 11404
  Gene Symbol: NARF
  Gene Name: nuclear prelamin A recognition factor
  Uniprot ID: Q9UHQ1
  ENSP ID: ENSP00000309899
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSGEIAQIMEQGDLSVRDAAVDTLFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 58240 - protein, 262 aa, Homo sapiens
  Payload ID: 11404
  Gene Symbol: NARF
  Gene Name: nuclear prelamin A recognition factor
  ENSP ID: ENSP00000363739
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSGESQAW

SEQ ID NO: 58241 - protein, 397 aa, Homo sapiens
  Payload ID: 11404
  Gene Symbol: NARF
  Gene Name: nuclear prelamin A recognition factor
  Uniprot ID: Q9UHQ1
  ENSP ID: ENSP00000374656
MTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSGEIAQIMEQGDLSVRDAAVDTLFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 58242 - protein, 503 aa, Homo sapiens
  Payload ID: 11404
  Gene Symbol: NARF
  Gene Name: nuclear prelamin A recognition factor
  ENSP ID: ENSP00000409710
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSPEKIFHVIVAPCYDKKLEALQESLPPALHGSRGADCVLTSGKVLISWWCTPVITATQEAAARESLEPGRQRLQRDKIAPLDSSLGGGGEIAQIMEQGDLSVRDAAVDTLFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 58243 - protein, 502 aa, Homo sapiens
  Payload ID: 11404
  Gene Symbol: NARF
  Gene Name: nuclear prelamin A recognition factor
  ENSP ID: ENSP00000414678
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQVQEEMGSAFPVLPGGSTGWGALQMFGRTTPSPEGGSRQTWMECWCSNLSPEKIFHVIVAPCYDKKLEALQESLPPALHGSRGADCVLTSGEIAQIMEQGDLSVRDAAVDTLFGDLKEDKVTRHDGASSDGHLAHIFRHAAKELFNEDVEEVTYRALRNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEWLEGINSPKAREVLHTTYQSQERGTHSLDIKW

SEQ ID NO: 58244 - protein, 188 aa, Homo sapiens
  Payload ID: 11404
  Gene Symbol: NARF
  Gene Name: nuclear prelamin A recognition factor
  ENSP ID: ENSP00000462006
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGMLPFPSSLQACRFP

SEQ ID NO: 58245 - protein, 37 aa, Homo sapiens
  Payload ID: 11404
  Gene Symbol: NARF
  Gene Name: nuclear prelamin A recognition factor
  ENSP ID: ENSP00000462240
MTAEEGVQLSQQNAKDFFRVLNLNKKCDTSKHKVLVV

SEQ ID NO: 58246 - protein, 217 aa, Homo sapiens
  Payload ID: 11404
  Gene Symbol: NARF
  Gene Name: nuclear prelamin A recognition factor
  ENSP ID: ENSP00000462305
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGWVRYAERVLGRPITAHLCTAKSPQQVMGSLVKDYFARQQNLSPEKIFHVIVAPCYDKKLEALQESLPPALHGSRGADCVLTSGESQAW

SEQ ID NO: 58247 - protein, 262 aa, Homo sapiens
  Payload ID: 11404
  Gene Symbol: NARF
  Gene Name: nuclear prelamin A recognition factor
  ENSP ID: ENSP00000462792
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGWVRYAERVLGRPITAHLCTAKSPQQVMGSLVKDYFARQQNLSPEKIFHVIVAPCYDKKLEALQESLPPALHGSRGADCVLTSGEIAQIMEQGDLSVRDAAVDTLFGDLKEDKVTRHDGASSDGHLAHIFRHAA

SEQ ID NO: 58248 - protein, 167 aa, Homo sapiens
  Payload ID: 11404
  Gene Symbol: NARF
  Gene Name: nuclear prelamin A recognition factor
  ENSP ID: ENSP00000462970
  MOD_RES (1)..(1): Any amino acid
XNLSPEKIFHVIVAPCYDKKLEALQESLPPALHGSRGADCVLTSGEIAQIMEQGDLSVRDAAVDTLNKDFQEVTLEKNGEVVLRFAAAYGFRNIQNMILKLKKGKFPFHFVEVLACAGGCLNGRGQAQTPDGHADKALLRQMEGIYADIPVRRPESSAHVQELYQEW

SEQ ID NO: 58249 - protein, 143 aa, Homo sapiens
  Payload ID: 11404
  Gene Symbol: NARF
  Gene Name: nuclear prelamin A recognition factor
  ENSP ID: ENSP00000463087
MKCEHCTRKECSKKTKTDDQENVSADAPSPAQENGEKGEFHKLADAKIFLSDCLACDSCMTAEEGVQLSQQNAKDFFRVLNLNKKCDTSKHKVLVVSVCPQSLPYFAAKFNLSVTDASRRLCGFLKSLGMLPFPSSLQACRFP

SEQ ID NO: 58250 - protein, 86 aa, Homo sapiens
  Payload ID: 11404
  Gene Symbol: NARF
  Gene Name: nuclear prelamin A recognition factor
  ENSP ID: ENSP00000463347
MTAEEGVQLSQQNAKDFFRVLNLNKKCDTSKHKVLVVSVCPQSLPYFAAKFNLSVTDASRRLCGFLKSLGVHYVFDTTIAADFSIL

SEQ ID NO: 58251 - protein, 99 aa, Homo sapiens
  Payload ID: 11404
  Gene Symbol: NARF
  Gene Name: nuclear prelamin A recognition factor
  ENSP ID: ENSP00000463697
MKCEHCTRKECSKKTKTDDQENVSADAPSPAQENGEASRFFSFVSAQSKLLLLFFSLGAHSTVHITALKKTEVRGHGGSRLESQHFGRPRWTDHLRSGV

SEQ ID NO: 58252 - protein, 158 aa, Homo sapiens
  Payload ID: 11404
  Gene Symbol: NARF
  Gene Name: nuclear prelamin A recognition factor
  ENSP ID: ENSP00000464124
MTAEEGVQLSQQNAKDFFRVLNLNKKCDTSKHKVLVVSVCPQSLPYFAAKFNLSVTDASRRLCGFLKSLGVHYVFDTTIAADFSILESQKEFVRRYRQHSEEERTLPMLTSACPGWVRYAERVLGRPITAHLCTAKSPQQVMGSLVKDYFARQQNLSP

SEQ ID NO: 58253 - protein, 87 aa, Homo sapiens
  Payload ID: 11404
  Gene Symbol: NARF
  Gene Name: nuclear prelamin A recognition factor
  ENSP ID: ENSP00000464644
MTAEEGVQLSQQNAKDFFRVLNLNKKCDTSKHKVLVVSVCPQSLPYFAAKFNLSVTDASRRLCGFLKSLGVHYVFDTTIAADFSILE

SEQ ID NO: 58254 - protein, 99 aa, Homo sapiens; identical to SEQ ID NO: 58251
  Payload ID: 11404
  Gene Symbol: NARF
  Gene Name: nuclear prelamin A recognition factor
  ENSP ID: ENSP00000467119

SEQ ID NO: 58255 - protein, 476 aa, Homo sapiens
  Payload ID: 11405
  Gene Symbol: NARFL
  Gene Name: nuclear prelamin A recognition factor-like
  Uniprot ID: Q9H6Q4
  ENSP ID: ENSP00000251588
MASPFSGALQLTDLDDFIGPSQECIKPVKVEKRAGSGVAKIRIEDDGSYFQINQDGGTRRLEKAKVSLNDCLACSGCITSAETVLITQQSHEELKKVLDANKMAAPSQQRLVVVSVSPQSRASLAARFQLNPTDTARKLTSFFKKIGVHFVFDTAFSRHFSLLESQREFVRRFRGQADCRQALPLLASACPGWICYAEKTHGSFILPHISTARSPQQVMGSLVKDFFAQQQHLTPDKIYHVTVMPCYDKKLEASRPDFFNQEHQTRDVDCVLTTGEVFRLLEEEGVSLPDLEPAPLDSLCSGASAEEPTSHRGGGSGGYLEHVFRHAARELFGIHVAEVTYKPLRNKDFQEVTLEKEGQVLLHFAMAYGFRNIQNLVQRLKRGRCPYHYVEVMACPSGCLNGGGQLQAPDRPSRELLQHVERLYGMVRAEAPEDAPGVQELYTHWLQGTDSECAGRLLHTQYHAVEKASTGLGIRW

SEQ ID NO: 58256 - protein, 374 aa, Homo sapiens
  Payload ID: 11405
  Gene Symbol: NARFL
  Gene Name: nuclear prelamin A recognition factor-like
  Uniprot ID: Q9H6Q4
  ENSP ID: ENSP00000444008
MAAPSQQRLVVVSVSPQSRASLAARFQLNPTDTARKLTSFFKKIGVHFVFDTAFSRHFSLLESQREFVRRFRGQADCRQALPLLASACPGWICYAEKTHGSFILPHISTARSPQQVMGSLVKDFFAQQQHLTPDKIYHVTVMPCYDKKLEASRPDFFNQEHQTRDVDCVLTTGEVFRLLEEEGVSLPDLEPAPLDSLCSGASAEEPTSHRGGGSGGYLEHVFRHAARELFGIHVAEVTYKPLRNKDFQEVTLEKEGQVLLHFAMAYGFRNIQNLVQRLKRGRCPYHYVEVMACPSGCLNGGGQLQAPDRPSRELLQHVERLYGMVRAEAPEDAPGVQELYTHWLQGTDSECAGRLLHTQYHAVEKASTGLGIRW

SEQ ID NO: 58257 - protein, 82 aa, Homo sapiens
  Payload ID: 11405
  Gene Symbol: NARFL
  Gene Name: nuclear prelamin A recognition factor-like
  ENSP ID: ENSP00000455514
MASPFSGALQLTDLDDFIGPSQECIKPVKVEKRAGSGVAKIRIEDDGSYFQINQVRHRRLLHHLSCPADPKHFSLLPPVTER

SEQ ID NO: 58258 - protein, 70 aa, Homo sapiens
  Payload ID: 11405
  Gene Symbol: NARFL
  Gene Name: nuclear prelamin A recognition factor-like
  ENSP ID: ENSP00000455543
MASPFSGALQLTDLDDFIGPSQIQAHVLSMGSATLVSVVVTPPVHVKGEGVHQACQSGKKGGKWRGQDSH

SEQ ID NO: 58259 - protein, 188 aa, Homo sapiens
  Payload ID: 11405
  Gene Symbol: NARFL
  Gene Name: nuclear prelamin A recognition factor-like
  ENSP ID: ENSP00000456497
MASPFSGALQLTDLDDFIGPSQECIKPVKVEKRAGSGVAKIRIEDDGSYFQINQDGGTRRLEKAKVSLNDCLACSGCITSAETVLITQQSHEELKKVLDANKGCTSSSTPPSQGTSASWRASESLCGDSEDRPTADRRCPCWPLPAQAGSAMPRRLTAASSSPTSAPPGPRSRSWAPWSRTSSPSSST

SEQ ID NO: 58260 - protein, 186 aa, Homo sapiens
  Payload ID: 11405
  Gene Symbol: NARFL
  Gene Name: nuclear prelamin A recognition factor-like
  ENSP ID: ENSP00000456701
MAAPSQQRLVVVSVSPQSRASLAARFQLNPTDTARKLTSFFKKIGVHFVFDTAFSRHFSLLESQREFVRRFRGQADCRQALPLLASACPGWICYAEKTHGSFILPHISTARSPQQVMGSLVKDFFAQQQHLTPDKIYHVTVMPCYDKKLEASRPDFFNQEHQTRDVDCVLTTGEVFRLLEEEGVSL

SEQ ID NO: 58261 - protein, 110 aa, Homo sapiens
  Payload ID: 11405
  Gene Symbol: NARFL
  Gene Name: nuclear prelamin A recognition factor-like
  ENSP ID: ENSP00000456733
MAAPSQQRLVVVSVSPQSRASLAARFQLNPTDTARKLTSFFKKIGVHFVFDTAFSRHFSLLESQREFVRRFRGQADCRQALPLLASACPGWICYAEKTHGSFILPHISTA

SEQ ID NO: 58262 - protein, 374 aa, Homo sapiens; identical to SEQ ID NO: 58256
  Payload ID: 11405
  Gene Symbol: NARFL
  Gene Name: nuclear prelamin A recognition factor-like
  Uniprot ID: Q9H6Q4
  ENSP ID: ENSP00000457058

SEQ ID NO: 58263 - protein, 66 aa, Homo sapiens
  Payload ID: 11405
  Gene Symbol: NARFL
  Gene Name: nuclear prelamin A recognition factor-like
  ENSP ID: ENSP00000457609
MASPFSGALQLTDLDDFIGPSQECIKPVKVEKRAGSGVAKIRIEDDGSYFQINQSPPSAFSCPTAL

SEQ ID NO: 58264 - protein, 53 aa, Homo sapiens
  Payload ID: 11405
  Gene Symbol: NARFL
  Gene Name: nuclear prelamin A recognition factor-like
  ENSP ID: ENSP00000459523
MAAPSQQRLVVVSVSPQSRASLAARFQLNPTDTARKLTSFFKKIGVHFVFDTA

SEQ ID NO: 58265 - protein, 1427 aa, Homo sapiens
  Payload ID: 11406
  Gene Symbol: NPAT
  Gene Name: nuclear protein, ataxia-telangiectasia locus
  Uniprot ID: Q14207
  ENSP ID: ENSP00000278612
MLLPSDVARLVLGYLQQENLISTCQTFILESSDLKEYAEHCTDEGFIPACLLSLFGKNLTTILNEYVAMKTKETSNNVPAIMSSLWKKLDHTLSQIRSMQSSPRFAGSQRARTRTGIAEIKRQRKLASQTAPASAELLTLPYLSGQFTTPPSTGTQVTRPSGQISDPSRSYFVVVNHSQSQDTVTTGEALNVIPGAQEKKAHASLMSPGRRKSESQRKSTTLSGPHSTIRNFQDPNAFAVEKQMVIENAREKILSNKSLQEKLAENINKFLTSDNNIAQVPKQTDNNPTEPETSIDEFLGLPSEIHMSEEAIQDILEQTESDPAFQALFDLFDYGKTKNNKNISQSISSQPMESNPSIVLADETNLAVKGSFETEESDGQSGQPAFCTSYQNDDPLNALKNSNNHDVLRQEDQENFSQISTSIQKKAFKTAVPTEQKCDIDITFESVPNLNDFNQRGNSNAECNPHCAELYTNQMSTETEMAIGIEKNSLSSNVPSESQLQPDQPDIPITSFVSLGCEANNENLILSGKSSQLLSQDTSLTGKPSKKSQFCENSNDTVKLKINFHGSKSSDSSEVHKSKIEINVLEPVMSQLSNCQDNSCLQSEILPVSVESSHLNVSGQVEIHLGDSLSSTKQPSNDSASVELNHTENEAQASKSENSQEPSSSVKEENTIFLSLGGNANCEKVALTPPEGTPVENSHSLPPESVCSSVGDSHPESQNTDDKPSSNNSAEIDASNIVSLKVIISDDPFVSSDTELTSAVSSINGENLPTIILSSPTKSPTKNAELVKCLSSEETVGAVVYAEVGDSASMEQSLLTFKSEDSAVNNTQNEDGIAFSANVTPCVSKDGGYIQLMPATSTAFGNSNNILIATCVTDPTALGTSVSQSNVVVLPGNSAPMTAQPLPPQLQTPPRSNSVFAVNQAVSPNFSQGSAIIIASPVQPVLQGMVGMIPVSVVGQNGNNFSTPPRQVLHMPLTAPVCNRSIPQFPVPPKSQKAQGLRNKPCIGKQVNNLVDSSGHSVGCHAQKTEVSDKSIATDLGKKSEETTVPFPEESIVPAAKPCHRRVLCFDSTTAPVANTQGPNHKMVSQNKERNAVSFPNLDSPNVSSTLKPPSNNAIKREKEKPPLPKILSKSESAISRHTTIRETQSEKKVSPTEIVLESFHKATANKENELCSDVERQKNPENSKLSIGQQNGGLRSEKSIASLQEMTKKQGTSSNNKNVLSVGTAVKDLKQEQTKSASSLITTEMLQDIQRHSSVSRLADSSDLPVPRTPGSGAGEKHKEEPIDIIKAPSSRRFSEDSSTSKVMVPPVTPDLPACSPASETGSENSVNMAAHTLMILSRAAISRTTSATPLKDNTQQFRASSRSTTKKRKIEELDERERNSRPSSKNLTNSSIPMKKKKIKKKKLPSSFPAGMDVDKFLLSLHYDE

SEQ ID NO: 58266 - protein, 60 aa, Homo sapiens
  Payload ID: 11406
  Gene Symbol: NPAT
  Gene Name: nuclear protein, ataxia-telangiectasia locus
  ENSP ID: ENSP00000433497
MLLPSDVARLVLDRVSPCCPGSSAVVQSWFAAASTSWAQAILPPPPPEQLELQVHTTKPS

SEQ ID NO: 58267 - protein, 299 aa, Homo sapiens
  Payload ID: 11406
  Gene Symbol: NPAT
  Gene Name: nuclear protein, ataxia-telangiectasia locus
  ENSP ID: ENSP00000436510
  MOD_RES (1)..(1): Any amino acid
XLVDSSGHSVGCHAQNFVLFCFRTEVSDKSIATDLGKKSEETTVPFPEESIVPAAKPCHRRVLCFDSTTAPVANTQGPNHKMVSQNKERNAVSFPNLDSPNVSSTLKPPSNNAIKREKEKPPLPKILSKSESAISRHTTIRETQSEKKVSPTEIVLESFHKATANKENELCSDVERQKNPENSKLSIGQQNGGLRSEKSIASLQEMTKKQGTSSNNKNVLSVGTAVKDLKQEQTKSASSLITTEMLQDIQRHSSVSRLADSSDLPVPRTPGSGAGEKHKEEPIDIIKAPSSRRFSEDSS

SEQ ID NO: 58268 - protein, 82 aa, Homo sapiens
  Payload ID: 11407
  Gene Symbol: NUPR1
  Gene Name: nuclear protein, transcriptional regulator, 1
  Uniprot ID: O60356
  ENSP ID: ENSP00000315559
MATFPPATSAPQQPPGPEDEDSSLDESDLYSLAHSYLGGGGRKGRTKREAAANTNRPSPGGHERKLVTKLQNSERKKRGARR

SEQ ID NO: 58269 - protein, 100 aa, Homo sapiens
  Payload ID: 11407
  Gene Symbol: NUPR1
  Gene Name: nuclear protein, transcriptional regulator, 1
  Uniprot ID: O60356
  ENSP ID: ENSP00000379003
MATFPPATSAPQQPPGPEDEDSSLDESDLYSLAHSYLGPLIMPMPTSPLTPALVTGGGGRKGRTKREAAANTNRPSPGGHERKLVTKLQNSERKKRGARR

SEQ ID NO: 58270 - protein, 43 aa, Homo sapiens
  Payload ID: 11407
  Gene Symbol: NUPR1
  Gene Name: nuclear protein, transcriptional regulator, 1
  ENSP ID: ENSP00000456597
MATFPPATSAPQQPPGPEDEDSSLDESDLYSLAHSYLGWSAVV

SEQ ID NO: 58271 - protein, 97 aa, Homo sapiens
  Payload ID: 11408
  Gene Symbol: NUPR1L
  Gene Name: nuclear protein, transcriptional regulator, 1-like
  Uniprot ID: A6NF83
  ENSP ID: ENSP00000455442
MEAPAERALPRLQALARPPPPISYEEELYDCLDYYYLRDFPACGAGRSKGRTRREQALRTNWPAPGGHERKVAQKLLNGQRKRRQRQLHPKMRTRLT

SEQ ID NO: 58272 - protein, 139 aa, Homo sapiens
  Payload ID: 11409
  Gene Symbol: NR2C2AP
  Gene Name: nuclear receptor 2C2-associated protein
  Uniprot ID: Q86WQ0
  ENSP ID: ENSP00000332823
MTHSLVCPETVSRVSSVLNRNTRQFGKKHLFDQDEETCWNSDQGPSQWVTLEFPQLIRVSQLQIQFQGGFSSRRGCLEGSQGTQALHKIVDFYPEDNNSLQTFPIPAAEVDRLKVTFEDATDFFGRVVIYHLRVLGEKV

SEQ ID NO: 58273 - protein, 167 aa, Homo sapiens
  Payload ID: 11409
  Gene Symbol: NR2C2AP
  Gene Name: nuclear receptor 2C2-associated protein
  Uniprot ID: Q86WQ0
  ENSP ID: ENSP00000402756
MTHSLVCPETVSRVSSVLNRNTRQFGKKHLFDQDEETCWNSDQGPSQWVTLEFPQLIRVSQLQIQFQGGFSSRRGCLEGSQGTQALHKIVDFYPEDNNSLQTFPIPAAEVDRLKVTFEDATDFFGRVVIYHLRVLGEKGTNRDPCRDLHYRAKLGEPRTHPRNLNFP

SEQ ID NO: 58274 - protein, 54 aa, Homo sapiens
  Payload ID: 11409
  Gene Symbol: NR2C2AP
  Gene Name: nuclear receptor 2C2-associated protein
  ENSP ID: ENSP00000438092
MTHSLVCPETVSRVSSVLNRNTRQFGKKHLFDQDEETCWNSDQVHRALRLSTRL

SEQ ID NO: 58275 - protein, 127 aa, Homo sapiens
  Payload ID: 11409
  Gene Symbol: NR2C2AP
  Gene Name: nuclear receptor 2C2-associated protein
  ENSP ID: ENSP00000475559
MTHSLVCPETVSRVSSVLNRNTRQFGKKHLFDQDEETCWNSDQGPSQWVTLEFPQLIRVSQLQIQFQGGFSSRRGCLEGSQGTQALHKIVDFYPEDNNSLQISCPCFWGGWSVPLEALDSPKPEWEP

SEQ ID NO: 58276 - protein, 29 aa, Homo sapiens
  Payload ID: 11409
  Gene Symbol: NR2C2AP
  Gene Name: nuclear receptor 2C2-associated protein
  ENSP ID: ENSP00000476087
GKKHLFDQDEETCWNSDQVHRALRLSTRL

SEQ ID NO: 58277 - protein, 287 aa, Homo sapiens
  Payload ID: 11410
  Gene Symbol: NRBF2
  Gene Name: nuclear receptor binding factor 2
  Uniprot ID: Q96F24
  ENSP ID: ENSP00000277746
MEVMEGPLNLAHQQSRRADRLLAAGKYEEAISCHKKAAAYLSEAMKLTQSEQAHLSLELQRDSHMKQLLLIQERWKRAQREERLKAQQNTDKDAAAHLQTSHKPSAEDAEGQSPLSQKYSPSTEKCLPEIQGIFDRDPDTLLYLLQQKSEPAEPCIGSKAPKDDKTIIEEQATKIADLKRHVEFLVAENERLRKENKQLKAEKARLLKGPIEKELDVDADFVETSELWSLPPHAETATASSTWQKFAANTGKAKDIPIPNLPPLDFPSPELPLMELSEDILKGFMNN

SEQ ID NO: 58278 - protein, 277 aa, Homo sapiens
  Payload ID: 11410
  Gene Symbol: NRBF2
  Gene Name: nuclear receptor binding factor 2
  Uniprot ID: Q96F24
  ENSP ID: ENSP00000397502
MFPGATTPLPKAAAYPGVYGSNGRTPQPAYLSEAMKLTQSEQAHLSLELQRDSHMKQLLLIQERWKRAQREERLKAQQNTDKDAAAHLQTSHKPSAEDAEGQSPLSQKYSPSTEKCLPEIQGIFDRDPDTLLYLLQQKSEPAEPCIGSKAPKDDKTIIEEQATKIADLKRHVEFLVAENERLRKENKQLKAEKARLLKGPIEKELDVDADFVETSELWSLPPHAETATASSTWQKFAANTGKAKDIPIPNLPPLDFPSPELPLMELSEDILKGFMNN

SEQ ID NO: 58279 - protein, 273 aa, Homo sapiens
  Payload ID: 11410
  Gene Symbol: NRBF2
  Gene Name: nuclear receptor binding factor 2
  ENSP ID: ENSP00000478749
MEVMEGPLNLAHQQSRRADRLLAAGKYEEAISCHKKAAAYLSEAMKLTQSEQAHLSLELQRDSHMKQLLLIQERWKRAQREERLKAQQNTDKDAAAHLQTSHKPSAEDAEGQSPLSQKYSPSTEKCLPEIQGIFDRDPDTLLYLLQQKSEPAEPCIGSKAPKDDKTIIEEQATKIADLKRHVEFLVAENERLRKENKQLKAEKARLLKGPIEKELDVDADFVETSELWSLPPRNCYSLLNLAEVRSKYWERTFQSPIFLPWIFHLQNFLLWSS

SEQ ID NO: 58280 - protein, 535 aa, Homo sapiens
  Payload ID: 11411
  Gene Symbol: NRBP1
  Gene Name: nuclear receptor binding protein 1
  Uniprot ID: Q9UHY1
  ENSP ID: ENSP00000233557
MSEGESQTVLSSGSDPKVESSSSAPGLTSVSPPVTSTTSAASPEEEEESEDESEILEESPCGRWQKRREEVNQRNVPGIDSAYLAMDTEEGVEVVWNEVQFSERKNYKLQEEKVRAVFDNLIQLEHLNIVKFHKYWADIKENKARVIFITEYMSSGSLKQFLKKTKKNHKTMNEKAWKRWCTQILSALSYLHSCDPPIIHGNLTCDTIFIQHNGLIKIGSVAPDTINNHVKTCREEQKNLHFFAPEYGEVTNVTTAVDIYSFGMCALEMAVLEIQGNGESSYVPQEAISSAIQLLEDPLQREFIQKCLQSEPARRPTARELLFHPALFEVPSLKLLAAHCIVGHQHMIPENALEEITKNMDTSAVLAEIPAGPGREPVQTLYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEADQSRLTSLLEETLNKFNFARNSTLNSAAVTVSS

SEQ ID NO: 58281 - protein, 535 aa, Homo sapiens; identical to SEQ ID NO: 58280
  Payload ID: 11411
  Gene Symbol: NRBP1
  Gene Name: nuclear receptor binding protein 1
  Uniprot ID: Q9UHY1
  ENSP ID: ENSP00000369181

SEQ ID NO: 58282 - protein, 543 aa, Homo sapiens
  Payload ID: 11411
  Gene Symbol: NRBP1
  Gene Name: nuclear receptor binding protein 1
  ENSP ID: ENSP00000369192
MSEGESQTVLSSGSDPKVESSSSAPGLTSVSPPVTSTTSAASPEEEEESEDESEILEESPCGRWQKRREEVNQRNVPGIDSAYLAMDTEEGVEVVWNEVQFSERKNYKLQEEKVRAVFDNLIQLEHLNIVKFHKYWADIKENKARVIFITEYMSSGSLKQFLKKTKKNHKTMNEKAWKRWCTQILSALSYLHSCDPPIIHGNLTCDTIFIQHNGLIKIGSVFHRIFANVAPDTINNHVKTCREEQKNLHFFAPEYGEVTNVTTAVDIYSFGMCALEMAVLEIQGNGESSYVPQEAISSAIQLLEDPLQREFIQKCLQSEPARRPTARELLFHPALFEVPSLKLLAAHCIVGHQHMIPENALEEITKNMDTSAVLAEIPAGPGREPVQTLYSQSPALELDKFLEDVRNGIYPLTAFGLPRPQQPQQEEVTSPVVPPSVKTPTPEPAEVETRKVVLMQCNIESVEEGVKHHLTLLLKLEDKLNRHLSCDLMPNENIPELAAELVQLGFISEADQSRLTSLLEETLNKFNFARNSTLNSAAVTVSS

SEQ ID NO: 58283 - protein, 155 aa, Homo sapiens
  Payload ID: 11411
  Gene Symbol: NRBP1
  Gene Name: nuclear receptor binding protein 1
  ENSP ID: ENSP00000403916
MSEGESQTVLSSGSDPKVESSSSAPGLTSVSPPVTSTTSAASPEEEEESEDESEILEESPCGRWQKRREEVNQRNVPGIDSAYLAMDTEEGVEVVWNEVQFSERKNYKLQEEKVRAVFDNLIQLEHLNIVKFHKYWADIKENKARVIFITEYMSS

SEQ ID NO: 58284 - protein, 81 aa, Homo sapiens
  Payload ID: 11411
  Gene Symbol: NRBP1
  Gene Name: nuclear receptor binding protein 1
  ENSP ID: ENSP00000415406
MSEGESQTVLSSGSDPKVESSSSAPGLTSVSPPVTSTTSAASPEEEEESEDESEILEESPCGRWQKRREEVNQRNVPGIDS

SEQ ID NO: 58285 - protein, 501 aa, Homo sapiens
  Payload ID: 11412
  Gene Symbol: NRBP2
  Gene Name: nuclear receptor binding protein 2
  Uniprot ID: Q9NSY0
  ENSP ID: ENSP00000414055
MAAPEPAPRRAREREREREDESEDESDILEESPCGRWQKRREQVNQGNMPGLQSTFLAMDTEEGVEVVWNELHFGDRKAFAAHEEKIQTVFEQLVLVDHPNIVKLHKYWLDTSEACARVIFITEYVSSGSLKQFLKKTKKNHKAMNARAWKRWCTQILSALSFLHACSPPIIHGNLTSDTIFIQHNGLIKIGSVWHRIFSNALPDDLRSPIRAEREELRNLHFFPPEYGEVADGTAVDIFSFGMCALEMAVLEIQTNGDTRVTEEAIARARHSLSDPNMREFILCCLARDPARRPSAHSLLFHRVLFEVHSLKLLAAHCFIQHQYLMPENVVEEKTKAMDLHAVLAELPRPRRPPLQWRYSEVSFMELDKFLEDVRNGIYPLMNFAATRPLGLPRVLAPPPEEVQKAKTPTPEPFDSETRKVIQMQCNLERSEDKARWHLTLLLVLEDRLHRQLTYDLLPTDSAQDLASELVHYGFLHEDDRMKLAAFLESTFLKYRGTQA

SEQ ID NO: 58286 - protein, 168 aa, Homo sapiens
  Payload ID: 11412
  Gene Symbol: NRBP2
  Gene Name: nuclear receptor binding protein 2
  ENSP ID: ENSP00000431280
  MOD_RES (1)..(1): Any amino acid
XLGLPRVLAPPPEEVQKAKTPTPEPFDSETRKVIQMQCNLERSEDKARWHLTLLLVLEDRLHRQLTYDLLPRRPDEAGRLPGEHLPQVPWDPGLTRSPSPRGPCRGAAWAGHVGETPAPWGCPPPCAWEHKGPGSEGTPRLLRVGLTLPWAPRGWGVGVGEPLGLPGP

SEQ ID NO: 58287 - protein, 232 aa, Homo sapiens
  Payload ID: 11412
  Gene Symbol: NRBP2
  Gene Name: nuclear receptor binding protein 2
  ENSP ID: ENSP00000432374
MPGLQSTFLAMDTEEGVEVVWNELHFGDRKAFAAHEEKIQTVFEQLVLVDHPNIVKLHKYWLDTSEACARVIFITEYVSSGSLKQFLKKTKKNHKAMNARAWKRWCTQILSALSFLHACSPPIIHGNLTSDTIFIQHNGLIKIGSVWHRIFSNALPDDLRSPIRAEREELRNLHFFPPEYGEVADGTAVDIFSFGMCALEMAVLEIQTNGDTRVTEEAIARARHSLSDPNMR

SEQ ID NO: 58288 - protein, 2427 aa, Homo sapiens
  Payload ID: 11413
  Gene Symbol: NSD1
  Gene Name: nuclear receptor binding SET domain protein 1
  Uniprot ID: Q96L73
  ENSP ID: ENSP00000343209
MPLKTRTALSDDPDSSTSTLGNMLELPGTSSSSTSQELPFCQPKKKSTPLKYEVGDLIWAKFKRRPWWPCRICSDPLINTHSKMKVSNRRPYRQYYVEAFGDPSERAWVAGKAIVMFEGRHQFEELPVLRRRGKQKEKGYRHKVPQKILSKWEASVGLAEQYDVPKGSKNRKCIPGSIKLDSEEDMPFEDCTNDPESEHDLLLNGCLKSLAFDSEHSADEKEKPCAKSRARKSSDNPKRTSVKKGHIQFEAHKDERRGKIPENLGLNFISGDISDTQASNELSRIANSLTGSNTAPGSFLFSSCGKNTAKKEFETSNGDSLLGLPEGALISKCSREKNKPQRSLVCGSKVKLCYIGAGDEEKRSDSISICTTSDDGSSDLDPIEHSSESDNSVLEIPDAFDRTENMLSMQKNEKIKYSRFAATNTRVKAKQKPLISNSHTDHLMGCTKSAEPGTETSQVNLSDLKASTLVHKPQSDFTNDALSPKFNLSSSISSENSLIKGGAANQALLHSKSKQPKFRSIKCKHKENPVMAEPPVINEECSLKCCSSDTKGSPLASISKSGKVDGLKLLNNMHEKTRDSSDIETAVVKHVLSELKELSYRSLGEDVSDSGTSKPSKPLLFSSASSQNHIPIEPDYKFSTLLMMLKDMHDSKTKEQRLMTAQNLVSYRSPGRGDCSTNSPVGVSKVLVSGGSTHNSEKKGDGTQNSANPSPSGGDSALSGELSASLPGLLSDKRDLPASGKSRSDCVTRRNCGRSKPSSKLRDAFSAQMVKNTVNRKALKTERKRKLNQLPSVTLDAVLQGDRERGGSLRGGAEDPSKEDPLQIMGHLTSEDGDHFSDVHFDSKVKQSDPGKISEKGLSFENGKGPELDSVMNSENDELNGVNQVVPKKRWQRLNQRRTKPRKRMNRFKEKENSECAFRVLLPSDPVQEGRDEFPEHRTPSASILEEPLTEQNHADCLDSAGPRLNVCDKSSASIGDMEKEPGIPSLTPQAELPEPAVRSEKKRLRKPSKWLLEYTEEYDQIFAPKKKQKKVQEQVHKVSSRCEEESLLARGRSSAQNKQVDENSLISTKEEPPVLEREAPFLEGPLAQSELGGGHAELPQLTLSVPVAPEVSPRPALESEELLVKTPGNYESKRQRKPTKKLLESNDLDPGFMPKKGDLGLSKKCYEAGHLENGITESCATSYSKDFGGGTTKIFDKPRKRKRQRHAAAKMQCKKVKNDDSSKEIPGSEGELMPHRTATSPKETVEEGVEHDPGMPASKKMQGERGGGAALKENVCQNCEKLGELLLCEAQCCGAFHLECLGLTEMPRGKFICNECRTGIHTCFVCKQSGEDVKRCLLPLCGKFYHEECVQKYPPTVMQNKGFRCSLHICITCHAANPANVSASKGRLMRCVRCPVAYHANDFCLAAGSKILASNSIICPNHFTPRRGCRNHEHVNVSWCFVCSEGGSLLCCDSCPAAFHRECLNIDIPEGNWYCNDCKAGKKPHYREIVWVKVGRYRWWPAEICHPRAVPSNIDKMRHDVGEFPVLFFGSNDYLWTHQARVFPYMEGDVSSKDKMGKGVDGTYKKALQEAAARFEELKAQKELRQLQEDRKNDKKPPPYKHIKVNRPIGRVQIFTADLSEIPRCNCKATDENPCGIDSECINRMLLYECHPTVCPAGGRCQNQCFSKRQYPEVEIFRTLQRGWGLRTKTDIKKGEFVNEYVGELIDEEECRARIRYAQEHDITNFYMLTLDKDRIIDAGPKGNYARFMNHCCQPNCETQKWSVNGDTRVGLFALSDIKAGTELTFNYNLECLGNGKTVCKCGAPNCSGFLGVRPKNQPIATEEKSKKFKKKQQGKRRTQGEITKEREDECFSCGDAGQLVSCKKPGCPKVYHADCLNLTKRPAGKWECPWHQCDICGKEAASFCEMCPSSFCKQHREGMLFISKLDGRLSCTEHDPCGPNPLEPGEIREYVPPPVPLPPGPSTHLAEQSTGMAAQAPKMSDKPPADTNQMLSLSKKALAGTCQRPLLPERPLERTDSRPQPLDKVRDLAGSGTKSQSLVSSQRPLDRPPAVAGPRPQLSDKPSPVTSPSSSPSVRSQPLERPLGTADPRLDKSIGAASPRPQSLEKTSVPTGLRLPPPDRLLITSSPKPQTSDRPTDKPHASLSQRLPPPEKVLSAVVQTLVAKEKALRPVDQNTQSKNRAALVMDLIDLTPRQKERAASPHQVTPQADEKMPVLESSSWPASKGLGHMPRAVEKGCVSDPLQTSGKAAAPSEDPWQAVKSLTQARLLSQPPAKAFLYEPTTQASGRASAGAEQTPGPLSQSPGLVKQAKQMVGGQQLPALAAKSGQSFRSLGKAPASLPTEEKKLVTTEQSPWALGKASSRAGLWPIVAGQTLAQSCWSAGSTQTLAQTCWSLGRGQDPKPEQNTLPALNQAPSSHKCAESEQK

SEQ ID NO: 58289 - protein, 2427 aa, Homo sapiens; identical to SEQ ID NO: 58288
  Payload ID: 11413
  Gene Symbol: NSD1
  Gene Name: nuclear receptor binding SET domain protein 1
  Uniprot ID: Q96L73
  ENSP ID: ENSP00000346111

SEQ ID NO: 58290 - protein, 64 aa, Homo sapiens
  Payload ID: 11413
  Gene Symbol: NSD1
  Gene Name: nuclear receptor binding SET domain protein 1
  ENSP ID: ENSP00000364499
DKSSASIGDMEKEPGIPSLTPQAELPEPGGVLLCHPGWSAVARSRLTATSASQVQVILLSHPPE

SEQ ID NO: 58291 - protein, 2696 aa, Homo sapiens
  Payload ID: 11413
  Gene Symbol: NSD1
  Gene Name: nuclear receptor binding SET domain protein 1
  Uniprot ID: Q96L73
  ENSP ID: ENSP00000395929
MDQTCELPRRNCLLPFSNPVNLDAPEDKDSPFGNGQSNFSEPLNGCTMQLSTVSGTSQNAYGQDSPSCYIPLRRLQDLASMINVEYLNGSADGSESFQDPEKSDSRAQTPIVCTSLSPGGPTALAMKQEPSCNNSPELQVKVTKTIKNGFLHFENFTCVDDADVDSEMDPEQPVTEDESIEEIFEETQTNATCNYETKSENGVKVAMGSEQDSTPESRHGAVKSPFLPLAPQTETQKNKQRNEVDGSNEKAALLPAPFSLGDTNITIEEQLNSINLSFQDDPDSSTSTLGNMLELPGTSSSSTSQELPFCQPKKKSTPLKYEVGDLIWAKFKRRPWWPCRICSDPLINTHSKMKVSNRRPYRQYYVEAFGDPSERAWVAGKAIVMFEGRHQFEELPVLRRRGKQKEKGYRHKVPQKILSKWEASVGLAEQYDVPKGSKNRKCIPGSIKLDSEEDMPFEDCTNDPESEHDLLLNGCLKSLAFDSEHSADEKEKPCAKSRARKSSDNPKRTSVKKGHIQFEAHKDERRGKIPENLGLNFISGDISDTQASNELSRIANSLTGSNTAPGSFLFSSCGKNTAKKEFETSNGDSLLGLPEGALISKCSREKNKPQRSLVCGSKVKLCYIGAGDEEKRSDSISICTTSDDGSSDLDPIEHSSESDNSVLEIPDAFDRTENMLSMQKNEKIKYSRFAATNTRVKAKQKPLISNSHTDHLMGCTKSAEPGTETSQVNLSDLKASTLVHKPQSDFTNDALSPKFNLSSSISSENSLIKGGAANQALLHSKSKQPKFRSIKCKHKENPVMAEPPVINEECSLKCCSSDTKGSPLASISKSGKVDGLKLLNNMHEKTRDSSDIETAVVKHVLSELKELSYRSLGEDVSDSGTSKPSKPLLFSSASSQNHIPIEPDYKFSTLLMMLKDMHDSKTKEQRLMTAQNLVSYRSPGRGDCSTNSPVGVSKVLVSGGSTHNSEKKGDGTQNSANPSPSGGDSALSGELSASLPGLLSDKRDLPASGKSRSDCVTRRNCGRSKPSSKLRDAFSAQMVKNTVNRKALKTERKRKLNQLPSVTLDAVLQGDRERGGSLRGGAEDPSKEDPLQIMGHLTSEDGDHFSDVHFDSKVKQSDPGKISEKGLSFENGKGPELDSVMNSENDELNGVNQVVPKKRWQRLNQRRTKPRKRMNRFKEKENSECAFRVLLPSDPVQEGRDEFPEHRTPSASILEEPLTEQNHADCLDSAGPRLNVCDKSSASIGDMEKEPGIPSLTPQAELPEPAVRSEKKRLRKPSKWLLEYTEEYDQIFAPKKKQKKVQEQVHKVSSRCEEESLLARGRSSAQNKQVDENSLISTKEEPPVLEREAPFLEGPLAQSELGGGHAELPQLTLSVPVAPEVSPRPALESEELLVKTPGNYESKRQRKPTKKLLESNDLDPGFMPKKGDLGLSKKCYEAGHLENGITESCATSYSKDFGGGTTKIFDKPRKRKRQRHAAAKMQCKKVKNDDSSKEIPGSEGELMPHRTATSPKETVEEGVEHDPGMPASKKMQGERGGGAALKENVCQNCEKLGELLLCEAQCCGAFHLECLGLTEMPRGKFICNECRTGIHTCFVCKQSGEDVKRCLLPLCGKFYHEECVQKYPPTVMQNKGFRCSLHICITCHAANPANVSASKGRLMRCVRCPVAYHANDFCLAAGSKILASNSIICPNHFTPRRGCRNHEHVNVSWCFVCSEGGSLLCCDSCPAAFHRECLNIDIPEGNWYCNDCKAGKKPHYREIVWVKVGRYRWWPAEICHPRAVPSNIDKMRHDVGEFPVLFFGSNDYLWTHQARVFPYMEGDVSSKDKMGKGVDGTYKKALQEAAARFEELKAQKELRQLQEDRKNDKKPPPYKHIKVNRPIGRVQIFTADLSEIPRCNCKATDENPCGIDSECINRMLLYECHPTVCPAGGRCQNQCFSKRQYPEVEIFRTLQRGWGLRTKTDIKKGEFVNEYVGELIDEEECRARIRYAQEHDITNFYMLTLDKDRIIDAGPKGNYARFMNHCCQPNCETQKWSVNGDTRVGLFALSDIKAGTELTFNYNLECLGNGKTVCKCGAPNCSGFLGVRPKNQPIATEEKSKKFKKKQQGKRRTQGEITKEREDECFSCGDAGQLVSCKKPGCPKVYHADCLNLTKRPAGKWECPWHQCDICGKEAASFCEMCPSSFCKQHREGMLFISKLDGRLSCTEHDPCGPNPLEPGEIREYVPPPVPLPPGPSTHLAEQSTGMAAQAPKMSDKPPADTNQMLSLSKKALAGTCQRPLLPERPLERTDSRPQPLDKVRDLAGSGTKSQSLVSSQRPLDRPPAVAGPRPQLSDKPSPVTSPSSSPSVRSQPLERPLGTADPRLDKSIGAASPRPQSLEKTSVPTGLRLPPPDRLLITSSPKPQTSDRPTDKPHASLSQRLPPPEKVLSAVVQTLVAKEKALRPVDQNTQSKNRAALVMDLIDLTPRQKERAASPHQVTPQADEKMPVLESSSWPASKGLGHMPRAVEKGCVSDPLQTSGKAAAPSEDPWQAVKSLTQARLLSQPPAKAFLYEPTTQASGRASAGAEQTPGPLSQSPGLVKQAKQMVGGQQLPALAAKSGQSFRSLGKAPASLPTEEKKLVTTEQSPWALGKASSRAGLWPIVAGQTLAQSCWSAGSTQTLAQTCWSLGRGQDPKPEQNTLPALNQAPSSHKCAESEQK

SEQ ID NO: 58292 - protein, 9 aa, Homo sapiens
  Payload ID: 11413
  Gene Symbol: NSD1
  Gene Name: nuclear receptor binding SET domain protein 1
  ENSP ID: ENSP00000422996
MRHDVGEFP

SEQ ID NO: 58293 - protein, 52 aa, Homo sapiens
  Payload ID: 11413
  Gene Symbol: NSD1
  Gene Name: nuclear receptor binding SET domain protein 1
  ENSP ID: ENSP00000423048
MRHDVGEFPVLFFGSNDYLWTHQARVFPYMEGDVSSKDKMGKGVDGTYKKAL

SEQ ID NO: 58294 - protein, 155 aa, Homo sapiens
  Payload ID: 11413
  Gene Symbol: NSD1
  Gene Name: nuclear receptor binding SET domain protein 1
  ENSP ID: ENSP00000423372
MPLKTRTALSDDPDSSTSTLGNMLELPGTSSSSTSQELPFCQPKKKSTPLKYEVGDLIWAKFKRRPWWPCRICSDPLINTHSKMKVSNRRPYRQYYVEAFGDPSERAWVAGKAIVMFEGRHQFEELPVLRRRGKQKEKGYRHKVPQKILSKWEAS

SEQ ID NO: 58295 - protein, 124 aa, Homo sapiens
  Payload ID: 11413
  Gene Symbol: NSD1
  Gene Name: nuclear receptor binding SET domain protein 1
  ENSP ID: ENSP00000423982
MPLKTRTALSDDPDSSTSTLGNMLELPGTSSSSTSQELPFCQPKKKSTPLKYEVGDLIWAKFKRRPWWPCRICSDPLINTHSKMKVSNRRPYRQYYVEAFGDPSERAWVAGKAIVMFEGRHQFE

SEQ ID NO: 58296 - protein, 94 aa, Homo sapiens
  Payload ID: 11413
  Gene Symbol: NSD1
  Gene Name: nuclear receptor binding SET domain protein 1
  ENSP ID: ENSP00000424024
MRHDVGEFPVLFFGSNDYLWTHQARVFPYMEGDVSSKDKMGKGVDGTYKKALQEAAARFEELKAQKELRQLQEDRKNDKKPPPYKHIKVNRPIG

SEQ ID NO: 58297 - protein, 5 aa, Homo sapiens
  Payload ID: 11413
  Gene Symbol: NSD1
  Gene Name: nuclear receptor binding SET domain protein 1
  ENSP ID: ENSP00000424096
MRHDV

SEQ ID NO: 58298 - protein, 34 aa, Homo sapiens
  Payload ID: 11413
  Gene Symbol: NSD1
  Gene Name: nuclear receptor binding SET domain protein 1
  ENSP ID: ENSP00000425120
MRHDVGEFPVLFFGSNDYLWTHQARVFPYMEGDV

SEQ ID NO: 58299 - protein, 67 aa, Homo sapiens
  Payload ID: 11413
  Gene Symbol: NSD1
  Gene Name: nuclear receptor binding SET domain protein 1
  ENSP ID: ENSP00000426428
MPLKTRTALSDDPDSSTSTLGNMLELPGTSSSSTSQELPFRLALSCCPGWRRDSWAHSILLHQLELQ

SEQ ID NO: 58300 - protein, 1399 aa, Homo sapiens
  Payload ID: 11414
  Gene Symbol: NCOA1
  Gene Name: nuclear receptor coactivator 1
  Uniprot ID: Q15788
  ENSP ID: ENSP00000288599
MSGLGDSSSDPANPDSHKRKGSPCDTLASSTEKRRREQENKYLEELAELLSANISDIDSLSVKPDKCKILKKTVDQIQLMKRMEQEKSTTDDDVQKSDISSSSQGVIEKESLGPLLLEALDGFFFVVNCEGRIVFVSENVTSYLGYNQEELMNTSVYSILHVGDHAEFVKNLLPKSLVNGVPWPQEATRRNSHTFNCRMLIHPPDEPGTENQEACQRYEVMQCFTVSQPKSIQEDGEDFQSCLICIARRLPRPPAITGVESFMTKQDTTGKIISIDTSSLRAAGRTGWEDLVRKCIYAFFQPQGREPSYARQLFQEVMTRGTASSPSYRFILNDGTMLSAHTKCKLCYPQSPDMQPFIMGIHIIDREHSGLSPQDDTNSGMSIPRVNPSVNPSISPAHGVARSSTLPPSNSNMVSTRINRQQSSDLHSSSHSNSSNSQGSFGCSPGSQIVANVALNQGQASSQSSNPSLNLNNSPMEGTGISLAQFMSPRRQVTSGLATRPRMPNNSFPPNISTLSSPVGMTSSACNNNNRSYSNIPVTSLQGMNEGPNNSVGFSASSPVLRQMSSQNSPSRLNIQPAKAESKDNKEIASILNEMIQSDNSSSDGKPLDSGLLHNNDRLSDGDSKYSQTSHKLVQLLTTTAEQQLRHADIDTSCKDVLSCTGTSNSASANSSGGSCPSSHSSLTERHKILHRLLQEGSPSDITTLSVEPDKKDSASTSVSVTGQVQGNSSIKLELDASKKKESKDHQLLRYLLDKDEKDLRSTPNLSLDDVKVKVEKKEQMDPCNTNPTPMTKPTPEEIKLEAQSQFTADLDQFDQLLPTLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQDKKTEEFFSVVTTD

SEQ ID NO: 58301 - protein, 1441 aa, Homo sapiens
  Payload ID: 11414
  Gene Symbol: NCOA1
  Gene Name: nuclear receptor coactivator 1
  Uniprot ID: Q15788
  ENSP ID: ENSP00000320940
MSGLGDSSSDPANPDSHKRKGSPCDTLASSTEKRRREQENKYLEELAELLSANISDIDSLSVKPDKCKILKKTVDQIQLMKRMEQEKSTTDDDVQKSDISSSSQGVIEKESLGPLLLEALDGFFFVVNCEGRIVFVSENVTSYLGYNQEELMNTSVYSILHVGDHAEFVKNLLPKSLVNGVPWPQEATRRNSHTFNCRMLIHPPDEPGTENQEACQRYEVMQCFTVSQPKSIQEDGEDFQSCLICIARRLPRPPAITGVESFMTKQDTTGKIISIDTSSLRAAGRTGWEDLVRKCIYAFFQPQGREPSYARQLFQEVMTRGTASSPSYRFILNDGTMLSAHTKCKLCYPQSPDMQPFIMGIHIIDREHSGLSPQDDTNSGMSIPRVNPSVNPSISPAHGVARSSTLPPSNSNMVSTRINRQQSSDLHSSSHSNSSNSQGSFGCSPGSQIVANVALNQGQASSQSSNPSLNLNNSPMEGTGISLAQFMSPRRQVTSGLATRPRMPNNSFPPNISTLSSPVGMTSSACNNNNRSYSNIPVTSLQGMNEGPNNSVGFSASSPVLRQMSSQNSPSRLNIQPAKAESKDNKEIASILNEMIQSDNSSSDGKPLDSGLLHNNDRLSDGDSKYSQTSHKLVQLLTTTAEQQLRHADIDTSCKDVLSCTGTSNSASANSSGGSCPSSHSSLTERHKILHRLLQEGSPSDITTLSVEPDKKDSASTSVSVTGQVQGNSSIKLELDASKKKESKDHQLLRYLLDKDEKDLRSTPNLSLDDVKVKVEKKEQMDPCNTNPTPMTKPTPEEIKLEAQSQFTADLDQFDQLLPTLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQQVQQVQVFADVQCTVNLVGGDPYLNQPGPLGTQKPTSGPQTPQAQQKSLLQQLLTE

SEQ ID NO: 58302 - protein, 1440 aa, Homo sapiens
  Payload ID: 11414
  Gene Symbol: NCOA1
  Gene Name: nuclear receptor coactivator 1
  Uniprot ID: Q15788
  ENSP ID: ENSP00000379197
MSGLGDSSSDPANPDSHKRKGSPCDTLASSTEKRRREQENKYLEELAELLSANISDIDSLSVKPDKCKILKKTVDQIQLMKRMEQEKSTTDDDVQKSDISSSSQGVIEKESLGPLLLEALDGFFFVVNCEGRIVFVSENVTSYLGYNQEELMNTSVYSILHVGDHAEFVKNLLPKSLVNGVPWPQEATRRNSHTFNCRMLIHPPDEPGTENQEACQRYEVMQCFTVSQPKSIQEDGEDFQSCLICIARRLPRPPAITGVESFMTKQDTTGKIISIDTSSLRAAGRTGWEDLVRKCIYAFFQPQGREPSYARQLFQEVMTRGTASSPSYRFILNDGTMLSAHTKCKLCYPQSPDMQPFIMGIHIIDREHSGLSPQDDTNSGMSIPRVNPSVNPSISPAHGVARSSTLPPSNSNMVSTRINRQQSSDLHSSSHSNSSNSQGSFGCSPGSQIVANVALNQGQASSQSSNPSLNLNNSPMEGTGISLAQFMSPRRQVTSGLATRPRMPNNSFPPNISTLSSPVGMTSSACNNNNRSYSNIPVTSLQGMNEGPNNSVGFSASSPVLRQMSSQNSPSRLNIQPAKAESKDNKEIASILNEMIQSDNSSSDGKPLDSGLLHNNDRLSDGDSKYSQTSHKLVQLLTTTAEQQLRHADIDTSCKDVLSCTGTSNSASANSSGGSCPSSHSSLTERHKILHRLLQEGSPSDITTLSVEPDKKDSASTSVSVTGQVQGNSSIKLELDASKKKESKDHQLLRYLLDKDEKDLRSTPNLSLDDVKVKVEKKEQMDPCNTNPTPMTKPTPEEIKLEAQSQFTADLDQFDQLLPTLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQVQQVQVFADVQCTVNLVGGDPYLNQPGPLGTQKPTSGPQTPQAQQKSLLQQLLTE

SEQ ID NO: 58303 - protein, 1399 aa, Homo sapiens; identical to SEQ ID NO: 58300
  Payload ID: 11414
  Gene Symbol: NCOA1
  Gene Name: nuclear receptor coactivator 1
  Uniprot ID: Q15788
  ENSP ID: ENSP00000385097

SEQ ID NO: 58304 - protein, 1248 aa, Homo sapiens
  Payload ID: 11414
  Gene Symbol: NCOA1
  Gene Name: nuclear receptor coactivator 1
  ENSP ID: ENSP00000385195
MNTSVYSILHVGDHAEFVKNLLPKSLVNGVPWPQEATRRNSHTFNCRMLIHPPDEPGTENQEACQRYEVMQCFTVSQPKSIQEDGEDFQSCLICIARRLPRPPAITGVESFMTKQDTTGKIISIDTSSLRAAGRTGWEDLVRKCIYAFFQPQGREPSYARQLFQEVMTRGTASSPSYRFILNDGTMLSAHTKCKLCYPQSPDMQPFIMGIHIIDREHSGLSPQDDTNSGMSIPRVNPSVNPSISPAHGVARSSTLPPSNSNMVSTRINRQQSSDLHSSSHSNSSNSQGSFGCSPGSQIVANVALNQGQASSQSSNPSLNLNNSPMEGTGISLAQFMSPRRQVTSGLATRPRMPNNSFPPNISTLSSPVGMTSSACNNNNRSYSNIPVTSLQGMNEGPNNSVGFSASSPVLRQMSSQNSPSRLNIQPAKAESKDNKEIASILNEMIQSDNSSSDGKPLDSGLLHNNDRLSDGDSKYSQTSHKLVQLLTTTAEQQLRHADIDTSCKDVLSCTGTSNSASANSSGGSCPSSHSSLTERHKILHRLLQEGSPSDITTLSVEPDKKDSASTSVSVTGQVQGNSSIKLELDASKKKESKDHQLLRYLLDKDEKDLRSTPNLSLDDVKVKVEKKEQMDPCNTNPTPMTKPTPEEIKLEAQSQFTADLDQFDQLLPTLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQDKKTEEFFSVVTTD

SEQ ID NO: 58305 - protein, 1441 aa, Homo sapiens; identical to SEQ ID NO: 58301
  Payload ID: 11414
  Gene Symbol: NCOA1
  Gene Name: nuclear receptor coactivator 1
  Uniprot ID: Q15788
  ENSP ID: ENSP00000385216

SEQ ID NO: 58306 - protein, 1464 aa, Homo sapiens
  Payload ID: 11415
  Gene Symbol: NCOA2
  Gene Name: nuclear receptor coactivator 2
  Uniprot ID: Q15596
  ENSP ID: ENSP00000399968
MSGMGENTSDPSRAETRKRKECPDQLGPSPKRNTEKRNREQENKYIEELAELIFANFNDIDNFNFKPDKCAILKETVKQIRQIKEQEKAAAANIDEVQKSDVSSTGQGVIDKDALGPMMLEALDGFFFVVNLEGNVVFVSENVTQYLRYNQEELMNKSVYSILHVGDHTEFVKNLLPKSIVNGGSWSGEPPRRNSHTFNCRMLVKPLPDSEEEGHDNQEAHQKYETMQCFAVSQPKSIKEEGEDLQSCLICVARRVPMKERPVLPSSESFTTRQDLQGKITSLDTSTMRAAMKPGWEDLVRRCIQKFHAQHEGESVSYAKRHHHEVLRQGLAFSQIYRFSLSDGTLVAAQTKSKLIRSQTTNEPQLVISLHMLHREQNVCVMNPDLTGQTMGKPLNPISSNSPAHQALCSGNPGQDMTLSSNINFPINGPKEQMGMPMGRFGGSGGMNHVSGMQATTPQGSNYALKMNSPSQSSPGMNPGQPTSMLSPRHRMSPGVAGSPRIPPSQFSPAGSLHSPVGVCSSTGNSHSYTNSSLNALQALSEGHGVSLGSSLASPDLKMGNLQNSPVNMNPPPLSKMGSLDSKDCFGLYGEPSEGTTGQAESSCHPGEQKETNDPNLPPAVSSERADGQSRLHDSKGQTKLLQLLTTKSDQMEPSPLASSLSDTNKDSTGSLPGSGSTHGTSLKEKHKILHRLLQDSSSPVDLAKLTAEATGKDLSQESSSTAPGSEVTIKQEPVSPKKKENALLRYLLDKDDTKDIGLPEITPKLERLDSKTDPASNTKLIAMKTEKEEMSFEPGDQPGSELDNLEEILDDLQNSQLPQLFPDTRPGAPAGSVDKQAIINDLMQLTAENSPVTPVGAQKTALRISQSTFNNPRPGQLGRLLPNQNLPLDITLQSPTGAGPFPPIRNSSPYSVIPQPGMMGNQGMIGNQGNLGNSSTGMIGNSASRPTMPSGEWAPQSSAVRVTCAATTSAMNRPVQGGMIRNPAASIPMRPSSQPGQRQTLQSQVMNIGPSELEMNMGGPQYSQQQAPPNQTAPWPESILPIDQASFASQNRQPFGSSPDDLLCPHPAAESPSDEGALLDQLYLALRNFDGLEEIDRALGIPELVSQSQAVDPEQFSSQDSNIMLEQKAPVFPQQYASQAQMAQGSYSPMQDPNFHTMGQRPSYATLRMQPRPGLRPTGLVQNQPNQLRLQLQHRLQAQQNRQPLMNQISNVSNVNLTLRPGVPTQAPINAQMLAQRQREILNQHLRQRQMHQQQQVQQRTLMMRGQGLNMTPSMVAPSGMPATMSNPRIPQANAQQFPFPPNYGISQQPDPGFTGATTPQSPLMSPRMAHTQSPMMQQSQANPAYQAPSDINGWAQGNMGGNSMFSQQSPPHFGQQANTSMYSNNMNINVSMATNTGGMSSMNQMTGQISMTSVTSVPTSGLSSMGPEQVNDPALRGGNLFPNQLPGMDMIKQEGDTTRKYC

SEQ ID NO: 58307 - protein, 590 aa, Homo sapiens
  Payload ID: 11415
  Gene Symbol: NCOA2
  Gene Name: nuclear receptor coactivator 2
  ENSP ID: ENSP00000429132
  MOD_RES (1)..(1): Any amino acid
XEEILDDLQNSQLPQLFPDTRPGAPAGSVDKQAIINDLMQLTAENSPVTPVGAQKTALRISQSRMIGNSASRPTMPSGEWAPQSSAVRVTCAATTSAMNRPVQGGMIRNPAASIPMRPSSQPGQRQTLQSQVMNIGPSELEMNMGGPQYSQQQAPPNQTAPWPESILPIDQASFASQNRQPFGSSPDDLLCPHPAAESPSDEGALLDQLYLALRNFDGLEEIDRALGIPELVSQSQAVDPEQFSSQDSNIMLEQKAPVFPQQYASQAQMAQGSYSPMQDPNFHTMGQRPSYATLRMQPRPGLRPTGLVQNQPNQLRLQLQHRLQAQQNRQPLMNQISNVSNVNLTLRPGVPTQAPINAQMLAQRQREILNQHLRQRQMHQQQQVQQRTLMMRGQGLNMTPSMVAPSGMPATMSNPRIPQANAQQFPFPPNYGISQQPDPGFTGATTPQSPLMSPRMAHTQSPMMQQSQANPAYQAPSDINGWAQGNMGGNSMFSQQSPPHFGQQANTSMYSNNMNINVSMATNTGGMSSMNQMTGQISMTSVTSVPTSGLSSMGPEQVNDPALRGGNLFPNQLPGMDMIKQEGDTTRKYC

SEQ ID NO: 58308 - protein, 946 aa, Homo sapiens
  Payload ID: 11415
  Gene Symbol: NCOA2
  Gene Name: nuclear receptor coactivator 2
  ENSP ID: ENSP00000430148
MSGMGENTSDPSRAETRKRKECPDQLGPSPKRNTEKRNREQENKYIEELAELIFANFNDIDNFNFKPDKCAILKETVKQIRQIKEQEKAAAANIDEVQKSDVSSTGQGVIDKDALGPMMLEALDGFFFVVNLEGNVVFVSENVTQYLRYNQEELMNKSVYSILHVGDHTEFVKNLLPKSIVNGGSWSGEPPRRNSHTFNCRMLVKPLPDSEEEGHDNQEAHQKYETMQCFAVSQPKSIKEEGEDLQSCLICVARRVPMKERPVLPSSESFTTRQDLQGKITSLDTSTMRAAMKPGWEDLVRRCIQKFHAQHEGESVSYAKRHHHEVLRQGLAFSQIYRFSLSDGTLVAAQTKSKLIRSQTTNEPQLVISLHMLHREQNVCVMNPDLTGQTMGKPLNPISSNSPAHQALCSGNPGQDMTLSSNINFPINGPKEQMGMPMGRFGGSGGMNHVSGMQATTPQGSNYALKMNSPSQSSPGMNPGQPTSMLSPRHRMSPGVAGSPRIPPSQFSPAGSLHSPVGVCSSTGNSHSYTNSSLNALQALSEGHGVSLGSSLASPDLKMGNLQNSPVNMNPPPLSKMGSLDSKDCFGLYGEPSEGTTGQAESSCHPGEQKETNDPNLPPAVSSERADGQSRLHDSKGQTKLLQLLTTKSDQMEPSPLASSLSDTNKDSTGSLPGSGSTHGTSLKEKHKILHRLLQDSSSPVDLAKLTAEATGKDLSQESSSTAPGSEVTIKQEPVSPKKKENALLRYLLDKDDTKDIGLPEITPKLERLDSKTDPASNTKLIAMKTEKEEMSFEPGDQPGSELDNLEEILDDLQNSQLPQLFPDTRPGAPAGSVDKQAIINDLMQLTAENSPVTPVGAQKTALRISQSRMIGNSASRPTMPSGEWAPQSSAVRVTCAATTSAMNRPVQGGMIRNPAASIPMRPSSQPGQRQTLQSQVMNIGKGHLN

SEQ ID NO: 58309 - protein, 16 aa, Homo sapiens
  Payload ID: 11415
  Gene Symbol: NCOA2
  Gene Name: nuclear receptor coactivator 2
  ENSP ID: ENSP00000430348
MSGMGENTSDPSRAET

SEQ ID NO: 58310 - protein, 8 aa, Homo sapiens
  Payload ID: 11415
  Gene Symbol: NCOA2
  Gene Name: nuclear receptor coactivator 2
  ENSP ID: ENSP00000430850
MSGMGENT

SEQ ID NO: 58311 - protein, 1415 aa, Homo sapiens
  Payload ID: 11416
  Gene Symbol: NCOA3
  Gene Name: nuclear receptor coactivator 3
  Uniprot ID: Q9Y6Q9
  ENSP ID: ENSP00000361065
MSGLGENLDPLASDSRKRKLPCDTPGQGLTCSGEKRRREQESKYIEELAELISANLSDIDNFNVKPDKCAILKETVRQIRQIKEQGKTISNDDDVQKADVSSTGQGVIDKDSLGPLLLQALDGFLFVVNRDGNIVFVSENVTQYLQYKQEDLVNTSVYNILHEEDRKDFLKNLPKSTVNGVSWTNETQRQKSHTFNCRMLMKTPHDILEDINASPEMRQRYETMQCFALSQPRAMMEEGEDLQSCMICVARRITTGERTFPSNPESFITRHDLSGKVVNIDTNSLRSSMRPGFEDIIRRCIQRFFSLNDGQSWSQKRHYQEVTSDGIFSPTAYLNGHAETPVYRFSLADGTIVTAQTKSKLFRNPVTNDRHGFVSTHFLQREQNGYRPNPNPVGQGIRPPMAGCNSSVGGMSMSPNQGLQMPSSRAYGLADPSTTGQMSGARYGGSSNIASLTPGPGMQSPSSYQNNNYGLNMSSPPHGSPGLAPNQQNIMISPRNRGSPKIASHQFSPVAGVHSPMASSGNTGNHSFSSSSLSALQAISEGVGTSLLSTLSSPGPKLDNSPNMNITQPSKVSNQDSKSPLGFYCDQNPVESSMCQSNSRDHLSDKESKESSVEGAENQRGPLESKGHKKLLQLLTCSSDDRGHSSLTNSPLDSSCKESSVSVTSPSGVSSSTSGGVSSTSNMHGSLLQEKHRILHKLLQNGNSPAEVAKITAEATGKDTSSITSCGDGNVVKQEQLSPKKKENNALLRYLLDRDDPSDALSKELQPQVEGVDNKMSQCTSSTIPSSSQEKDPKIKTETSEEGSGDLDNLDAILGDLTSSDFYNNSISSNGSHLGTKQQVFQGTNSLGLKSSQSVQSIRPPYNRAVSLDSPVSVGSSPPVKNISAFPMLPKQPMLGGNPRMMDSQENYGSSMGDWGLPNSKAGRMEPMNSNSMGRPGGDYNTSLPRPALGGSIPTLPLRSNSIPGARPVLQQQQQMLQMRPGEIPMGMGANPYGQAAASNQLGSWPDGMLSMEQVSHGTQNRPLLRNSLDDLVGPPSNLEGQSDERALLDQLHTLLSNTDATGLEEIDRALGIPELVNQGQALEPKQDAFQGQEAAVMMDQKAGLYGQTYPAQGPPMQGGFHLQGQSPSFNSMMNQMNQQGNFPLQGMHPRANIMRPRTNTPKQLRMQLQQRLQGQQFLNQSRQALELKMENPTAGGAAVMRPMMQPQQGFLNAQMVAQRSRELLSHHFRQQRVAMMMQQQQQQQQQQQQQQQQQQQQQQQQQQQQQTQAFSPPPNVTASPSMDGLLAGPTMPQAPPQQFPYQPNYGMGQQPDPAFGRVSSPPNAMMSSRMGPSQNPMMQHPQAASIYQSSEMKGWPSGNLARNSSFSQQQFAHQGNPAVYSMVHMNGSSGHMGQMNMNPMPMSGMPMGPDQKYC

SEQ ID NO: 58312 - protein, 1424 aa, Homo sapiens
  Payload ID: 11416
  Gene Symbol: NCOA3
  Gene Name: nuclear receptor coactivator 3
  Uniprot ID: Q9Y6Q9
  ENSP ID: ENSP00000361066
MSGLGENLDPLASDSRKRKLPCDTPGQGLTCSGEKRRREQESKYIEELAELISANLSDIDNFNVKPDKCAILKETVRQIRQIKEQGKTISNDDDVQKADVSSTGQGVIDKDSLGPLLLQALDGFLFVVNRDGNIVFVSENVTQYLQYKQEDLVNTSVYNILHEEDRKDFLKNLPKSTVNGVSWTNETQRQKSHTFNCRMLMKTPHDILEDINASPEMRQRYETMQCFALSQPRAMMEEGEDLQSCMICVARRITTGERTFPSNPESFITRHDLSGKVVNIDTNSLRSSMRPGFEDIIRRCIQRFFSLNDGQSWSQKRHYQEAYLNGHAETPVYRFSLADGTIVTAQTKSKLFRNPVTNDRHGFVSTHFLQREQNGYRPNPNPVGQGIRPPMAGCNSSVGGMSMSPNQGLQMPSSRAYGLADPSTTGQMSGARYGGSSNIASLTPGPGMQSPSSYQNNNYGLNMSSPPHGSPGLAPNQQNIMISPRNRGSPKIASHQFSPVAGVHSPMASSGNTGNHSFSSSSLSALQAISEGVGTSLLSTLSSPGPKLDNSPNMNITQPSKVSNQDSKSPLGFYCDQNPVESSMCQSNSRDHLSDKESKESSVEGAENQRGPLESKGHKKLLQLLTCSSDDRGHSSLTNSPLDSSCKESSVSVTSPSGVSSSTSGGVSSTSNMHGSLLQEKHRILHKLLQNGNSPAEVAKITAEATGKDTSSITSCGDGNVVKQEQLSPKKKENNALLRYLLDRDDPSDALSKELQPQVEGVDNKMSQCTSSTIPSSSQEKDPKIKTETSEEGSGDLDNLDAILGDLTSSDFYNNSISSNGSHLGTKQQVFQGTNSLGLKSSQSVQSIRPPYNRAVSLDSPVSVGSSPPVKNISAFPMLPKQPMLGGNPRMMDSQENYGSSMGGPNRNVTVTQTPSSGDWGLPNSKAGRMEPMNSNSMGRPGGDYNTSLPRPALGGSIPTLPLRSNSIPGARPVLQQQQQMLQMRPGEIPMGMGANPYGQAAASNQLGSWPDGMLSMEQVSHGTQNRPLLRNSLDDLVGPPSNLEGQSDERALLDQLHTLLSNTDATGLEEIDRALGIPELVNQGQALEPKQDAFQGQEAAVMMDQKAGLYGQTYPAQGPPMQGGFHLQGQSPSFNSMMNQMNQQGNFPLQGMHPRANIMRPRTNTPKQLRMQLQQRLQGQQFLNQSRQALELKMENPTAGGAAVMRPMMQPQVSSQQGFLNAQMVAQRSRELLSHHFRQQRVAMMMQQQQQQQQQQQQQQQQQQQQQQQQQQQQQTQAFSPPPNVTASPSMDGLLAGPTMPQAPPQQFPYQPNYGMGQQPDPAFGRVSSPPNAMMSSRMGPSQNPMMQHPQAASIYQSSEMKGWPSGNLARNSSFSQQQFAHQGNPAVYSMVHMNGSSGHMGQMNMNPMPMSGMPMGPDQKYC

SEQ ID NO: 58313 - protein, 1420 aa, Homo sapiens
  Payload ID: 11416
  Gene Symbol: NCOA3
  Gene Name: nuclear receptor coactivator 3
  Uniprot ID: Q9Y6Q9
  ENSP ID: ENSP00000361073
MSGLGENLDPLASDSRKRKLPCDTPGQGLTCSGEKRRREQESKYIEELAELISANLSDIDNFNVKPDKCAILKETVRQIRQIKEQGKTISNDDDVQKADVSSTGQGVIDKDSLGPLLLQALDGFLFVVNRDGNIVFVSENVTQYLQYKQEDLVNTSVYNILHEEDRKDFLKNLPKSTVNGVSWTNETQRQKSHTFNCRMLMKTPHDILEDINASPEMRQRYETMQCFALSQPRAMMEEGEDLQSCMICVARRITTGERTFPSNPESFITRHDLSGKVVNIDTNSLRSSMRPGFEDIIRRCIQRFFSLNDGQSWSQKRHYQEAYLNGHAETPVYRFSLADGTIVTAQTKSKLFRNPVTNDRHGFVSTHFLQREQNGYRPNPNPVGQGIRPPMAGCNSSVGGMSMSPNQGLQMPSSRAYGLADPSTTGQMSGARYGGSSNIASLTPGPGMQSPSSYQNNNYGLNMSSPPHGSPGLAPNQQNIMISPRNRGSPKIASHQFSPVAGVHSPMASSGNTGNHSFSSSSLSALQAISEGVGTSLLSTLSSPGPKLDNSPNMNITQPSKVSNQDSKSPLGFYCDQNPVESSMCQSNSRDHLSDKESKESSVEGAENQRGPLESKGHKKLLQLLTCSSDDRGHSSLTNSPLDSSCKESSVSVTSPSGVSSSTSGGVSSTSNMHGSLLQEKHRILHKLLQNGNSPAEVAKITAEATGKDTSSITSCGDGNVVKQEQLSPKKKENNALLRYLLDRDDPSDALSKELQPQVEGVDNKMSQCTSSTIPSSSQEKDPKIKTETSEEGSGDLDNLDAILGDLTSSDFYNNSISSNGSHLGTKQQVFQGTNSLGLKSSQSVQSIRPPYNRAVSLDSPVSVGSSPPVKNISAFPMLPKQPMLGGNPRMMDSQENYGSSMGGPNRNVTVTQTPSSGDWGLPNSKAGRMEPMNSNSMGRPGGDYNTSLPRPALGGSIPTLPLRSNSIPGARPVLQQQQQMLQMRPGEIPMGMGANPYGQAAASNQLGSWPDGMLSMEQVSHGTQNRPLLRNSLDDLVGPPSNLEGQSDERALLDQLHTLLSNTDATGLEEIDRALGIPELVNQGQALEPKQDAFQGQEAAVMMDQKAGLYGQTYPAQGPPMQGGFHLQGQSPSFNSMMNQMNQQGNFPLQGMHPRANIMRPRTNTPKQLRMQLQQRLQGQQFLNQSRQALELKMENPTAGGAAVMRPMMQPQQGFLNAQMVAQRSRELLSHHFRQQRVAMMMQQQQQQQQQQQQQQQQQQQQQQQQQQQQQTQAFSPPPNVTASPSMDGLLAGPTMPQAPPQQFPYQPNYGMGQQPDPAFGRVSSPPNAMMSSRMGPSQNPMMQHPQAASIYQSSEMKGWPSGNLARNSSFSQQQFAHQGNPAVYSMVHMNGSSGHMGQMNMNPMPMSGMPMGPDQKYC

SEQ ID NO: 58314 - protein, 448 aa, Homo sapiens
  Payload ID: 11417
  Gene Symbol: NCOA4
  Gene Name: nuclear receptor coactivator 4
  ENSP ID: ENSP00000462352
MAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKFKSPMNTSWCSFNTADWVLPGKKMGNLSQLSSGEDKWLLRKKAQEVLLNSPLQEEHNFPPDHYGLPAVCDLFACMQLKVDKEKWLYRTPLQM

SEQ ID NO: 58315 - protein, 614 aa, Homo sapiens
  Payload ID: 11417
  Gene Symbol: NCOA4
  Gene Name: nuclear receptor coactivator 4
  Uniprot ID: Q13772
  ENSP ID: ENSP00000462943
MNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKFKSPMNTSWCSFNTADWVLPGKKMGNLSQLSSGEDKWLLRKKAQEVLLNSPLQEEHNFPPDHYGLPAVCDLFACMQLKVDKEKWLYRTPLQM

SEQ ID NO: 58316 - protein, 514 aa, Homo sapiens
  Payload ID: 11417
  Gene Symbol: NCOA4
  Gene Name: nuclear receptor coactivator 4
  ENSP ID: ENSP00000463022
MNRWTLFISLKRRHFNSRLSSSTRLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKFKSPMNTSWCSFNTADWVLPGKKMGNLSQLSSGEDKWLLRKKAQEVLLNSPLQEEHNFPPDHYGLPAVCDLFACMQLKVDKEKWLYRTPLQM

SEQ ID NO: 58317 - protein, 650 aa, Homo sapiens
  Payload ID: 11417
  Gene Symbol: NCOA4
  Gene Name: nuclear receptor coactivator 4
  Uniprot ID: Q13772
  ENSP ID: ENSP00000463027
MGAQLTTFALAGAVRRMNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKFKSPMNTSWCSFNTADWVLPGKKMGNLSQLSSGEDKWLLRKKAQEVLLNSPLQEEHNFPPDHYGLPAVCDLFACMQLKVDKEKWLYRTPLQAYFKMNFQDVTVGNFQIPCGF

SEQ ID NO: 58318 - protein, 630 aa, Homo sapiens
  Payload ID: 11417
  Gene Symbol: NCOA4
  Gene Name: nuclear receptor coactivator 4
  Uniprot ID: Q13772
  ENSP ID: ENSP00000463455
MGAQLTTFALAGAVRRMNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKFKSPMNTSWCSFNTADWVLPGKKMGNLSQLSSGEDKWLLRKKAQEVLLNSPLQEEHNFPPDHYGLPAVCDLFACMQLKVDKEKWLYRTPLQM

SEQ ID NO: 58319 - protein, 614 aa, Homo sapiens; identical to SEQ ID NO: 58315
  Payload ID: 11417
  Gene Symbol: NCOA4
  Gene Name: nuclear receptor coactivator 4
  Uniprot ID: Q13772
  ENSP ID: ENSP00000463476

SEQ ID NO: 58320 - protein, 614 aa, Homo sapiens; identical to SEQ ID NO: 58315
  Payload ID: 11417
  Gene Symbol: NCOA4
  Gene Name: nuclear receptor coactivator 4
  Uniprot ID: Q13772
  ENSP ID: ENSP00000464054

SEQ ID NO: 58321 - protein, 579 aa, Homo sapiens
  Payload ID: 11418
  Gene Symbol: NCOA5
  Gene Name: nuclear receptor coactivator 5
  Uniprot ID: Q9HCD5
  ENSP ID: ENSP00000290231
MNTAPSRPSPTRRDPYGFGDSRDSRRDRSPIRGSPRREPRDGRNGRDARDSRDIRDPRDLRDHRHSRDLRDHRDSRSVRDVRDVRDLRDFRDLRDSRDFRDQRDPMYDRYRDMRDSRDPMYRREGSYDRYLRMDDYCRRKDDSYFDRYRDSFDGRGPPGPESQSRAKERLKREERRREELYRQYFEEIQRRFDAERPVDCSVIVVNKQTKDYAESVGRKVRDLGMVVDLIFLNTEVSLSQALEDVSRGGSPFAIVITQQHQIHRSCTVNIMFGTPQEHRNMPQADAMVLVARNYERYKNECREKEREEIARQAAKMADEAILQERERGGPEEGVRGGHPPAIQSLINLLADNRYLTAEETDKIINYLRERKERLMRSSTDSLPGPISRQPLGATSGASLKTQPSSQPLQSGQVLPSATPTPSAPPTSQQELQAKILSLFNSGTVTANSSSASPSVAAGNTPNQNFSTAANSQPQQRSQASGNQPPSILGQGGSAQNMGPRPGAPSQGLFGQPSSRLAPASNMTSQRPVSSTGINFDNPSVQKALDTLIQSGPALSHLVSQTTAQMGQPQAPMGSYQRHY

SEQ ID NO: 58322 - protein, 104 aa, Homo sapiens
  Payload ID: 11418
  Gene Symbol: NCOA5
  Gene Name: nuclear receptor coactivator 5
  ENSP ID: ENSP00000361365
MYDRYRDMRDSRDPMYRREGSYDRYLRMDDYCRRKDDSYFDRYRDSFDGRGPPGPESQSRAKERLKREERRREELYRQYFEEIQRRFDAERPVDCSVIVVNKQT

SEQ ID NO: 58323 - protein, 2063 aa, Homo sapiens
  Payload ID: 11419
  Gene Symbol: NCOA6
  Gene Name: nuclear receptor coactivator 6
  Uniprot ID: Q14686
  ENSP ID: ENSP00000351894
MVLDDLPNLEDIYTSLCSSTMEDSEMDFDSGLEDDDTKSDSILEDSTIFVAFKGNIDDKDFKWKLDAILKNVPNLLHMESSKLKVQKVEPWNSVRVTFNIPREAAERLRILAQSNNQQLRDLGILSVQIEGEGAINLALAQNRSQDVRMNGPMGAGNSVRMEAGFPMASGPGIIRMNNPATVMIPPGGNVSSSMMAPGPNPELQPRTPRPASQSDAMDPLLSGLHIQQQSHPSGSLAPPHHPMQPVSVNRQMNPANFPQLQQQQQQQQQQQQQQQQQQQQQQQQQLQARPPQQHQQQQPQGIRPQFTAPTQVPVPPGWNQLPSGALQPPPAQGSLGTMTANQGWKKAPLPGPMQQQLQARPSLATVQTPSHPPPPYPFGSQQASQAHTNFPQMSNPGQFTAPQMKSLQGGPSRVPTPLQQPHLTNKSPASSPSSFQQGSPASSPTVNQTQQQMGPRPPQNNPLPQGFQQPVSSPGRNPMVQQGNVPPNFMVMQQQPPNQGPQSLHPGLGGMPKRLPPGFSAGQANPNFMQGQVPSTTATTPGNSGAPQLQANQNVQHAGGQGAGPPQNQMQVSHGPPNMMQPSLMGIHGNMNNQQAGTSGVPQVNLSNMQGQPQQGPPSQLMGMHQQIVPSQGQMVQQQGTLNPQNPMILSRAQLMPQGQMMVNPPSQNLGPSPQRMTPPKQMLSQQGPQMMAPHNQMMGPQGQVLLQQNPMIEQIMTNQMQGNKQQFNTQNQSNVMPGPAQIMRGPTPNMQGNMVQFTGQMSGQMLPQQGPVNNSPSQVMGIQGQVLRPPGPSPHMAQQHGDPATTANNDVSLSQMMPDVSIQQTNMVPPHVQAMQGNSASGNHFSGHGMSFNAPFSGAPNGNQMSCGQNPGFPVNKDVTLTSPLLVNLLQSDISAGHFGVNNKQNNTNANKPKKKKPPRKKKNSQQDLNTPDTRPAGLEEADQPPLPGEQGINLDNSGPKLPEFSNRPPGYPSQPVEQRPLQQMPPQLMQHVAPPPQPPQQQPQPQLPQQQQPPPPSQPQSQQQQQQQQQMMMMLMMQQDPKSVRLPVSQNVHPPRGPLNPDSQRMPMQQSGSVPVMVSLQGPASVPPSPDKQRMPMPVNTPLGSNSRKMVYQESPQNPSSSPLAEMASLPEASGSEAPSVPGGPNNMPSHVVLPQNQLMMTGPKPGPSPLSATQGATPQQPPVNSLPSSHGHHFPNVAAPTQTSRPKTPNRASPRPYYPQTPNNRPPSTEPSEISLSPERLNASIAGLFPPQINIPLPPRPNLNRGFDQQGLNPTTLKAIGQAPSNLTMNPSNFATPQTHKLDSVVVNSGKQSNSGATKRASPSNSRRSSPGSSRKTTPSPGRQNSKAPKLTLASQTNAALLQNVELPRNVLVSPTPLANPPVPGSFPNNSGLNPQNSTVSVAAVGGVVEDNKESLNVPQDSDCQNSQSRKEQVNIELKAVPAQEVKMVVPEDQSKKDGQPSDPNKLPSVEENKNLVSPAMREAPTSLSQLLDNSGAPNVTIKPPGLTDLEVTPPVVSGEDLKKASVIPTLQDLSSSKEPSNSLNLPHSNELCSSLVHPELSEVSSNVAPSIPPVMSRPVSSSSISTPLPPNQITVFVTSNPITTSANTSAALPTHLQSALMSTVVTMPNAGSKVMVSEGQSAAQSNARPQFITPVFINSSSIIQVMKGSQPSTIPAAPLTTNSGLMPPSVAVVGPLHIPQNIKFSSAPVPPNALSSSPAPNIQTGRPLVLSSRATPVQLPSPPCTSSPVVPSHPPVQQVKELNPDEASPQVNTSADQNTLPSSQSTTMVSPLLTNSPGSSGNRRSPVSSSKGKGKVDKIGQILLTKACKKVTGSLEKGEEQYGADGETEGQGLDTTAPGLMGTEQLSTELDSKTPTPPAPTLLKMTSSPVGPGTASAGPSLPGGALPTSVRSIVTTLVPSELISAVPTTKSNHGGIASESLAGGLVEEKVGSHPELLPSIAPSQNLVSKETSTTALQASVARPELEVNAAIVSGQSSEPKEIVEKSKIPGRRNSRTEEPTVASESVENGHRKRSSRPASASSSTKDITSAVQSKRRKSK

SEQ ID NO: 58324 - protein, 2063 aa, Homo sapiens; identical to SEQ ID NO: 58323
  Payload ID: 11419
  Gene Symbol: NCOA6
  Gene Name: nuclear receptor coactivator 6
  Uniprot ID: Q14686
  ENSP ID: ENSP00000363929

SEQ ID NO: 58325 - protein, 1070 aa, Homo sapiens
  Payload ID: 11419
  Gene Symbol: NCOA6
  Gene Name: nuclear receptor coactivator 6
  ENSP ID: ENSP00000481177
MVLDDLPNLEDIYTSLCSSTMEDSEMDFDSGLEDDDTKSDSILEDSTIFVAFKGNIDDKDFKWKLDAILKNVPNLLHMESSKLKVQKVEPWNSVRVTFNIPREAAERLRILAQSNNQQLRDLGILSVQIEGEGAINLALAQNRSQDVRMNGPMGAGNSVRMEAGFPMASGPGIIRMNNPATVMIPPGGNVSSSMMAPGPNPELQPRTPRPASQSDAMDPLLSGLHIQQQSHPSGSLAPPHHPMQPVSVNRQMNPANFPQLQQQQQQQQQQQQQQQQQQQQQQQQQLQARPPQQHQQQQPQGIRPQFTAPTQVPVPPGWNQLPSGALQPPPAQGSLGTMTANQGWKKAPLPGPMQQQLQARPSLATVQTPSHPPPPYPFGSQQASQAHTNFPQMSNPGQFTAPQMKSLQGGPSRVPTPLQQPHLTNKSPASSPSSFQQGSPASSPTVNQTQQQMGPRPPQNNPLPQGFQQPVSSPGRNPMVQQGNVPPNFMVMQQQPPNQGPQSLHPGLGGMPKRLPPGFSAGQANPNFMQGQVPSTTATTPGNSGAPQLQANQNVQHAGGQGAGPPQNQMQVSHGPPNMMQPSLMGIHGNMNNQQAGTSGVPQVNLSNMQGQPQQGPPSQLMGMHQQIVPSQGQMVQQQGTLNPQNPMILSRAQLMPQGQMMVNPPSQNLGPSPQRMTPPKQMLSQQGPQMMAPHNQMMGPQGQVLLQQNPMIEQIMTNQMQGNKQQFNTQNQSNVMPGPAQIMRGPTPNMQGNMVQFTGQMSGQMLPQQGPVNNSPSQVMGIQGQVLRPPGPSPHMAQQHGDPATTANNDVSLSQMMPDVSIQQTNMVPPHVQAMQGNSASGNHFSGHGMSFNAPFSGAPNGNQMSCGQNPGFPVNKDVTLTSPLLVNLLQSDISAGHFGVNNKQNNTNANKPKKKKPPRKKKNSQQDLNTPDTRPAGLEEADQPPLPGEQGINLDNSGPKLPEFSNRPPAPSQNLVSKETSTTALQASVARPELEVNAAIVSGQSSEPKEIVEKSKIPGRRNSRTEEPTVASESVENGHRKRSSRPASASSSTKDITSAVQSKRRKSK

SEQ ID NO: 58326 - protein, 982 aa, Homo sapiens
  Payload ID: 11419
  Gene Symbol: NCOA6
  Gene Name: nuclear receptor coactivator 6
  ENSP ID: ENSP00000481935
MVLDDLPNLEDIYTSLCSSTMEDSEMDFDSGLEDDDTKSDSILEDSTIFVAFKGNIDDKDFKWKLDAILKNVPNLLHMESSKLKVQKVEPWNSVRVTFNIPREAAERLRILAQSNNQQLRDLGILSVQIEGEGAINLALAQNRSQDVRMNGPMGAGNSVRMEAGFPMASGPGIIRMNNPATVMIPPGGNVSSSMMAPGPNPELQPRTPRPASQSDAMDPLLSGLHIQQQSHPSGSLAPPHHPMQPVSVNRQMNPANFPQLQQQQQQQQQQQQQQQQQQQQQQQQQLQARPPQQHQQQQPQGIRPQFTAPTQVPVPPGWNQLPSGALQPPPAQGSLGTMTANQGWKKAPLPGPMQQQLQARPSLATVQTPSHPPPPYPFGSQQASQAHTNFPQMSNPGQFTAPQMKSLQGGPSRVPTPLQQPHLTNKSPASSPSSFQQGSPASSPTVNQTQQQMGPRPPQNNPLPQGFQQPVSSPGRNPMVQQGNVPPNFMVMQQQPPNQGPQSLHPGLGGMPKRLPPGFSAGQANPNFMQGQVPSTTATTPGNSGAPQLQANQNVQHAGGQGAGPPQNQMQVSHGPPNMMQPSLMGIHGNMNNQQAGTSGVPQVNLSNMQGQPQQGPPSQLMGMHQQIVPSQGQMVQQQGTLNPQNPMILSRAQLMPQGQMMVNPPSQNLGPSPQRMTPPKQMLSQQGPQMMAPHNQMMGPQGQVLLQQNPMIEQIMTNQMQGNKQQFNTQNQSNVMPGPAQIMRGPTPNMQGNMVQFTGQMSGQMLPQQGPVNNSPSQVMGIQGQVLRPPGPSPHMAQQHGDPATTANNDVSLSQMMPDVSIQQTNMVPPHVQAMQGNSASGNHFSGHGMSFNAPFSGAPNGNQMSCGQNPGFPVNKDVTLTSPLLVNLLQSDISAGHFGVNNKQNNTNANKPKKKKPPRKKKNSQQDLNTPDTRPAGLEEADQPPLPGEQGINLDNSGPKLPEFSNRPPAKMLRVPTTEW

SEQ ID NO: 58327 - protein, 220 aa, Homo sapiens
  Payload ID: 11419
  Gene Symbol: NCOA6
  Gene Name: nuclear receptor coactivator 6
  ENSP ID: ENSP00000486894
  MOD_RES (1)..(1): Any amino acid
XPGFPVNKDVTLTSPLLVNLLQSDISAGHFGVNNKQNNTNANKPKKKKPPRKKKNSQQDLNTPDTRPAGLEEADQPPLPGEQGINLDNSGPKLPEFSNRPPAPSQNLVSKETSTTALQASVARPELEVNAAIVSGQSSEPKEIVEKSKIPGRRNSRTEEPTVASESVENGHRKRSSRPASASSSTKAGAPMKDQMLCVERATRGGPKRDLYKLRVESGPL

SEQ ID NO: 58328 - protein, 827 aa, Homo sapiens
  Payload ID: 11420
  Gene Symbol: NCOA7
  Gene Name: nuclear receptor coactivator 7
  Uniprot ID: Q8NI08
  ENSP ID: ENSP00000229634
MVVQKPHGTMEYTAGNQDTLNSIALKFNITPNKLVELNKLFTHTIVPGQVLFVPDANSPSSTLRLSSSSPGATVSPSSSDAEYDKLPDADLARKALKPIERVLSSTSEEDEPGVVKFLKMNCRYFTDGKGVVGGVMIVTPNNIMFDPHKSDPLVIENGCEEYGLICPMEEVVSIALYNDISHMKIKDALPSPGEWEDLASEKDINPFSKFKSINKEKRQQNGEKIMTSDSRPIVPLEKSTGHTPTKPSGSSVSEKLKKLDSSRETSHGSPTVTKLSKEPSDTSSAFESTAKENFLGEDDDFVDLEELSSQTGGGMHKKDTLKECLSLDPEERKKAESQINNSAVEMQVQSALAFLGTENDVELKGALDLETCEKQDIMPEVDKQSGSPESRVENTLNIHEDLDKVKLIEYYLTKNKEGPQVSENLQKTELSDGKSIEPGGIDITLSSSLSQAGDPITEGNKEPDKTWVKKGEPLPVKLNSSTEANVIKEALDSSLESTLDNSCQGAQMDNKSEVQLWLLKRIQVPIEDILPSKEEKSKTPPMFLCIKVGKPMRKSFATHTAAMVQQYGKRRKQPEYWFAVPRERVDHLYTFFVQWSPDVYGKDAKEQGFVVVEKEELNMIDNFFSEPTTKSWEIITVEEAKRRKSTCSYYEDEDEEVLPVLRPHSALLENMHIEQLARRLPARVQGYPWRLAYSTLEHGTSLKTLYRKSASLDSPVLLVIKDMDNQIFGAYATHPFKFSDHYYGTGETFLYTFSPHFKVFKWSGENSYFINGDISSLELGGGGGRFGLWLDADLYHGRSNSCSTFNNDILSKKEDFIVQDLEVWAFD

SEQ ID NO: 58329 - protein, 942 aa, Homo sapiens
  Payload ID: 11420
  Gene Symbol: NCOA7
  Gene Name: nuclear receptor coactivator 7
  Uniprot ID: Q8NI08
  ENSP ID: ENSP00000357341
MDTKEEKKERKQSYFARLKKKKQAKQNAETASAVATRTHTGKEDNNTVVLEPDKCNIAVEEEYMTDEKKKRKSNQLKEIRRTELKRYYSIDDNQNKTHDKKEKKMVVQKPHGTMEYTAGNQDTLNSIALKFNITPNKLVELNKLFTHTIVPGQVLFVPDANSPSSTLRLSSSSPGATVSPSSSDAEYDKLPDADLARKALKPIERVLSSTSEEDEPGVVKFLKMNCRYFTDGKGVVGGVMIVTPNNIMFDPHKSDPLVIENGCEEYGLICPMEEVVSIALYNDISHMKIKDALPSDLPQDLCPLYRPGEWEDLASEKDINPFSKFKSINKEKRQQNGEKIMTSDSRPIVPLEKSTGHTPTKPSGSSVSEKLKKLDSSRETSHGSPTVTKLSKEPSDTSSAFESTAKENFLGEDDDFVDLEELSSQTGGGMHKKDTLKECLSLDPEERKKAESQINNSAVEMQVQSALAFLGTENDVELKGALDLETCEKQDIMPEVDKQSGSPESRVENTLNIHEDLDKVKLIEYYLTKNKEGPQVSENLQKTELSDGKSIEPGGIDITLSSSLSQAGDPITEGNKEPDKTWVKKGEPLPVKLNSSTEANVIKEALDSSLESTLDNSCQGAQMDNKSEVQLWLLKRIQVPIEDILPSKEEKSKTPPMFLCIKVGKPMRKSFATHTAAMVQQYGKRRKQPEYWFAVPRERVDHLYTFFVQWSPDVYGKDAKEQGFVVVEKEELNMIDNFFSEPTTKSWEIITVEEAKRRKSTCSYYEDEDEEVLPVLRPHSALLENMHIEQLARRLPARVQGYPWRLAYSTLEHGTSLKTLYRKSASLDSPVLLVIKDMDNQIFGAYATHPFKFSDHYYGTGETFLYTFSPHFKVFKWSGENSYFINGDISSLELGGGGGRFGLWLDADLYHGRSNSCSTFNNDILSKKEDFIVQDLEVWAFD

SEQ ID NO: 58330 - protein, 942 aa, Homo sapiens; identical to SEQ ID NO: 58329
  Payload ID: 11420
  Gene Symbol: NCOA7
  Gene Name: nuclear receptor coactivator 7
  Uniprot ID: Q8NI08
  ENSP ID: ENSP00000376269

SEQ ID NO: 58331 - protein, 219 aa, Homo sapiens
  Payload ID: 11420
  Gene Symbol: NCOA7
  Gene Name: nuclear receptor coactivator 7
  ENSP ID: ENSP00000398268
MRGQRLPLDIQIFYCARPDEEPFVKIITVEEAKRRKSTCSYYEDEDEEVLPVLRPHSALLENMHIEQLARRLPARVQGYPWRLAYSTLEHGTSLKTLYRKSASLDSPVLLVIKDMDNQIFGAYATHPFKFSDHYYGTGETFLYTFSPHFKVFKWSGENSYFINGDISSLELGGGGGRFGLWLDADLYHGRSNSCSTFNNDILSKKEDFIVQDLEVWAFD

SEQ ID NO: 58332 - protein, 90 aa, Homo sapiens
  Payload ID: 11420
  Gene Symbol: NCOA7
  Gene Name: nuclear receptor coactivator 7
  ENSP ID: ENSP00000403643
MDTKEEKKERKQSYFARLKKKKQAKQNAETASAVATRTHTGKEDNNTVVLEPDKCNIAVEEEYMTDEKKKRKSNQLKEIRRTELKRYYSI

SEQ ID NO: 58333 - protein, 191 aa, Homo sapiens
  Payload ID: 11420
  Gene Symbol: NCOA7
  Gene Name: nuclear receptor coactivator 7
  ENSP ID: ENSP00000406363
MDTKEEKKERKQSYFARLKKKKQAKQNAETASAVATRTHTGKEDNNTVVLEPDKCNIAVEEEYMTDEKKKRKSNQLKEIRRTELKRYYSIDDNQNKTHDKKEKKMVVQKPHGTMEYTAGNQDTLNSIALKFNITPNKLVELNKLFTHTIVPGQVLFVPDANSPSSTLRLSSSSPGATVSPSSSDAEYDKLP

SEQ ID NO: 58334 - protein, 90 aa, Homo sapiens; identical to SEQ ID NO: 58332
  Payload ID: 11420
  Gene Symbol: NCOA7
  Gene Name: nuclear receptor coactivator 7
  ENSP ID: ENSP00000407426

SEQ ID NO: 58335 - protein, 159 aa, Homo sapiens
  Payload ID: 11420
  Gene Symbol: NCOA7
  Gene Name: nuclear receptor coactivator 7
  ENSP ID: ENSP00000407684
MRGQRLPLDIQIFYCARPDEEPFVKIITVEEAKRRKSTCSYYEDEDEEVLPVLRPHSALLENMHIEQLARRLPARVQGYPWRLAYSTLEHGTSLKTLYRKSASLDSPVLLVIKDMDNQIFGAYATHPFKFSDHYYGTGETFLYTFSPHFKGTIWFMARC

SEQ ID NO: 58336 - protein, 117 aa, Homo sapiens
  Payload ID: 11420
  Gene Symbol: NCOA7
  Gene Name: nuclear receptor coactivator 7
  ENSP ID: ENSP00000408211
MDTKEEKKERKQSYFARLKKKKQAKQNAETASAVATRTHTGKEDNNTVVLEPDKCNIAVEEEYMTDEKKKRKSNQLKEIRRTELKRYYSIDDNQNKTHDKKEKKMVVQKPHGTMEYT

SEQ ID NO: 58337 - protein, 2440 aa, Homo sapiens
  Payload ID: 11421
  Gene Symbol: NCOR1
  Gene Name: nuclear receptor corepressor 1
  Uniprot ID: O75376
  ENSP ID: ENSP00000268712
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPAAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKESKHEAARLEENLRSRSAAVSEQQQLEQKTLEVEKRSVQCLYTSSAFPSGKPQPHSSVVYSEAGKDKGPPPKSRYEEELRTRGKTTITAANFIDVIITRQIASDKDARERGSQSSDSSSSLSSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 58338 - protein, 914 aa, Homo sapiens
  Payload ID: 11421
  Gene Symbol: NCOR1
  Gene Name: nuclear receptor corepressor 1
  Uniprot ID: O75376
  ENSP ID: ENSP00000379189
MSSSGYPPNQGAFSTEQSRYPPHSVQYTFPNTRHQQDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEGR

SEQ ID NO: 58339 - protein, 1071 aa, Homo sapiens
  Payload ID: 11421
  Gene Symbol: NCOR1
  Gene Name: nuclear receptor corepressor 1
  ENSP ID: ENSP00000379190
  MOD_RES (1)..(1): Any amino acid
XSVESIPSLRGSITQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPAAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKESKHEAARLEENLRSRSAAVSEQQQLEQKTLEVEKRSVQCLYTSSAFPSGKPQPHSSVVYSEAGKDKGPPPKSRYEEELRTRGKTTITAANFIDVIITRQIASDKDARERGSQSSDSSSSLSSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 58340 - protein, 2337 aa, Homo sapiens
  Payload ID: 11421
  Gene Symbol: NCOR1
  Gene Name: nuclear receptor corepressor 1
  Uniprot ID: O75376
  ENSP ID: ENSP00000379192
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVTISSNKSTNHERKSTLTPTQRESIPAKSPVPGVDPVVSHSPFDPHHRGSTAGEVYRSHLPTHLDPAMPFHRALDPAAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKEISSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 58341 - protein, 2343 aa, Homo sapiens
  Payload ID: 11421
  Gene Symbol: NCOR1
  Gene Name: nuclear receptor corepressor 1
  ENSP ID: ENSP00000379198
MSSSGYPPNQGAFSTEQSRYPPHSVQYTFPNTRHQQDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKKEEEKKDEEEKDEKEDSKENTKEKDKIDGTAEETEEREQATPRGRKTANSQGRRKGRITRSMTNEAAAASAAAAAATEEPPPPLPPPPEPISTEPVETSRWTEEEMEVAKKGLVEHGRNWAAIAKMVGTKSEAQCKNFYFNYKRRHNLDNLLQQHKQKTSRKPREERDVSQCESVASTVSAQEDEDIEASNEEENPEDSEGAENSSDTESAPSPSPVEAVKPSEDSPENATSRGNTEPAVELEPTTETAPSTSPSLAVPSTKPAEDESVETQVNDSISAETAEQMDVDQQEHSAEEGSVCDPPPATKADSVDVEVRVPENHASKVEGDNTKERDLDRASEKVEPRDEDLVVAQQINAQRPEPQSDNDSSATCSADEDVDGEPERQRMFPMDSKPSLLNPTGSILVSSPLKPNPLDLPQLQHRAAVIPPMVSCTPCNIPIGTPVSGYALYQRHIKAMHESALLEEQRQRQEQIDLECRSSTSPCGTSKSPNREWEVLQPAPHQVITNLPEGVRLPTTRPTRPPPPLIPSSKTTVASEKPSFIMGGSISQGTPGTYLTSHNQASYTQETPKPSVGSISLGLPRQQESAKSATLPYIKQEEFSPRSQNSQPEGLLVRAQHEGVVRGTAGAIQEGSITRGTPTSKISVESIPSLRGSITQGTPALPQTGIPTEALVKGSISRMPIEDSSPEKGREEAASKGHVIYEGKSGHILSYDNIKNAREGTRSPRTAHEISLKRSYESVEGNIKQGMSMRESPVSAPLEGLICRALPRGSPHSDLKERTVLSGSIMQGTPRATTESFEDGLKYPKQIKRESPPIRAFEGAITKGKPYDGITTIKEMGRSIHEIPRQDILTQESRKTPEVVQSTRPIIEGSISQGTPIKFDNNSGQSAIKHNVKSLITGPSKLSRGMPPLEIVPENIKVVERGKYEDVKAGETVRSRHTSVVSSGPSVLRSTLHEAPKAQLSPGIYDDTSARRTPVSYQNTMSRGSPMMNRTSDVSSNKSTNHERKSTLTPTQRESIPAKSPVPGVDPVVSHSPFDPHHRGSTAGEVYRSHLPTHLDPAMPFHRALDPAAAYLFQRQLSPTPGYPSQYQLYAMENTRQTILNDYITSQQMQVNLRPDVARGLSPREQPLGLPYPATRGIIDLTNMPPTILVPHPGGTSTPPMDRITYIPGTQITFPPRPYNSASMSPGHPTHLAAAASAEREREREREKERERERIAAASSDLYLRPGSEQPGRPGSHGYVRSPSPSVRTQETMLQQRPSVFQGTNGTSVITPLDPTAQLRIMPLPAGGPSISQGLPASRYNTAADALAALVDAAASAPQMDVSKTKESKHEAARLEENLRSRSAAVSEQQQLEQKTLEVEKRSVQCLYTSSAFPSGKPQPHSSVVYSEAGKDKGPPPKSRYEEELRTRGKTTITAANFIDVIITRQIASDKDARERGSQSSDSSSSLSSHRYETPSDAIEVISPASSPAPPQEKLQTYQPEVVKANQAENDPTRQYEGPLHHYRPQQESPSPQQQLPPSSQAEGMGQVPRTHRLITLADHICQIITQDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTTSGSVSSRGHSFADPASNLGLEDIIRKALMGSFDDKVEDHGVVMSQPMGVVPGTANTSVVTSGETRREEGDPSPHSGVCKPKLISKSNSRKSKSPIPGQGYLGTERPSSVSSVHSEGDYHRQTPGWAWEDRPSSTGSTQFPYNPLTMRMLSSTPPTPIACAPSAVNQAAPHQQNRIWEREPAPLLSAQYETLSDSDD

SEQ ID NO: 58342 - protein, 537 aa, Homo sapiens
  Payload ID: 11421
  Gene Symbol: NCOR1
  Gene Name: nuclear receptor corepressor 1
  ENSP ID: ENSP00000387727
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTGVPARRMMKNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQIARPSQEEKVEEKEEDKAEKTEKK

SEQ ID NO: 58343 - protein, 92 aa, Homo sapiens
  Payload ID: 11421
  Gene Symbol: NCOR1
  Gene Name: nuclear receptor corepressor 1
  ENSP ID: ENSP00000389839
  MOD_RES (1)..(1): Any amino acid
XRSSTSPCGTSKSPNREWEGKSVAYMPYAEVKRALEQEAQMHNTAARSASPCRLSPREVSKAAPQPDMSAARYSVPPVLQPAPHQVITNLPE

SEQ ID NO: 58344 - protein, 545 aa, Homo sapiens
  Payload ID: 11421
  Gene Symbol: NCOR1
  Gene Name: nuclear receptor corepressor 1
  ENSP ID: ENSP00000407998
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQQIARPSQEEKVEEKEEDKAEKTEKKEEEKKDEEEKDEKEDS

SEQ ID NO: 58345 - protein, 125 aa, Homo sapiens
  Payload ID: 11421
  Gene Symbol: NCOR1
  Gene Name: nuclear receptor corepressor 1
  ENSP ID: ENSP00000410784
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAA

SEQ ID NO: 58346 - protein, 183 aa, Homo sapiens
  Payload ID: 11421
  Gene Symbol: NCOR1
  Gene Name: nuclear receptor corepressor 1
  ENSP ID: ENSP00000461959
ENTSPMVKSKKQEIFRKLNSSGGGDSDMAAQPGTEIFNLPAVTTSGSVSSRGHSFADPASNLGLEDIIRKALMGSFDDKVEDHGVVMSQPMGVVPGTANTSVVTSGETRREEGDPSPHSGGVCKPKLISKSNSRKSKSPIPGQGYLGTERPSSVSSVHSEGDYHRQTPGWAWEDRPSSTGSTQ

SEQ ID NO: 58347 - protein, 184 aa, Homo sapiens
  Payload ID: 11421
  Gene Symbol: NCOR1
  Gene Name: nuclear receptor corepressor 1
  ENSP ID: ENSP00000462281
  MOD_RES (1)..(1): Any amino acid
XTQDFARNQVSSQTPQQPPTSTFQNSPSALVSTPVRTKTSNRYSPESQAQSVHHQRPGSRVSPENLVDKSRGRPGKSPERSHVSSEPYEPISPPQVPVVHEKQDSLLLLSQRGAEPAEQRNDARSPGSISYLPSFFTKLENTSPMVKSKKQEIFRKLNSSGGGDSDMAAAQPGTEIFNLPAVTT

SEQ ID NO: 58348 - protein, 546 aa, Homo sapiens
  Payload ID: 11421
  Gene Symbol: NCOR1
  Gene Name: nuclear receptor corepressor 1
  ENSP ID: ENSP00000462308
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFEGLGPKVELPLYNQPSDTKVYHENIKTGVPARRMMKNQVMRKKLILFFKRRNHARKQREQKICQRYDQLMEAWEKKVDRIENNPRRKAKESKTREYYEKQFPEIRKQREQQERFQRVGQRGAGLSATIARSEHEISEIIDGLSEQENNEKQMRQLSVIPPMMFDAEQRRVKFINMNGLMEDPMKVYKDRQFMNVWTDHEKEIFKDKFIQHPKNFGLIASYLERKSVPDCVLYYYLTKKNENYKALVRRNYGKRRGRNQQQIARPSQEEKVEEKEEDKAEKTEKKEEEKKDEE

SEQ ID NO: 58349 - protein, 88 aa, Homo sapiens
  Payload ID: 11421
  Gene Symbol: NCOR1
  Gene Name: nuclear receptor corepressor 1
  ENSP ID: ENSP00000462794
MSSSGYPPNQGAFSTEQSRYPPHSVQYTFPNTRHQQEFAVPDYRSSHLEVSQASQLLQQQQQQQLRRRPSLLSEFHPGSDSVYFLCMY

SEQ ID NO: 58350 - protein, 217 aa, Homo sapiens
  Payload ID: 11421
  Gene Symbol: NCOR1
  Gene Name: nuclear receptor corepressor 1
  ENSP ID: ENSP00000463169
  MOD_RES (1)..(1): Any amino acid
XDFARNQVSSQTPQQPPTSTFQNSPSALVSTPVRTKTSNRYSPESQAQSVHHQRPGSRVSPENLVDKSRGSRPGKSPERSHVSSEPYEPISPPQVPVVHEKQDSLLLLSQRGAEPAEQRNDARSPGSISYLPSFFTKLENTSPMVKSKKQEIFPAAQPGTEIFNLPAVTTSGSVSSRGHSFADPASNLGLEDIIRKALMGSFDDKVEDHGVVMSQPM

SEQ ID NO: 58351 - protein, 57 aa, Homo sapiens
  Payload ID: 11421
  Gene Symbol: NCOR1
  Gene Name: nuclear receptor corepressor 1
  ENSP ID: ENSP00000474008
RREEGDPSPHSGTAFILVLFCCFSPKKPVYFPNSDASLRHFIYVFMCSESPLRVSVT

SEQ ID NO: 58352 - protein, 2079 aa, Homo sapiens
  Payload ID: 11422
  Gene Symbol: NCOR2
  Gene Name: nuclear receptor corepressor 2
  Uniprot ID: Q9Y618
  ENSP ID: ENSP00000348551
FMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNAATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 58353 - protein, 2514 aa, Homo sapiens
  Payload ID: 11422
  Gene Symbol: NCOR2
  Gene Name: nuclear receptor corepressor 2
  ENSP ID: ENSP00000384018
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNAATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 58354 - protein, 2458 aa, Homo sapiens
  Payload ID: 11422
  Gene Symbol: NCOR2
  Gene Name: nuclear receptor corepressor 2
  ENSP ID: ENSP00000384202
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNAATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 58355 - protein, 2062 aa, Homo sapiens
  Payload ID: 11422
  Gene Symbol: NCOR2
  Gene Name: nuclear receptor corepressor 2
  ENSP ID: ENSP00000385618
FMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNAATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 58356 - protein, 129 aa, Homo sapiens
  Payload ID: 11422
  Gene Symbol: NCOR2
  Gene Name: nuclear receptor corepressor 2
  ENSP ID: ENSP00000391389
  MOD_RES (1)..(1): Any amino acid
XHNRNEPEYNISQPGTEIFNMPAITGTGLMTYRSQAVQEHASTNMGLEAIIRKALMGGGGKAKVSGRPSSRKAKSPAPGLASGDRPPSVSSVHSEGDCNRRTPLTNRVWEDRPSSAGGHQVPRHSPTTP

SEQ ID NO: 58357 - protein, 156 aa, Homo sapiens
  Payload ID: 11422
  Gene Symbol: NCOR2
  Gene Name: nuclear receptor corepressor 2
  ENSP ID: ENSP00000396044
  MOD_RES (1)..(1): Any amino acid
XESSLALNYAAGPRGGPTHLTKPTTTSSSERERDRDRERDRDREREKSILTSTTTVEHAPIWRPGTEQSSGSSGGGGGSSSRPASHSHAHQHSPISPRTQDALQQRPSVLHNTGMKGIITAVEPSTPTVLRSTSTSSPVRPAATFPPATHCPLGGT

SEQ ID NO: 58358 - protein, 134 aa, Homo sapiens
  Payload ID: 11422
  Gene Symbol: NCOR2
  Gene Name: nuclear receptor corepressor 2
  ENSP ID: ENSP00000398963
  MOD_RES (1)..(1): Any amino acid
XVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTVLVHKKKFSRLQSLPLNLCQTSPL

SEQ ID NO: 58359 - protein, 2504 aa, Homo sapiens
  Payload ID: 11422
  Gene Symbol: NCOR2
  Gene Name: nuclear receptor corepressor 2
  ENSP ID: ENSP00000400281
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNAATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 58360 - protein, 225 aa, Homo sapiens
  Payload ID: 11422
  Gene Symbol: NCOR2
  Gene Name: nuclear receptor corepressor 2
  ENSP ID: ENSP00000400687
  MOD_RES (1)..(1): Any amino acid
XRHLAPNPTYPHLYPPYLIRGYPDTAALENRQTIINDYITSQQMHHNAATAMAQRADMLRGLSPRESSLALNYAAGPRGTPATAMDRLAYLPTAPQPFSSRHSSSPLSPGGPTHLTKPTTTSSSERERDRDRERDRDREREKSILTSTTTVEHAPIWRPGTEQSSGSSGGGGGSSSRPASHSHAHQHSPISPRTQDALQQRPSVLHNTGMKGIITAVEPSTPTVL

SEQ ID NO: 58361 - protein, 1451 aa, Homo sapiens
  Payload ID: 11422
  Gene Symbol: NCOR2
  Gene Name: nuclear receptor corepressor 2
  ENSP ID: ENSP00000402808
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAP

SEQ ID NO: 58362 - protein, 245 aa, Homo sapiens
  Payload ID: 11422
  Gene Symbol: NCOR2
  Gene Name: nuclear receptor corepressor 2
  ENSP ID: ENSP00000403034
QELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRPLYNQPSDTRQYHENIKINQAMRKKLILYFKRRNHARKQWEQKFCQRYDQLMEAWEKKVERIENNPRRRAKESKVREYYEKQFPEIRKQ

SEQ ID NO: 58363 - protein, 493 aa, Homo sapiens
  Payload ID: 11422
  Gene Symbol: NCOR2
  Gene Name: nuclear receptor corepressor 2
  ENSP ID: ENSP00000405367
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKS

SEQ ID NO: 58364 - protein, 132 aa, Homo sapiens
  Payload ID: 11422
  Gene Symbol: NCOR2
  Gene Name: nuclear receptor corepressor 2
  ENSP ID: ENSP00000407357
  MOD_RES (1)..(1): Any amino acid
XMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGGHQVPRHSPTTP

SEQ ID NO: 58365 - protein, 162 aa, Homo sapiens
  Payload ID: 11422
  Gene Symbol: NCOR2
  Gene Name: nuclear receptor corepressor 2
  ENSP ID: ENSP00000408247
MFPENLAEGETRMRGCLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEATVNNSSDTESIPSPHTEAAKDTGQNGPKPPATLGADGPPPGPPTPPPED

SEQ ID NO: 58366 - protein, 275 aa, Homo sapiens
  Payload ID: 11422
  Gene Symbol: NCOR2
  Gene Name: nuclear receptor corepressor 2
  ENSP ID: ENSP00000443689
  MOD_RES (1)..(1): Any amino acid
XSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQR

SEQ ID NO: 58367 - protein, 1158 aa, Homo sapiens
  Payload ID: 11423
  Gene Symbol: NRIP1
  Gene Name: nuclear receptor interacting protein 1
  Uniprot ID: P48552
  ENSP ID: ENSP00000327213
MTHGEELGSDVHQDSIVLTYLEGLLMHQAAGGSGTAVDKKSAGHNEEDQNFNISGSAFPTCQSNGPVLNTHTYQGSGMLHLKKARLLQSSEDWNAAKRKRLSDSIMNLNVKKEALLAGMVDSVPKGKQDSTLLASLLQSFSSRLQTVALSQQIRQSLKEQGYALSHDSLKVEKDLRCYGVASSHLKTLLKKSKVKDQKPDTNLPDVTKNLIRDRFAESPHHVGQSGTKVMSEPLSCAARLQAVASMVEKRASPATSPKPSVACSQLALLLSSEAHLQQYSREHALKTQNANQAASERLAAMARLQENGQKDVGSYQLPKGMSSHLNGQARTSSSKLMASKSSATVFQNPMGIIPSSPKNAGYKNSLERNNIKQAANNSLLLHLLKSQTIPKPMNGHSHSERGSIFEESSTPTTIDEYSDNNPSFTDDSSGDESSYSNCVPIDLSCKHRTEKSESDQPVSLDNFTQSLLNTWDPKVPDVDIKEDQDTSKNSKLNSHQKVTLLQLLLGHKNEENVEKNTSPQGVHNDVSKFNTQNYARTSVIESPSTNRTTPVSTPPLLTSSKAGSPINLSQHSLVIKWNSPPYVCSTQSEKLTNTASNHSMDLTKSKDPPGEKPAQNEGAQNSATFSASKLLQNLAQCGMQSSMSVEEQRPSKQLLTGNTDKPIGMIDRLNSPLLSNKTNAVEENKAFSSQPTGPEPGLSGSEIENLLERRTVLQLLLGNPNKGKSEKKEKTPLRDESTQEHSERALSEQILMVKIKSEPCDDLQIPNTNVHLSHDAKSAPFLGMAPAVQRSAPALPVSEDFKSEPVSPQDFSFSKNGLLSRLLRQNQDSYLADDSDRSHRNNEMALLESKNLCMVPKKRKLYTEPLENPFKKMKNNIVDAANNHSAPEVLYGSLLNQEELKFSRNDLEFKYPAGHGSASESEHRSWARESKSFNVLKQLLLSENCVRDLSPHRSNSVADSKKKGHKNNVTNSKPEFSISSLNGLMYSSTQPSSCMDNRTFSYPGVVKTPVSPTFPEHLGCAGSRPESGLLNGCSMPSEKGPIKWVITDAEKNEYEKDSPRLTKTNPILYYMLQKGGNSVTSRETQDKDIWREASSAESVSQVTAKEELLPTAETKASFFNLRSPYNSHMGNNASRPHSANGEVYGLLGSVLTIKKESE

SEQ ID NO: 58368 - protein, 1158 aa, Homo sapiens; identical to SEQ ID NO: 58367
  Payload ID: 11423
  Gene Symbol: NRIP1
  Gene Name: nuclear receptor interacting protein 1
  Uniprot ID: P48552
  ENSP ID: ENSP00000383060

SEQ ID NO: 58369 - protein, 1158 aa, Homo sapiens; identical to SEQ ID NO: 58367
  Payload ID: 11423
  Gene Symbol: NRIP1
  Gene Name: nuclear receptor interacting protein 1
  Uniprot ID: P48552
  ENSP ID: ENSP00000383063

SEQ ID NO: 58370 - protein, 65 aa, Homo sapiens
  Payload ID: 11423
  Gene Symbol: NRIP1
  Gene Name: nuclear receptor interacting protein 1
  ENSP ID: ENSP00000412114
MTHGEELGSDVHQDSIVLTYLEGLLMHQAAGGSGTAVDKKSAGHNEEDQNFNISGSAFPTCQSNG

SEQ ID NO: 58371 - protein, 281 aa, Homo sapiens
  Payload ID: 11424
  Gene Symbol: NRIP2
  Gene Name: nuclear receptor interacting protein 2
  Uniprot ID: Q9BQI9
  ENSP ID: ENSP00000337501
MLFIFPLSLPWRPSCWKESCSTGQRQAGRSREDSVTPPPSSPWPTPPAGAMSTKQEARRDEGEARTRGQEAQLRDRAHLSQQRRLKQATQFLHKDSADLLPLDSLKRLGTSKDLQPRSVIQRRLVEGNPNWLQGEPPRMQDLIHGQESRRKTSRTEIPALLVNCKCQDQLLRVAVDTGTQYNRISAGCLSRLGLEKRVLKASAGDLAPGPPTQVEQLELQLGQETVVCSAQVVDAESPEFCLGLQTLLSLKCCIDLEHGVLRLKAPFSELPFLPLYQEPGQ

SEQ ID NO: 58372 - protein, 138 aa, Homo sapiens
  Payload ID: 11424
  Gene Symbol: NRIP2
  Gene Name: nuclear receptor interacting protein 2
  ENSP ID: ENSP00000438338
MSTKQEARRDEGEARTRGQEAQLRDRAHLSQQRRLKQATQFLHKDSADLLPLDSLKRLGTSKDLQPRSVIQRRLVEGNPNWLQGEPPRMQDLIHGQESRRKTSRTEIPALLVNCKCQDQLLRVAVDTGTQYNRISAGC

SEQ ID NO: 58373 - protein, 175 aa, Homo sapiens
  Payload ID: 11424
  Gene Symbol: NRIP2
  Gene Name: nuclear receptor interacting protein 2
  ENSP ID: ENSP00000446283
MSTKQEARRDEGEARTRGQEAQLRDRAHLSQQRRLKQATQFLHKDSADLLPLDSLKRLGTSKDLQPRSVIQRRLVEGNPNWLQGEPPRMQDLIHGQESRRKTSRTEIPALLVNCKCQDQLLRVAVDTGTQYNRISAGCLSRLGLEKRVLKASAGDLAPGPPTQVEQLELQLGQET

SEQ ID NO: 58374 - protein, 241 aa, Homo sapiens
  Payload ID: 11425
  Gene Symbol: NRIP3
  Gene Name: nuclear receptor interacting protein 3
  Uniprot ID: Q9NQ35
  ENSP ID: ENSP00000310205
MFYSGLLTEGGRKETDMREAASLRQQRRMKQAVQFIHKDSADLLPLDGLKKLGSSKDMQPHNILQRRLMETNLSKLRSGPRVPWASKTNKLNQAKSEGLKKSEEDDMILVSCQCAGKDVKALVDTGCLYNLISLACVDRLGLKEHVKSHKHEGEKLSLPRHLKVVGQIEHLVITLGSLRLDCPAAVVDDNEKNLSLGLQTLRSLKCIINLDKHRLIMGKTDKEEIPFVETVSLNEDNTSEA

SEQ ID NO: 58375 - protein, 65 aa, Homo sapiens
  Payload ID: 11425
  Gene Symbol: NRIP3
  Gene Name: nuclear receptor interacting protein 3
  ENSP ID: ENSP00000432002
ITLGSLRLDCPAAVVDDNEKNLSLGLQTLRSLKCIINLDKHRLIMGKTDKEEIPFVETVSLNEDK

SEQ ID NO: 58376 - protein, 141 aa, Homo sapiens
  Payload ID: 11425
  Gene Symbol: NRIP3
  Gene Name: nuclear receptor interacting protein 3
  ENSP ID: ENSP00000432451
MFYSGLLTEGGRKETDMREAASLRQQRRMKQAVQFIHKDSADLLPLDGLKKLGSSKDMQPHNILQRRLMETNLSKLRSGPRVPWASKTNKLNQAKSEGLKKSEEDDMILVSCQCAGKDVKALVDTGCLYNLISLACVDRLG

SEQ ID NO: 58377 - protein, 160 aa, Homo sapiens
  Payload ID: 11425
  Gene Symbol: NRIP3
  Gene Name: nuclear receptor interacting protein 3
  ENSP ID: ENSP00000433845
MFYSGLLTEGGRKETDMREAASLRQQRRMKQAVQFIHKDSADLLPLDGLKKLGSSKDMRRLMETNLSKLRSGPRVPWASKTNKLNQAKSEGLKKSEEDDMILVSCQCAGKDVKALVDTGCLYNLISLACVDRLGLKEHVKSHKHEGEKLSLPRHLKVVGQ

SEQ ID NO: 58378 - protein, 55 aa, Homo sapiens
  Payload ID: 11425
  Gene Symbol: NRIP3
  Gene Name: nuclear receptor interacting protein 3
  ENSP ID: ENSP00000435785
  MOD_RES (1)..(1): Any amino acid
XLGLQTLRSLKCIINLDKHRLIMGKTDKEEIPFVETVSLNEDKSREASELSKFIY

SEQ ID NO: 58379 - protein, 105 aa, Homo sapiens
  Payload ID: 11426
  Gene Symbol: NR0B1
  Gene Name: nuclear receptor subfamily 0, group B, member 1
  ENSP ID: ENSP00000368246
MLELAQDRLQFETVEVSEPSMLQKILTTRRRETGGNEPLPVPTLQHHLAPPAEARKVPSASQVQAIKCFLSKCWSLNISTKEYAYLKGTVLFNPGKGKENDCNHH

SEQ ID NO: 58380 - protein, 470 aa, Homo sapiens
  Payload ID: 11426
  Gene Symbol: NR0B1
  Gene Name: nuclear receptor subfamily 0, group B, member 1
  Uniprot ID: P51843
  ENSP ID: ENSP00000368253
MAGENHQWQGSILYNMLMSAKQTRAAPEAPETRLVDQCWGCSCGDEPGVGREGLLGGRNVALLYRCCFCGKDHPRQGSILYSMLTSAKQTYAAPKAPEATLGPCWGCSCGSDPGVGRAGLPGGRPVALLYRCCFCGEDHPRQGSILYSLLTSSKQTHVAPAAPEARPGGAWWDRSYFAQRPGGKEALPGGRATALLYRCCFCGEDHPQQGSTLYCVPTSTNQAQAAPEERPRAPWWDTSSGALRPVALKSPQVVCEAASAGLLKTLRFVKYLPCFQVLPLDQQLVLVRNCWASLLMLELAQDRLQFETVEVSEPSMLQKILTTRRRETGGNEPLPVPTLQHHLAPPAEARKVPSASQVQAIKCFLSKCWSLNISTKEYAYLKGTVLFNPDVPGLQCVKYIQGLQWGTQQILSEHTRMTHQGPHDRFIELNSTLFLLRFINANVIAELFFRPIIGTVSMDDMMLEMLCTKI

SEQ ID NO: 58381 - protein, 257 aa, Homo sapiens
  Payload ID: 11427
  Gene Symbol: NR0B2
  Gene Name: nuclear receptor subfamily 0, group B, member 2
  Uniprot ID: Q15466
  ENSP ID: ENSP00000254227
MSTSQPGACPCQGAASRPAILYALLSSSLKAVPRPRSRCLCRQHRPVQLCAPHRTCREALDVLAKTVAFLRNLPSFWQLPPQDQRRLLQGCWGPLFLLGLAQDAVTFEVAEAPVPSILKKILLEEPSSSGGSGQLPDRPQPSLAAVQWLQCCLESFWSLELSPKEYACLKGTILFNPDVPGLQAASHIGHLQQEAHWVLCEVLEPWCPAAQGRLTRVLLTASTLKSIPTSLLGDLFFRPIIGDVDIAGLLGDMLLLR

SEQ ID NO: 58382 - protein, 614 aa, Homo sapiens
  Payload ID: 11428
  Gene Symbol: NR1D1
  Gene Name: nuclear receptor subfamily 1, group D, member 1
  Uniprot ID: P20393
  ENSP ID: ENSP00000246672
MTTLDSNNNTGGVITYIGSSGSSPSRTSPESLYSDNSNGSFQSLTQGCPTYFPPSPTGSLTQDPARSFGSIPPSLSDDGSPSSSSSSSSSSSSFYNGSPPGSLQVAMEDSSRVSPSKSTSNITKLNGMVLLCKVCGDVASGFHYGVHACEGCKGFFRRSIQQNIQYKRCLKNENCSIVRINRNRCQQCRFKKCLSVGMSRDAVRFGRIPKREKQRMLAEMQSAMNLANNQLSSQCPLETSPTQHPTPGPMGPSPPPAPVPSPLVGFSQFPQQLTPPRSPSPEPTVEDVISQVARAHREIFTYAHDKLGSSPGNFNANHASGSPPATTPHRWENQGCPPAPNDNNTLAAQRHNEALNGLRQAPSSYPPTWPPGPAHHSCHQSNSNGHRLCPTHVYAAPEGKAPANSPRQGNSKNVLLACPMNMYPHGRSGRTVQEIWEDFSMSFTPAVREVVEFAKHIPGFRDLSQHDQVTLLKAGTFEVLMVRFASLFNVKDQTVMFLSRTTYSLQELGAMGMGDLLSAMFDFSEKLNSLALTEEELGLFTAVVLVSADRSGMENSASVEQLQETLLRALRALVLKNRPLETSRFTKLLLKLPDLRTLNNMHSEKLLSFRVDAQ

SEQ ID NO: 58383 - protein, 579 aa, Homo sapiens
  Payload ID: 11429
  Gene Symbol: NR1D2
  Gene Name: nuclear receptor subfamily 1, group D, member 2
  Uniprot ID: Q14995
  ENSP ID: ENSP00000310006
MEVNAGGVIAYISSSSSASSPASCHSEGSENSFQSSSSSVPSSPNSSNSDTNGNPKNGDLANIEGILKNDRIDCSMKTSKSSAPGMTKSHSGVTKFSGMVLLCKVCGDVASGFHYGVHACEGCKGFFRRSIQQNIQYKKCLKNENCSIMRMNRNRCQQCRFKKCLSVGMSRDAVRFGRIPKREKQRMLIEMQSAMKTMMNSQFSGHLQNDTLVEHHEQTALPAQEQLRPKPQLEQENIKSSSPPSSDFAKEEVIGMVTRAHKDTFMYNQEQQENSAESMQPQRGERIPKNMEQYNLNHDHCGNGLSSHFPCSESQQHLNGQFKGRNIMHYPNGHAICIANGHCMNFSNAYTQRVCDRVPIDGFSQNENKNSYLCNTGGRMHLVCPMSKSPYVDPHKSGHEIWEEFSMSFTPAVKEVVEFAKRIPGFRDLSQHDQVNLLKAGTFEVLMVRFASLFDAKERTVTFLSGKKYSVDDLHSMGAGDLLNSMFEFSEKLNALQLSDEEMSLFTAVVLVSADRSGIENVNSVEALQETLIRALRTLIMKNHPNEASIFTKLLLKLPDLRSLNNMHSEELLAFKVHP

SEQ ID NO: 58384 - protein, 408 aa, Homo sapiens
  Payload ID: 11429
  Gene Symbol: NR1D2
  Gene Name: nuclear receptor subfamily 1, group D, member 2
  ENSP ID: ENSP00000373283
MEVNAGGVIAYISSSSSASSPASCHSEGSENSFQSSSSSVPSSPNSSNSDTNGNPKNGDLANIEGILKNDRIDCSMKTSKSSAPGMTKSHSGVTKFSGMVLLCKVCGDVASGFHYGVHACEGCKGFFRRSIQQNIQYKKCLKNENCSIMRMNRNRCQQCRFKKCLSVGMSRDAVRFGRIPKREKQRMLIEMQSAMKTMMNSQFSGHLQNDTLVEHHEQTALPAQEQLRPKPQLEQENIKSSSPPSSDFAKEEVIGMVTRAHKDTFMYNQEQQENSAESMQPQRGERIPKNMEQYNLNHDHCGNGLSSHFPCSESQQHLNGQFKGRNIMHYPNGHAICIANGHCMNFSNAYTQRVCDRVPIDGFSQNENKNSYLCNTGGRMHLYSVHIQPKFHQKQQYHTISSLNHEVL

SEQ ID NO: 58385 - protein, 460 aa, Homo sapiens
  Payload ID: 11430
  Gene Symbol: NR1H2
  Gene Name: nuclear receptor subfamily 1, group H, member 2
  Uniprot ID: P55055
  ENSP ID: ENSP00000253727
MSSPTTSSLDTPLPGNGPPQPGAPSSSPTVKEEGPEPWPGGPDPDVPGTDEASSACSTDWVIPDPEEEPERKRKKGPAPKMLGHELCRVCGDKASGFHYNVLSCEGCKGFFRRSVVRGGARRYACRGGGTCQMDAFMRRKCQQCRLRKCKEAGMREQCVLSEEQIRKKKIRKQQQESQSQSQSPVGPQGSSSSASGPGASPGGSEAGSQGSGEGEGVQLTAAQELMIQQLVAAQLQCNKRSFSDQPKVTPWPLGADPQSRDARQQRFAHFTELAIISVQEIVDFAKQVPGFLQLGREDQIALLKASTIEIMLLETARRYNHETECITFLKDFTYSKDDFHRAGLQVEFINPIFEFSRAMRRLGLDDAEYALLIAINIFSADRPNVQEPGRVEALQQPYVEALLSYTRIKRPQDQLRFPRMLMKLVSLRTLSSVHSEQVFALRLQDKKLPPLLSEIWDVHE

SEQ ID NO: 58386 - protein, 363 aa, Homo sapiens
  Payload ID: 11430
  Gene Symbol: NR1H2
  Gene Name: nuclear receptor subfamily 1, group H, member 2
  Uniprot ID: P55055
  ENSP ID: ENSP00000396151
MSSPTTSSLDTPLPGNGPPQPGAPSSSPTVKEEGPEPWPGGPDPDVPGTDEASSACSTDWGVLSEEQIRKKKIRKQQQESQSQSQSPVGPQGSSSSASGPGASPGGSEAGSQGSGEGEGVQLTAAQELMIQQLVAAQLQCNKRSFSDQPKVTPWPLGADPQSRDARQQRFAHFTELAIISVQEIVDFAKQVPGFLQLGREDQIALLKASTIEIMLLETARRYNHETECITFLKDFTYSKDDFHRAGLQVEFINPIFEFSRAMRRLGLDDAEYALLIAINIFSADRPNVQEPGRVEALQQPYVEALLSYTRIKRPQDQLRFPRMLMKLVSLRTLSSVHSEQVFALRLQDKKLPPLLSEIWDVHE

SEQ ID NO: 58387 - protein, 228 aa, Homo sapiens
  Payload ID: 11430
  Gene Symbol: NR1H2
  Gene Name: nuclear receptor subfamily 1, group H, member 2
  ENSP ID: ENSP00000469778
MSSPTTSSLDTPLPGNGPPQPGAPSSSPTVKEEGPEPWPGGPDPDVPGTDEASSACSTDWVIPDPEEEPERKRKKGPAPKMLGHELCRVCGDKASGFHYNVLSCEGCKGFFRRSVVRGGARRYACRGGGTCQMDAFMRRKCQQCRLRKCKEAGMREQCVLSEEQIRKKKIRKQQQESQSQSQSPVGPQGSSSSASGPGASPGGSEAGSQGSGEGEGVQLTAAQELMIQ

SEQ ID NO: 58388 - protein, 115 aa, Homo sapiens
  Payload ID: 11430
  Gene Symbol: NR1H2
  Gene Name: nuclear receptor subfamily 1, group H, member 2
  ENSP ID: ENSP00000470518
MSSPTTSSLDTPLPGNGPPQPGAPSSSPTVKEEGPEPWPGGPDPDVPGTDEASSACSTDWVIPDPEEEPERKRKKGPAPKMLGHELCRVCGDKASGFHYNVLSCEGCKGFFRRSV

SEQ ID NO: 58389 - protein, 460 aa, Homo sapiens; identical to SEQ ID NO: 58385
  Payload ID: 11430
  Gene Symbol: NR1H2
  Gene Name: nuclear receptor subfamily 1, group H, member 2
  Uniprot ID: P55055
  ENSP ID: ENSP00000471194

SEQ ID NO: 58390 - protein, 430 aa, Homo sapiens
  Payload ID: 11430
  Gene Symbol: NR1H2
  Gene Name: nuclear receptor subfamily 1, group H, member 2
  ENSP ID: ENSP00000471294
MSSPTTSSLDTPLPGNGPPQPGAPSSSPTVKEEGPEPWPGGPDPDVPGTDEASSACSTDWVIPDPEEEPERKRKKGPAPKMLGHELCRVCGDKASGFHYNVLSCEGCKGFFRRSVVRGGARRYACRGGGTCQMDAFMRRKCQQCRLRKCKEAGMREQCVLSEEQIRKKKIRKQQQESQSQSQSPVGPQGSSSSASGPGASPGGSEAGSQGSGEGEGVQLTAAQELMIQQLVAAQLQCNKRSFSDQPKVTEIVDFAKQVPGFLQLGREDQIALLKASTIEIMLLETARRYNHETECITFLKDFTYSKDDFHRAGLQVEFINPIFEFSRAMRRLGLDDAEYALLIAINIFSADRPNVQEPGRVEALQQPYVEALLSYTRIKRPQDQLRFPRMLMKLVSLRTLSSVHSEQVFALRLQDKKLPPLLSEIWDVHE

SEQ ID NO: 58391 - protein, 209 aa, Homo sapiens
  Payload ID: 11430
  Gene Symbol: NR1H2
  Gene Name: nuclear receptor subfamily 1, group H, member 2
  ENSP ID: ENSP00000472138
MSSPTTSSLDTPLPGNGPPQPGAPSSSPTVKEEGPEPWPGGPDPDVPGTDEASSACSTDWVIPDPEEEPERKRKKGPAPKMLGHELCRVCGDKASGFHYNVLSCEGCKGFFRRSVVRGGARRYACRGGGTCQMDAFMRRKCQQCRLRKCKEAGMREQCVLSEEQIRKKKIRKQQQESQSQSQSPVGPQGSSSSASGPGASPGGSEAGSQ

SEQ ID NO: 58392 - protein, 176 aa, Homo sapiens
  Payload ID: 11430
  Gene Symbol: NR1H2
  Gene Name: nuclear receptor subfamily 1, group H, member 2
  ENSP ID: ENSP00000472271
MSSPTTSSLDTPLPGNGPPQPGAPSSSPTVKEEGPEPWPGGPDPDVPGTDEASSACSTDWVIPDPEEEPERKRKKGPAPKMLGHELCRVCGDKASGFHYNVLSCEGCKGFFRRSVASFLKNRSGRRRFGNSSRSHSHSRSHLWGRRAAAAQPLGLGLPLVDLRQAARAPGKARVSS

SEQ ID NO: 58393 - protein, 416 aa, Homo sapiens
  Payload ID: 11430
  Gene Symbol: NR1H2
  Gene Name: nuclear receptor subfamily 1, group H, member 2
  ENSP ID: ENSP00000472526
MSSPTTSSLDTPLPGNGPPQPGAPSSSPTVKEEGPEPWPGGPDPDVPGTDEASSACSTDWVIPDPEEEPERKRKKGPAPKMLGHELCRVCGDKASGFHYNVLSCEGCKGFFRRSVVRGGARRYACRGGGTCQMDAFMRRKCQQCRLRKCKEAGMREQCVLSEEQIRKKKIRKQQQESQSQSQSPVGPQGSSSSASGPGASPGGSEAGSQGSGEGEGVQLTAAQELMIQQLVAAQLQCNKRSFSDQPKVTLGREDQIALLKASTIEIMLLETARRYNHETECITFLKDFTYSKDDFHRAGLQVEFINPIFEFSRAMRRLGLDDAEYALLIAINIFSADRPNVQEPGRVEALQQPYVEALLSYTRIKRPQDQLRFPRMLMKLVSLRTLSSVHSEQVFALRLQDKKLPPLLSEIWDVHE

SEQ ID NO: 58394 - protein, 40 aa, Homo sapiens
  Payload ID: 11430
  Gene Symbol: NR1H2
  Gene Name: nuclear receptor subfamily 1, group H, member 2
  ENSP ID: ENSP00000473099
MSSPTTSSLDTPLPGNGPPQPGAPSSSPTVKEEGPEPWPG

SEQ ID NO: 58395 - protein, 402 aa, Homo sapiens
  Payload ID: 11431
  Gene Symbol: NR1H3
  Gene Name: nuclear receptor subfamily 1, group H, member 3
  Uniprot ID: Q13133
  ENSP ID: ENSP00000378793
MPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLGMIEKLVAAQQQCNRRSFSDRLRVTPWPMAPDPHSREARQQRFAHFTELAIVSVQEIVDFAKQLPGFLQLSREDQIALLKTSAIEVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 58396 - protein, 387 aa, Homo sapiens
  Payload ID: 11431
  Gene Symbol: NR1H3
  Gene Name: nuclear receptor subfamily 1, group H, member 3
  Uniprot ID: Q13133
  ENSP ID: ENSP00000384745
MSLWLGAPVPDIPPDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLGMIEKLVAAQQQCNRRSFSDRLRVTVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 58397 - protein, 342 aa, Homo sapiens
  Payload ID: 11431
  Gene Symbol: NR1H3
  Gene Name: nuclear receptor subfamily 1, group H, member 3
  ENSP ID: ENSP00000385073
MPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLGMIEKLVAAQQQCNRRSFSDRLRVTVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 58398 - protein, 387 aa, Homo sapiens; identical to SEQ ID NO: 58396
  Payload ID: 11431
  Gene Symbol: NR1H3
  Gene Name: nuclear receptor subfamily 1, group H, member 3
  Uniprot ID: Q13133
  ENSP ID: ENSP00000385801

SEQ ID NO: 58399 - protein, 447 aa, Homo sapiens
  Payload ID: 11431
  Gene Symbol: NR1H3
  Gene Name: nuclear receptor subfamily 1, group H, member 3
  Uniprot ID: Q13133
  ENSP ID: ENSP00000387946
MSLWLGAPVPDIPPDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLGMIEKLVAAQQQCNRRSFSDRLRVTPWPMAPDPHSREARQQRFAHFTELAIVSVQEIVDFAKQLPGFLQLSREDQIALLKTSAIEVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 58400 - protein, 193 aa, Homo sapiens
  Payload ID: 11431
  Gene Symbol: NR1H3
  Gene Name: nuclear receptor subfamily 1, group H, member 3
  ENSP ID: ENSP00000391005
MSLWLGAPVPDIPPDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLP

SEQ ID NO: 58401 - protein, 68 aa, Homo sapiens
  Payload ID: 11431
  Gene Symbol: NR1H3
  Gene Name: nuclear receptor subfamily 1, group H, member 3
  ENSP ID: ENSP00000396132
MSLWLGAPVPDIPPDSAVELWKPGAQDASSQAQGGSSCILREEARMPHSAGGTAGVGLEAAEPTALLT

SEQ ID NO: 58402 - protein, 212 aa, Homo sapiens
  Payload ID: 11431
  Gene Symbol: NR1H3
  Gene Name: nuclear receptor subfamily 1, group H, member 3
  ENSP ID: ENSP00000403696
MSLWLGAPVPDIPPDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLG

SEQ ID NO: 58403 - protein, 202 aa, Homo sapiens
  Payload ID: 11431
  Gene Symbol: NR1H3
  Gene Name: nuclear receptor subfamily 1, group H, member 3
  ENSP ID: ENSP00000403798
MSLWLGAPVPDIPPDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQI

SEQ ID NO: 58404 - protein, 114 aa, Homo sapiens
  Payload ID: 11431
  Gene Symbol: NR1H3
  Gene Name: nuclear receptor subfamily 1, group H, member 3
  ENSP ID: ENSP00000406692
MSLWLGAPVPDIPPAQTLRWSCGSQAHRMQAARPREAAAASSERKPGCPTLLGVLQGWGWRLQSPQPCSPGQSPLQNPQRSVHKSGKRGQPPKCWGTSYAACVGTRPRASTTMF

SEQ ID NO: 58405 - protein, 54 aa, Homo sapiens
  Payload ID: 11431
  Gene Symbol: NR1H3
  Gene Name: nuclear receptor subfamily 1, group H, member 3
  ENSP ID: ENSP00000407716
MSLWLGAPVPDIPPESSPESFLVVLASRPDHLSPGSSAWPLQAPAQSSPVWICC

SEQ ID NO: 58406 - protein, 134 aa, Homo sapiens
  Payload ID: 11431
  Gene Symbol: NR1H3
  Gene Name: nuclear receptor subfamily 1, group H, member 3
  ENSP ID: ENSP00000412636
MPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKL

SEQ ID NO: 58407 - protein, 77 aa, Homo sapiens
  Payload ID: 11431
  Gene Symbol: NR1H3
  Gene Name: nuclear receptor subfamily 1, group H, member 3
  ENSP ID: ENSP00000413095
MSLWLGAPVPDIPPDSAVELWKPGAQDASSQAQGGSSCILREEARMPHSAGGTAGVGLEAAEPTALLTRAEPPSEPT

SEQ ID NO: 58408 - protein, 205 aa, Homo sapiens
  Payload ID: 11431
  Gene Symbol: NR1H3
  Gene Name: nuclear receptor subfamily 1, group H, member 3
  ENSP ID: ENSP00000415591
MSLWLGAPVPDIPPDSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQ

SEQ ID NO: 58409 - protein, 447 aa, Homo sapiens; identical to SEQ ID NO: 58399
  Payload ID: 11431
  Gene Symbol: NR1H3
  Gene Name: nuclear receptor subfamily 1, group H, member 3
  Uniprot ID: Q13133
  ENSP ID: ENSP00000420656

SEQ ID NO: 58410 - protein, 296 aa, Homo sapiens
  Payload ID: 11431
  Gene Symbol: NR1H3
  Gene Name: nuclear receptor subfamily 1, group H, member 3
  ENSP ID: ENSP00000432073
MLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLGMIEKLVAAQQQCNRRSFSDRLRVTVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 58411 - protein, 466 aa, Homo sapiens
  Payload ID: 11431
  Gene Symbol: NR1H3
  Gene Name: nuclear receptor subfamily 1, group H, member 3
  ENSP ID: ENSP00000433271
MPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLGMIEKLVAAQQQCNRRSFSDRLRVTPWPMAPDPHSREARQQRFAHFTELAIVSVQEIVDFAKQLPGFLQLSREDQIALLKTSAIEVAGEGQGMKGEAEWDYLWEGPPDIELGEPNLLGSRDEENRPPWKRPCSKTSPPSPRLRFAACVQVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 58412 - protein, 167 aa, Homo sapiens
  Payload ID: 11431
  Gene Symbol: NR1H3
  Gene Name: nuclear receptor subfamily 1, group H, member 3
  ENSP ID: ENSP00000434650
MPHSAGGTAGVGLEAAEPTALLTRAEPPSEPTGVLSEEQIRLKKLKRQEEEQAHATSLPPRASSPPQILPQLSPEQLGMIEKLVAAQQQCNRRSFSDRLRVTVMLLETSRRYNPGSESITFLKDFSYNREDFAKAGLQVEFINPIFEFSRAMNELQLNDAEFALLIA

SEQ ID NO: 58413 - protein, 453 aa, Homo sapiens
  Payload ID: 11431
  Gene Symbol: NR1H3
  Gene Name: nuclear receptor subfamily 1, group H, member 3
  ENSP ID: ENSP00000477707
MQQTSWNPLGGTCKQPPGRTHSAVELWKPGAQDASSQAQGGSSCILREEARMPHSAGGTAGVGLEAAEPTALLTRAEPPSEPTEIRPQKRKKGPAPKMLGNELCSVCGDKASGFHYNVLSCEGCKGFFRRSVIKGAHYICHSGGHCPMDTYMRRKCQECRLRKCRQAGMREECVLSEEQIRLKKLKRQEEEQAHATSLPPRASSPPQILPQLSPEQLGMIEKLVAAQQQCNRRSFSDRLRVTPWPMAPDPHSREARQQRFAHFTELAIVSVQEIVDFAKQLPGFLQLSREDQIALLKTSAIEVMLLETSRRYNPGSESITFLKDFSYNREDFAKAGLQVEFINPIFEFSRAMNELQLNDAEFALLIAISIFSADRPNVQDQLQVERLQHTYVEALHAYVSIHHPHDRLMFPRMLMKLVSLRTLSSVHSEQVFALRLQDKKLPPLLSEIWDVHE

SEQ ID NO: 58414 - protein, 482 aa, Homo sapiens
  Payload ID: 11432
  Gene Symbol: NR1H4
  Gene Name: nuclear receptor subfamily 1, group H, member 4
  Uniprot ID: Q96RI1
  ENSP ID: ENSP00000188403
MVMQFQGLENPIQISPHCSCTPSGFFMEMMSMKPAKGVLTEQVAGPLGQNLEVEPYSQYSNVQFPQVQPQISSSSYYSNLGFYPQQPEEWYSPGIYELRRMPAETLYQGETEVAEMPVTKKPRMGASAGRIKGDELCVVCGDRASGYHYNALTCEGCKGFFRRSITKNAVYKCKNGGNCVMDMYMRRKCQECRLRKCKEMGMLAECLLTEIQCKSKRLRKNVKQHADQTVNEDSEGRDLRQVTSTTKSCREKTELTPDQQTLLHFIMDSYNKQRMPQEITNKILKEEFSAEENFLILTEMATNHVQVLVEFTKKLPGFQTLDHEDQIALLKGSAVEAMFLRSAEIFNKKLPSGHSDLLEERIRNSGISDEYITPMFSFYKSIGELKMTQEEYALLTAIVILSPDRQYIKDREAVEKLQEPLLDVLQKLCKIHQPENPQHFACLLGRLTELRTFNHHHAEMLMSWRVNDHKFTPLLCEIWDVQ

SEQ ID NO: 58415 - protein, 270 aa, Homo sapiens
  Payload ID: 11432
  Gene Symbol: NR1H4
  Gene Name: nuclear receptor subfamily 1, group H, member 4
  ENSP ID: ENSP00000315442
MGSKMNLIEHSHLPTTDEFSFSENLFGVLTEQVAGPLGQNLEVEPYSQYSNVQFPQVQPQISSSSYYSNLGFYPQQPEEWYSPGIYELRRMPAETLYQGETEVAEMPVTKKPRMGASAGRIKGDELCVVCGDRASGYHYNALTCEGCKGFFRRSITKNAVYKCKNGGNCVMDMYMRRKCQECRLRKCKEMGMLAECLLTEIQCKSKRLRKNVKQHADQTVNEDSEGRDLRQVTSTTKSCRCRRKLNSPQINRLFYILLWIHITNRGCLRK

SEQ ID NO: 58416 - protein, 476 aa, Homo sapiens
  Payload ID: 11432
  Gene Symbol: NR1H4
  Gene Name: nuclear receptor subfamily 1, group H, member 4
  Uniprot ID: Q96RI1
  ENSP ID: ENSP00000376712
MGSKMNLIEHSHLPTTDEFSFSENLFGVLTEQVAGPLGQNLEVEPYSQYSNVQFPQVQPQISSSSYYSNLGFYPQQPEEWYSPGIYELRRMPAETLYQGETEVAEMPVTKKPRMGASAGRIKGDELCVVCGDRASGYHYNALTCEGCKGFFRRSITKNAVYKCKNGGNCVMDMYMRRKCQECRLRKCKEMGMLAECMYTGLLTEIQCKSKRLRKNVKQHADQTVNEDSEGRDLRQVTSTTKSCREKTELTPDQQTLLHFIMDSYNKQRMPQEITNKILKEEFSAEENFLILTEMATNHVQVLVEFTKKLPGFQTLDHEDQIALLKGSAVEAMFLRSAEIFNKKLPSGHSDLLEERIRNSGISDEYITPMFSFYKSIGELKMTQEEYALLTAIVILSPDRQYIKDREAVEKLQEPLLDVLQKLCKIHQPENPQHFACLLGRLTELRTFNHHHAEMLMSWRVNDHKFTPLLCEIWDVQ

SEQ ID NO: 58417 - protein, 57 aa, Homo sapiens
  Payload ID: 11432
  Gene Symbol: NR1H4
  Gene Name: nuclear receptor subfamily 1, group H, member 4
  ENSP ID: ENSP00000446584
MGSKMNLIEHSHLPTTDEFSFSENLFDFLGWFQSLPSTTLWSWTNSLTLHKLLALFK

SEQ ID NO: 58418 - protein, 45 aa, Homo sapiens
  Payload ID: 11432
  Gene Symbol: NR1H4
  Gene Name: nuclear receptor subfamily 1, group H, member 4
  ENSP ID: ENSP00000446760
MGSKMNLIEHSHLPTTDEFSFSENLFGLLRLPWSPSMCSHLRTRP

SEQ ID NO: 58419 - protein, 34 aa, Homo sapiens
  Payload ID: 11432
  Gene Symbol: NR1H4
  Gene Name: nuclear receptor subfamily 1, group H, member 4
  ENSP ID: ENSP00000446861
  MOD_RES (1)..(1): Any amino acid
XSGFFMEMMSMKPAKGLLRLPWSPSMCSHLRTRP

SEQ ID NO: 58420 - protein, 486 aa, Homo sapiens
  Payload ID: 11432
  Gene Symbol: NR1H4
  Gene Name: nuclear receptor subfamily 1, group H, member 4
  Uniprot ID: Q96RI1
  ENSP ID: ENSP00000447149
MVMQFQGLENPIQISPHCSCTPSGFFMEMMSMKPAKGVLTEQVAGPLGQNLEVEPYSQYSNVQFPQVQPQISSSSYYSNLGFYPQQPEEWYSPGIYELRRMPAETLYQGETEVAEMPVTKKPRMGASAGRIKGDELCVVCGDRASGYHYNALTCEGCKGFFRRSITKNAVYKCKNGGNCVMDMYMRRKCQECRLRKCKEMGMLAECMYTGLLTEIQCKSKRLRKNVKQHADQTVNEDSEGRDLRQVTSTTKSCREKTELTPDQQTLLHFIMDSYNKQRMPQEITNKILKEEFSAEENFLILTEMATNHVQVLVEFTKKLPGFQTLDHEDQIALLKGSAVEAMFLRSAEIFNKKLPSGHSDLLEERIRNSGISDEYITPMFSFYKSIGELKMTQEEYALLTAIVILSPDRQYIKDREAVEKLQEPLLDVLQKLCKIHQPENPQHFACLLGRLTELRTFNHHHAEMLMSWRVNDHKFTPLLCEIWDVQ

SEQ ID NO: 58421 - protein, 472 aa, Homo sapiens
  Payload ID: 11432
  Gene Symbol: NR1H4
  Gene Name: nuclear receptor subfamily 1, group H, member 4
  Uniprot ID: Q96RI1
  ENSP ID: ENSP00000448506
MGSKMNLIEHSHLPTTDEFSFSENLFGVLTEQVAGPLGQNLEVEPYSQYSNVQFPQVQPQISSSSYYSNLGFYPQQPEEWYSPGIYELRRMPAETLYQGETEVAEMPVTKKPRMGASAGRIKGDELCVVCGDRASGYHYNALTCEGCKGFFRRSITKNAVYKCKNGGNCVMDMYMRRKCQECRLRKCKEMGMLAECLLTEIQCKSKRLRKNVKQHADQTVNEDSEGRDLRQVTSTTKSCREKTELTPDQQTLLHFIMDSYNKQRMPQEITNKILKEEFSAEENFLILTEMATNHVQVLVEFTKKLPGFQTLDHEDQIALLKGSAVEAMFLRSAEIFNKKLPSGHSDLLEERIRNSGISDEYITPMFSFYKSIGELKMTQEEYALLTAIVILSPDRQYIKDREAVEKLQEPLLDVLQKLCKIHQPENPQHFACLLGRLTELRTFNHHHAEMLMSWRVNDHKFTPLLCEIWDVQ

SEQ ID NO: 58422 - protein, 425 aa, Homo sapiens
  Payload ID: 11432
  Gene Symbol: NR1H4
  Gene Name: nuclear receptor subfamily 1, group H, member 4
  Uniprot ID: Q96RI1
  ENSP ID: ENSP00000448978
MGSKMNLIEHSHLPTTDEFSFSENLFGVLTEQVAGPLGQNLEVEPYSQYSNVQFPQVQPQISSSSYYSNLGFYPQQPEEWYSPGIYELRRMPAETLYQGETEVAEMPVTKKPRMGASAGRIKGDELCVVCGDRASGYHYNALTCEGCKGLLTEIQCKSKRLRKNVKQHADQTVNEDSEGRDLRQVTSTTKSCREKTELTPDQQTLLHFIMDSYNKQRMPQEITNKILKEEFSAEENFLILTEMATNHVQVLVEFTKKLPGFQTLDHEDQIALLKGSAVEAMFLRSAEIFNKKLPSGHSDLLEERIRNSGISDEYITPMFSFYKSIGELKMTQEEYALLTAIVILSPDRQYIKDREAVEKLQEPLLDVLQKLCKIHQPENPQHFACLLGRLTELRTFNHHHAEMLMSWRVNDHKFTPLLCEIWDVQ

SEQ ID NO: 58423 - protein, 473 aa, Homo sapiens
  Payload ID: 11433
  Gene Symbol: NR1I2
  Gene Name: nuclear receptor subfamily 1, group I, member 2
  Uniprot ID: O75469
  ENSP ID: ENSP00000336528
MTVTRTHHFKEGSLRAPAIPLHSAAAELASNHPRGPEANLEVRPKESWNHADFVHCEDTESVPGKPSVNADEEVGGPQICRVCGDKATGYHFNVMTCEGCKGFFRRAMKRNARLRCPFRKGACEITRKTRRQCQACRLRKCLESGMKKEMIMSDEAVEERRALIKRKKSERTGTQPLGVQGLTEEQRMMIRELMDAQMKTFDTTFSHFKNFRLPGVLSSGCELPESLQAPSREEAAKWSQVRKDLCSLKVSLQLRGEDGSVWNYKPPADSGGKEIFSLLPHMADMSTYMFKGIISFAKVISYFRDLPIEDQISLLKGAAFELCQLRFNTVFNAETGTWECGRLSYCLEDTAGGFQQLLLEPMLKFHYMLKKLQLHEEEYVLMQAISLFSPDRPGVLQHRVVDQLQEQFAITLKSYIECNRPQPAHRFLFLKIMAMLTELRSINAQHTQRLLRIQDIHPFATPLMQELFGITGS

SEQ ID NO: 58424 - protein, 434 aa, Homo sapiens
  Payload ID: 11433
  Gene Symbol: NR1I2
  Gene Name: nuclear receptor subfamily 1, group I, member 2
  ENSP ID: ENSP00000377319
LEVRPKESWNHADFVHCEDTESVPGKPSVNADEEVGGPQICRVCGDKATGYHFNVMTCEGCKGFFRRAMKRNARLRCPFRKGACEITRKTRRQCQACRLRKCLESGMKKEMIMSDEAVEERRALIKRKKSERTGTQPLGVQGLTEEQRMMIRELMDAQMKTFDTTFSHFKNFRLPGVLSSGCELPESLQAPSREEAAKWSQVRKDLCSLKVSLQLRGEDGSVWNYKPPADSGGKEIFSLLPHMADMSTYMFKGIISFAKVISYFRDLPIEDQISLLKGAAFELCQLRFNTVFNAETGTWECGRLSYCLEDTAGGFQQLLLEPMLKFHYMLKKLQLHEEEYVLMQAISLFSPDRPGVLQHRVVDQLQEQFAITLKSYIECNRPQPAHRFLFLKIMAMLTELRSINAQHTQRLLRIQDIHPFATPLMQELFGITGS

SEQ ID NO: 58425 - protein, 397 aa, Homo sapiens
  Payload ID: 11433
  Gene Symbol: NR1I2
  Gene Name: nuclear receptor subfamily 1, group I, member 2
  ENSP ID: ENSP00000420297
LEVRPKESWNHADFVHCEDTESVPGKPSVNADEEVGGPQICRVCGDKATGYHFNVMTCEGCKGFFRRAMKRNARLRCPFRKGACEITRKTRRQCQACRLRKCLESGMKKEMIMSDEAVEERRALIKRKKSERTGTQPLGVQGLTEEQRMMIRELMDAQMKTFDTTFSHFKNFRVSLQLRGEDGSVWNYKPPADSGGKEIFSLLPHMADMSTYMFKGIISFAKVISYFRDLPIEDQISLLKGAAFELCQLRFNTVFNAETGTWECGRLSYCLEDTAGGFQQLLLEPMLKFHYMLKKLQLHEEEYVLMQAISLFSPDRPGVLQHRVVDQLQEQFAITLKSYIECNRPQPAHRFLFLKIMAMLTELRSINAQHTQRLLRIQDIHPFATPLMQELFGITGS

SEQ ID NO: 58426 - protein, 357 aa, Homo sapiens
  Payload ID: 11434
  Gene Symbol: NR1I3
  Gene Name: nuclear receptor subfamily 1, group I, member 3
  Uniprot ID: Q14994
  ENSP ID: ENSP00000356958
MASREDELRNCVVCGDQATGYHFNALTCEGCKGFFRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVSPTVGFQVEFLELLFHFHGTLRKLQLQEPEYVLLAAMALFSPAPYLTDRPGVTQRDEIDQLQEEMALTLQSYIKGQQRRPRDRFLYAKLLGLLAELRSINEAYGYQIQHIQGLSAMMPLLQEICS

SEQ ID NO: 58427 - protein, 357 aa, Homo sapiens; identical to SEQ ID NO: 58426
  Payload ID: 11434
  Gene Symbol: NR1I3
  Gene Name: nuclear receptor subfamily 1, group I, member 3
  Uniprot ID: Q14994
  ENSP ID: ENSP00000356959

SEQ ID NO: 58428 - protein, 324 aa, Homo sapiens
  Payload ID: 11434
  Gene Symbol: NR1I3
  Gene Name: nuclear receptor subfamily 1, group I, member 3
  Uniprot ID: Q14994
  ENSP ID: ENSP00000356960
MLPKRSRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVGFQVEFLELLFHFHGTLRKLQLQEPEYVLLAAMALFSPAPYLTDRPGVTQRDEIDQLQEEMALTLQSYIKGQQRRPRDRFLYAKLLGLLAELRSINEAYGYQIQHIQGLSAMMPLLQEICS

SEQ ID NO: 58429 - protein, 352 aa, Homo sapiens
  Payload ID: 11434
  Gene Symbol: NR1I3
  Gene Name: nuclear receptor subfamily 1, group I, member 3
  Uniprot ID: Q14994
  ENSP ID: ENSP00000356961
MASREDELRNCVVCGDQATGYHFNALTCEGCKGFFRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVSPTVGFQVEFLELLFHFHGTLRKLQLQEPEYVLLAAMALFSPDRPGVTQRDEIDQLQEEMALTLQSYIKGQQRRPRDRFLYAKLLGLLAELRSINEAYGYQIQHIQGLSAMMPLLQEICS

SEQ ID NO: 58430 - protein, 348 aa, Homo sapiens
  Payload ID: 11434
  Gene Symbol: NR1I3
  Gene Name: nuclear receptor subfamily 1, group I, member 3
  Uniprot ID: Q14994
  ENSP ID: ENSP00000356962
MASREDELRNCVVCGDQATGYHFNALTCEGCKGFFRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVGFQVEFLELLFHFHGTLRKLQLQEPEYVLLAAMALFSPDRPGVTQRDEIDQLQEEMALTLQSYIKGQQRRPRDRFLYAKLLGLLAELRSINEAYGYQIQHIQGLSAMMPLLQEICS

SEQ ID NO: 58431 - protein, 309 aa, Homo sapiens
  Payload ID: 11434
  Gene Symbol: NR1I3
  Gene Name: nuclear receptor subfamily 1, group I, member 3
  Uniprot ID: Q14994
  ENSP ID: ENSP00000356963
MASREDELRNCVVCGDQATGYHFNALTCEGCKGFFRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARDRPGVTQRDEIDQLQEEMALTLQSYIKGQQRRPRDRFLYAKLLGLLAELRSINEAYGYQIQHIQGLSAMMPLLQEICS

SEQ ID NO: 58432 - protein, 314 aa, Homo sapiens
  Payload ID: 11434
  Gene Symbol: NR1I3
  Gene Name: nuclear receptor subfamily 1, group I, member 3
  Uniprot ID: Q14994
  ENSP ID: ENSP00000356965
MASREDELRNCVVCGDQATGYHFNALTCEGCKGFFRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARAPYLTDRPGVTQRDEIDQLQEEMALTLQSYIKGQQRRPRDRFLYAKLLGLLAELRSINEAYGYQIQHIQGLSAMMPLLQEICS

SEQ ID NO: 58433 - protein, 315 aa, Homo sapiens
  Payload ID: 11434
  Gene Symbol: NR1I3
  Gene Name: nuclear receptor subfamily 1, group I, member 3
  Uniprot ID: Q14994
  ENSP ID: ENSP00000399361
MLPKRSRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVSPTVGFQVEFLELLFHFHGTLRKLQLQEPEYVLLAAMALFSPAPYLTDRPGVTQRDEIDQLQEEMALTLQSYIKGQQRRPRDRSPGTPWIHWSGKMLGPKIGPGSKGAQWLQ

SEQ ID NO: 58434 - protein, 339 aa, Homo sapiens
  Payload ID: 11434
  Gene Symbol: NR1I3
  Gene Name: nuclear receptor subfamily 1, group I, member 3
  Uniprot ID: Q14994
  ENSP ID: ENSP00000406493
MASREDELRNCVVCGDQATGYHFNALTCEGCKGFFRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVSPTVGFQVEFLELLFHFHGTLRKLQLQEPEYVLLAAMALFSPDRPGVTQRDEIDQLQEEMALTLQSYIKGQQRRPRDRSPGTPWIHWSGKMLGPKIGPGSKGAQWLQ

SEQ ID NO: 58435 - protein, 306 aa, Homo sapiens
  Payload ID: 11434
  Gene Symbol: NR1I3
  Gene Name: nuclear receptor subfamily 1, group I, member 3
  Uniprot ID: Q14994
  ENSP ID: ENSP00000407446
MLPKRSRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVGFQVEFLELLFHFHGTLRKLQLQEPEYVLLAAMALFSPDRPGVTQRDEIDQLQEEMALTLQSYIKGQQRRPRDRSPGTPWIHWSGKMLGPKIGPGSKGAQWLQ

SEQ ID NO: 58436 - protein, 340 aa, Homo sapiens
  Payload ID: 11434
  Gene Symbol: NR1I3
  Gene Name: nuclear receptor subfamily 1, group I, member 3
  Uniprot ID: Q14994
  ENSP ID: ENSP00000412672
MASREDELRNCVVCGDQATGYHFNALTCEGCKGFFRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVGFQVEFLELLFHFHGTLRKLQLQEPEYVLLAAMALFSPAPYLTDRPGVTQRDEIDQLQEEMALTLQSYIKGQQRRPRDRSPGTPWIHWSGKMLGPKIGPGSKGAQWLQ

SEQ ID NO: 58437 - protein, 147 aa, Homo sapiens
  Payload ID: 11434
  Gene Symbol: NR1I3
  Gene Name: nuclear receptor subfamily 1, group I, member 3
  ENSP ID: ENSP00000421374
MASREDELRNCVVCGDQATGYHFNALTCEGCKGFFRRTVSKSIGPTCPFAGSCEVSKTQRRHCPACRLQKCLDAGMRKDIPCPLKTRSPFSREQLWKSVTSYSIPLSVSKHKTSSAGLFATQLKMEPVTDLELPREMRLISCKRRWH

SEQ ID NO: 58438 - protein, 273 aa, Homo sapiens
  Payload ID: 11434
  Gene Symbol: NR1I3
  Gene Name: nuclear receptor subfamily 1, group I, member 3
  ENSP ID: ENSP00000421588
MRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVGFQVEFLELLFHFHGTLRKLQLQEPEYVLLAAMALFSPDRPGVTQRDEIDQLQEEMALTLQSYIKGQQRRPRDRFLYAKLLGLLAELRSINEAYGYQIQHIQGLSAMMPLLQEICS

SEQ ID NO: 58439 - protein, 118 aa, Homo sapiens
  Payload ID: 11434
  Gene Symbol: NR1I3
  Gene Name: nuclear receptor subfamily 1, group I, member 3
  ENSP ID: ENSP00000422982
MLPKRSRRTVSKSIGPTCPFAGSCEVSKTQRRHCPACRLQKCLDAGMRKDIPCPLKTRSPFSREQLWKSVTSYSIPLSVSKHKTSSAGLFATQLKMEPVTDLELPREMRLISCKRRWH

SEQ ID NO: 58440 - protein, 90 aa, Homo sapiens
  Payload ID: 11434
  Gene Symbol: NR1I3
  Gene Name: nuclear receptor subfamily 1, group I, member 3
  ENSP ID: ENSP00000423007
MLPKRSRRTVSKSIGPTCPFAGSCEVSKTQRRHCPACRLQKCLDAGMRKDTSSSSVHPSPALAHPGPCAASGHTLRRHQHFHGTASHQVY

SEQ ID NO: 58441 - protein, 297 aa, Homo sapiens
  Payload ID: 11434
  Gene Symbol: NR1I3
  Gene Name: nuclear receptor subfamily 1, group I, member 3
  ENSP ID: ENSP00000423089
MLPKRSRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVGFQVEFLELLFHFHGTLRKLQLQEPEYVLLAAMALFSPDRPGVTQRDEIDQLQEEMALTLQSYIKGQQRRPRDRYGGTLRAWRPHQGRKGLVKH

SEQ ID NO: 58442 - protein, 311 aa, Homo sapiens
  Payload ID: 11434
  Gene Symbol: NR1I3
  Gene Name: nuclear receptor subfamily 1, group I, member 3
  Uniprot ID: Q14994
  ENSP ID: ENSP00000423666
MLPKRSRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVGFQVEFLELLFHFHGTLRKLQLQEPEYVLLAAMALFSPAPYLTDRPGVTQRDEIDQLQEEMALTLQSYIKGQQRRPRDRSPGTPWIHWSGKMLGPKIGPGSKGAQWLQ

SEQ ID NO: 58443 - protein, 280 aa, Homo sapiens
  Payload ID: 11434
  Gene Symbol: NR1I3
  Gene Name: nuclear receptor subfamily 1, group I, member 3
  Uniprot ID: Q14994
  ENSP ID: ENSP00000424345
MLPKRSRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARDRPGVTQRDEIDQLQEEMALTLQSYIKGQQRRPRDRFLYAKLLGLLAELRSINEAYGYQIQHIQGLSAMMPLLQEICS

SEQ ID NO: 58444 - protein, 274 aa, Homo sapiens
  Payload ID: 11434
  Gene Symbol: NR1I3
  Gene Name: nuclear receptor subfamily 1, group I, member 3
  ENSP ID: ENSP00000424834
MLPKRSRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVSPTVGFQVEFLELLFHFHGTLRKLQLQEPEYVLLAAMALFSPGEHLPKPRAFCCTTSAQILSSLSPSTQAF

SEQ ID NO: 58445 - protein, 296 aa, Homo sapiens
  Payload ID: 11434
  Gene Symbol: NR1I3
  Gene Name: nuclear receptor subfamily 1, group I, member 3
  Uniprot ID: Q14994
  ENSP ID: ENSP00000424934
MASREDELRNCVVCGDQATGYHFNALTCEGCKGFFRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARDRPGVTQRDEIDQLQEEMALTLQSYIKGQQRRPRDRSPGTPWIHWSGKMLGPKIGPGSKGAQWLQ

SEQ ID NO: 58446 - protein, 267 aa, Homo sapiens
  Payload ID: 11434
  Gene Symbol: NR1I3
  Gene Name: nuclear receptor subfamily 1, group I, member 3
  Uniprot ID: Q14994
  ENSP ID: ENSP00000425417
MLPKRSRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARDRPGVTQRDEIDQLQEEMALTLQSYIKGQQRRPRDRSPGTPWIHWSGKMLGPKIGPGSKGAQWLQ

SEQ ID NO: 58447 - protein, 90 aa, Homo sapiens; identical to SEQ ID NO: 58440
  Payload ID: 11434
  Gene Symbol: NR1I3
  Gene Name: nuclear receptor subfamily 1, group I, member 3
  ENSP ID: ENSP00000425607

SEQ ID NO: 58448 - protein, 90 aa, Homo sapiens; identical to SEQ ID NO: 58440
  Payload ID: 11434
  Gene Symbol: NR1I3
  Gene Name: nuclear receptor subfamily 1, group I, member 3
  ENSP ID: ENSP00000425900

SEQ ID NO: 58449 - protein, 119 aa, Homo sapiens
  Payload ID: 11434
  Gene Symbol: NR1I3
  Gene Name: nuclear receptor subfamily 1, group I, member 3
  ENSP ID: ENSP00000426016
MASREDELRNCVVCGDQATGYHFNALTCEGCKGFFRRTVSKSIGPTCPFAGSCEVSKTQRRHCPACRLQKCLDAGMRKDTSSSSVHPSPALAHPGPCAASGHTLRRHQHFHGTASHQVY

SEQ ID NO: 58450 - protein, 147 aa, Homo sapiens; identical to SEQ ID NO: 58437
  Payload ID: 11434
  Gene Symbol: NR1I3
  Gene Name: nuclear receptor subfamily 1, group I, member 3
  ENSP ID: ENSP00000426292

SEQ ID NO: 58451 - protein, 238 aa, Homo sapiens
  Payload ID: 11434
  Gene Symbol: NR1I3
  Gene Name: nuclear receptor subfamily 1, group I, member 3
  ENSP ID: ENSP00000427034
MASREDELRNCVVCGDQATGYHFNALTCEGCKGFFRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARGEMVLEQ

SEQ ID NO: 58452 - protein, 319 aa, Homo sapiens
  Payload ID: 11434
  Gene Symbol: NR1I3
  Gene Name: nuclear receptor subfamily 1, group I, member 3
  Uniprot ID: Q14994
  ENSP ID: ENSP00000427175
MLPKRSRRTVSKSIGPTCPFAGSCEVSKTQRRHCPACRLQKCLDAGMRKDMILSAEALALRRAKQAQRRAQQTPVQLSKEQEELIRTLLGAHTRHMGTMFEQFVQFRPPAHLFIHHQPLPTLAPVLPLVTHFADINTFMVLQVIKFTKDLPVFRSLPIEDQISLLKGAAVEICHIVLNTTFCLQTQNFLCGPLRYTIEDGARVGFQVEFLELLFHFHGTLRKLQLQEPEYVLLAAMALFSPDRPGVTQRDEIDQLQEEMALTLQSYIKGQQRRPRDRFLYAKLLGLLAELRSINEAYGYQIQHIQGLSAMMPLLQEICS

SEQ ID NO: 58453 - protein, 118 aa, Homo sapiens; identical to SEQ ID NO: 58439
  Payload ID: 11434
  Gene Symbol: NR1I3
  Gene Name: nuclear receptor subfamily 1, group I, member 3
  ENSP ID: ENSP00000427600

SEQ ID NO: 58454 - protein, 119 aa, Homo sapiens; identical to SEQ ID NO: 58449
  Payload ID: 11434
  Gene Symbol: NR1I3
  Gene Name: nuclear receptor subfamily 1, group I, member 3
  ENSP ID: ENSP00000487337

SEQ ID NO: 58455 - protein, 483 aa, Homo sapiens
  Payload ID: 11435
  Gene Symbol: NR2C1
  Gene Name: nuclear receptor subfamily 2, group C, member 1
  Uniprot ID: P13056
  ENSP ID: ENSP00000328843
MATIEEIAHQIIEQQMGEIVTEQQTGQKIQIVTALDHNTQGKQFILTNHDGSTPSKVILARQDSTPGKVFLTTPDAAGVNQLFFTTPDLSAQHLQLLTDNSPDQGPNKVFDLCVVCGDKASGRHYGAVTCEGCKGFFKRSIRKNLVYSCRGSKDCIINKHHRNRCQYCRLQRCIAFGMKQDSVQCERKPIEVSREKSSNCAASTEKIYIRKDLRSPLTATPTFVTDSESTRSTGLLDSGMFMNIHPSGVKTESAVLMTSDKAESCQGDLSTLANVVTSLANLGKTKDLSQNSNEMSMIESLSNDDTSLCEFQEMQTNGDVSRAFDTLAKALNPGESTACQSSVAGMEGSVHLITGDSSINYTEKEGPLLSDSHVAFRLTMPSPMPEYLNVHYIGESASRLLFLSMHWALSIPSFQALGQENSISLVKAYWNELFTLGLAQCWQVMNVATILATFVNCLHNSLQQDAKVIAALIHFTRRAITDL

SEQ ID NO: 58456 - protein, 603 aa, Homo sapiens
  Payload ID: 11435
  Gene Symbol: NR2C1
  Gene Name: nuclear receptor subfamily 2, group C, member 1
  Uniprot ID: P13056
  ENSP ID: ENSP00000333275
MATIEEIAHQIIEQQMGEIVTEQQTGQKIQIVTALDHNTQGKQFILTNHDGSTPSKVILARQDSTPGKVFLTTPDAAGVNQLFFTTPDLSAQHLQLLTDNSPDQGPNKVFDLCVVCGDKASGRHYGAVTCEGCKGFFKRSIRKNLVYSCRGSKDCIINKHHRNRCQYCRLQRCIAFGMKQDSVQCERKPIEVSREKSSNCAASTEKIYIRKDLRSPLTATPTFVTDSESTRSTGLLDSGMFMNIHPSGVKTESAVLMTSDKAESCQGDLSTLANVVTSLANLGKTKDLSQNSNEMSMIESLSNDDTSLCEFQEMQTNGDVSRAFDTLAKALNPGESTACQSSVAGMEGSVHLITGDSSINYTEKEGPLLSDSHVAFRLTMPSPMPEYLNVHYIGESASRLLFLSMHWALSIPSFQALGQENSISLVKAYWNELFTLGLAQCWQVMNVATILATFVNCLHNSLQQDKMSTERRKLLMEHIFKLQEFCNSMVKLCIDGYEYAYLKAIVLFSPDHPSLENMEQIEKFQEKAYVEFQDYITKTYPDDTYRLSRLLLRLPALRLMNATITEELFFKGLIGNIRIDSVIPHILKMEPADYNSQIIGHSI

SEQ ID NO: 58457 - protein, 467 aa, Homo sapiens
  Payload ID: 11435
  Gene Symbol: NR2C1
  Gene Name: nuclear receptor subfamily 2, group C, member 1
  Uniprot ID: P13056
  ENSP ID: ENSP00000376813
MATIEEIAHQIIEQQMGEIVTEQQTGQKIQIVTALDHNTQGKQFILTNHDGSTPSKVILARQDSTPGKVFLTTPDAAGVNQLFFTTPDLSAQHLQLLTDNSPDQGPNKVFDLCVVCGDKASGRHYGAVTCEGCKGFFKRSIRKNLVYSCRGSKDCIINKHHRNRCQYCRLQRCIAFGMKQDSVQCERKPIEVSREKSSNCAASTEKIYIRKDLRSPLTATPTFVTDSESTRSTGLLDSGMFMNIHPSGVKTESAVLMTSDKAESCQGDLSTLANVVTSLANLGKTKDLSQNSNEMSMIESLSNDDTSLCEFQEMQTNGDVSRAFDTLAKALNPGESTACQSSVAGMEGSVHLITGDSSINYTEKEGPLLSDSHVAFRLTMPSPMPEYLNVHYIGESASRLLFLSMHWALSIPSFQALGQENSISLVKAYWNELFTLGLAQCWQVMNVATILATFVNCLHNSLQQAEG

SEQ ID NO: 58458 - protein, 47 aa, Homo sapiens
  Payload ID: 11435
  Gene Symbol: NR2C1
  Gene Name: nuclear receptor subfamily 2, group C, member 1
  ENSP ID: ENSP00000446817
  MOD_RES (1)..(1): Any amino acid
XDLSQNSNEMSMIESLSNDDTSLCEFQEMQTNGDVSSSPCLLLCLST

SEQ ID NO: 58459 - protein, 16 aa, Homo sapiens
  Payload ID: 11435
  Gene Symbol: NR2C1
  Gene Name: nuclear receptor subfamily 2, group C, member 1
  ENSP ID: ENSP00000446906
MATIEEIAHQIIEQQM

SEQ ID NO: 58460 - protein, 73 aa, Homo sapiens
  Payload ID: 11435
  Gene Symbol: NR2C1
  Gene Name: nuclear receptor subfamily 2, group C, member 1
  ENSP ID: ENSP00000450225
  MOD_RES (1)..(1): Any amino acid
XLTMPSPMPEYLNVHYIGESASRLLFLSMHWALSIPSFQALGSSKPRKHGTDREISGKGLCGIPRLYNQNISR

SEQ ID NO: 58461 - protein, 434 aa, Homo sapiens
  Payload ID: 11435
  Gene Symbol: NR2C1
  Gene Name: nuclear receptor subfamily 2, group C, member 1
  ENSP ID: ENSP00000478728
MATIEEIAHQIIEQQMGEIVTEQQTGQKIQIVTALDHNTQGKQFILTNHDGSTPSKVILARQDSTPGKVFLTTPDAAGVNQLFFTTPDLSAQHLQLLTDNSPDQGPNKVFDLCVVCGDKASGRHYGAVTCEGCKGFFKRSIRKNLVYSCRGSKDCIINKHHRNRCQYCRLQRCIAFGMKQDSVQCERKPIEVSREKSSNCAASTEKIYIRKDLRSPLTATPTFVTDSESTRSTGLLDSGMFMNIHPSGVKTESAVLMTSDKAESCQGDLSTLANVVTSLANLGKTKDLSQNSNEMSMIESLSNDDTSLCEFQEMQTNGDVSRAFDTLAKALNPGESTACQSSVAGMEGSVHLITGDSSINYTEKEGPLLSDSHVAFRLTMPSPMPEYLNVHYIGESASRLLFLSMHWALSIPSFQALGKKKIIDGAHLQTTGVL

SEQ ID NO: 58462 - protein, 615 aa, Homo sapiens
  Payload ID: 11436
  Gene Symbol: NR2C2
  Gene Name: nuclear receptor subfamily 2, group C, member 2
  Uniprot ID: P49116
  ENSP ID: ENSP00000320447
MTSPSPRIQIISTDSAVASPQRIQGSEPASGPLSVFTSLNKEKIVTDQQTGQKIQIVTAVDASGSPKQQFILTSPDGAGTGKVILASPETSSAKQLIFTTSDNLVPGRIQIVTDSASVERLLGKTDVQRPQVVEYCVVCGDKASGRHYGAVSCEGCKGFFKRSVRKNLTYSCRSNQDCIINKHHRNRCQFCRLKKCLEMGMKMESVQSERKPFDVQREKPSNCAASTEKIYIRKDLRSPLIATPTFVADKDGARQTGLLDPGMLVNIQQPLIREDGTVLLATDSKAETSQGALGTLANVVTSLANLSESLNNGDTSEIQPEDQSASEITRAFDTLAKALNTTDSSSSPSLADGIDTSGGGSIHVISRDQSTPIIEVEGPLLSDTHVTFKLTMPSPMPEYLNVHYICESASRLLFLSMHWARSIPAFQALGQDCNTSLVRACWNELFTLGLAQCAQVMSLSTILAAIVNHLQNSIQEDKLSGDRIKQVMEHIWKLQEFCNSMAKLDIDGYEYAYLKAIVLFSPDHPGLTSTSQIEKFQEKAQMELQDYVQKTYSEDTYRLARILVRLPALRLMSSNITEELFFTGLIGNVSIDSIIPYILKMETAEYNGQITGASL

SEQ ID NO: 58463 - protein, 596 aa, Homo sapiens
  Payload ID: 11436
  Gene Symbol: NR2C2
  Gene Name: nuclear receptor subfamily 2, group C, member 2
  Uniprot ID: P49116
  ENSP ID: ENSP00000376814
MTSPSPRIQIISTDSAVASPQRIQIVTDQQTGQKIQIVTAVDASGSPKQQFILTSPDGAGTGKVILASPETSSAKQLIFTTSDNLVPGRIQIVTDSASVERLLGKTDVQRPQVVEYCVVCGDKASGRHYGAVSCEGCKGFFKRSVRKNLTYSCRSNQDCIINKHHRNRCQFCRLKKCLEMGMKMESVQSERKPFDVQREKPSNCAASTEKIYIRKDLRSPLIATPTFVADKDGARQTGLLDPGMLVNIQQPLIREDGTVLLATDSKAETSQGALGTLANVVTSLANLSESLNNGDTSEIQPEDQSASEITRAFDTLAKALNTTDSSSSPSLADGIDTSGGGSIHVISRDQSTPIIEVEGPLLSDTHVTFKLTMPSPMPEYLNVHYICESASRLLFLSMHWARSIPAFQALGQDCNTSLVRACWNELFTLGLAQCAQVMSLSTILAAIVNHLQNSIQEDKLSGDRIKQVMEHIWKLQEFCNSMAKLDIDGYEYAYLKAIVLFSPDHPGLTSTSQIEKFQEKAQMELQDYVQKTYSEDTYRLARILVRLPALRLMSSNITEELFFTGLIGNVSIDSIIPYILKMETAEYNGQITGASL

SEQ ID NO: 58464 - protein, 596 aa, Homo sapiens; identical to SEQ ID NO: 58463
  Payload ID: 11436
  Gene Symbol: NR2C2
  Gene Name: nuclear receptor subfamily 2, group C, member 2
  Uniprot ID: P49116
  ENSP ID: ENSP00000384463

SEQ ID NO: 58465 - protein, 596 aa, Homo sapiens; identical to SEQ ID NO: 58463
  Payload ID: 11436
  Gene Symbol: NR2C2
  Gene Name: nuclear receptor subfamily 2, group C, member 2
  Uniprot ID: P49116
  ENSP ID: ENSP00000388387

SEQ ID NO: 58466 - protein, 36 aa, Homo sapiens
  Payload ID: 11436
  Gene Symbol: NR2C2
  Gene Name: nuclear receptor subfamily 2, group C, member 2
  ENSP ID: ENSP00000391473
MTSPSPRIQIISTDSAVASPQRIQGSEPASGPLSVF

SEQ ID NO: 58467 - protein, 205 aa, Homo sapiens
  Payload ID: 11436
  Gene Symbol: NR2C2
  Gene Name: nuclear receptor subfamily 2, group C, member 2
  ENSP ID: ENSP00000401807
MTSPSPRIQIISTDSAVASPQRIQGSEPASGPLSVFTSLNKEKIVTDQQTGQKIQIVTAVDASGSPKQQFILTSPDGAGTGKVILASPETSSAKQLIFTTSDNLVPGRIQIVTDSASVERLLGKTDVQRPQVVEYCVVCGDKASGRHYGAVSCEGCKGFFKRSVRKNLTYSCRSNQDCIINKHHRNRCQFCRLKKCLEMGMKMEC

SEQ ID NO: 58468 - protein, 67 aa, Homo sapiens
  Payload ID: 11436
  Gene Symbol: NR2C2
  Gene Name: nuclear receptor subfamily 2, group C, member 2
  ENSP ID: ENSP00000402272
MTSPSPRIQIISTDSAVASPQRIQIVTDQQTGQKIQIVTAVDASGSPKQQFILTSPDGAGTGKVILA

SEQ ID NO: 58469 - protein, 222 aa, Homo sapiens
  Payload ID: 11436
  Gene Symbol: NR2C2
  Gene Name: nuclear receptor subfamily 2, group C, member 2
  ENSP ID: ENSP00000412473
CESASRLLFLSMHWARSIPAFQALGQDCNTSLVRACWNELFTLGLAQCAQVMSLSTILAAIVNHLQNSIQEDKLSGDRIKQVMEHIWKLQEFCNSMAKLDIDGYEYAYLKAIVLFSPDHPGLTSTSQIEKFQEKAQMELQDYVQKTYSEDTYRSNQTTHSFFPKIFLMCSMISLLLLVSTSTRTCSPESGNGKHGAEEKQNSQRTQPQKVVIWDLLLVAETF

SEQ ID NO: 58470 - protein, 173 aa, Homo sapiens
  Payload ID: 11436
  Gene Symbol: NR2C2
  Gene Name: nuclear receptor subfamily 2, group C, member 2
  ENSP ID: ENSP00000413438
PFYIPRQDCNTSLVRACWNELFTLGLAQCAQVMSLSTILAAIVNHLQNSIQEDKLSGDRIKQVMEHIWKLQEFCNSMAKLDIDGYEYAYLKAIVLFSPDHPGLTSTSQIEKFQEKAQMELQDYVQKTYSEDTYRTCSPESGNGKHGAEEKQNSQRTQPQKVVIWDLLLVAETF

SEQ ID NO: 58471 - protein, 615 aa, Homo sapiens; identical to SEQ ID NO: 58462
  Payload ID: 11436
  Gene Symbol: NR2C2
  Gene Name: nuclear receptor subfamily 2, group C, member 2
  Uniprot ID: P49116
  ENSP ID: ENSP00000483059

SEQ ID NO: 58472 - protein, 422 aa, Homo sapiens
  Payload ID: 11437
  Gene Symbol: NR2E1
  Gene Name: nuclear receptor subfamily 2, group E, member 1
  Uniprot ID: Q9Y466
  ENSP ID: ENSP00000357979
MFRAGAEGAEKEPSPRPECRADPGPGLGFPLGSGLPWPSLLESPGGRILDIPCKVCGDRSSGKHYGVYACDGCSGFFKRSIRRNRTYVCKSGNQGGCPVDKTHRNQCRACRLKKCLEVNMNKDAVQHERGPRTSTIRKQVALYFRGHKEENGAAAHFPSAALPAPAFFTAVTQLEPHGLELAAVSTTPERQTLVSLAQPTPKYPHEVNGTPMYLYEVATESVCESAARLLFMSIKWAKSVPAFSTLSLQDQLMLLEDAWRELFVLGIAQWAIPVDANTLLAVSGMNGDNTDSQKLNKIISEIQALQEVVARFRQLRLDATEFACLKCIVTFKAVPTHSGSELRSFRNAAAIAALQDEAQLTLNSYIHTRYPTQPCRFGKLLLLLPALRSISPSTIEEVFFKKTIGNVPITRLLSDMYKSSDI

SEQ ID NO: 58473 - protein, 385 aa, Homo sapiens
  Payload ID: 11437
  Gene Symbol: NR2E1
  Gene Name: nuclear receptor subfamily 2, group E, member 1
  Uniprot ID: Q9Y466
  ENSP ID: ENSP00000357982
MSKPAGSTSRILDIPCKVCGDRSSGKHYGVYACDGCSGFFKRSIRRNRTYVCKSGNQGGCPVDKTHRNQCRACRLKKCLEVNMNKDAVQHERGPRTSTIRKQVALYFRGHKEENGAAAHFPSAALPAPAFFTAVTQLEPHGLELAAVSTTPERQTLVSLAQPTPKYPHEVNGTPMYLYEVATESVCESAARLLFMSIKWAKSVPAFSTLSLQDQLMLLEDAWRELFVLGIAQWAIPVDANTLLAVSGMNGDNTDSQKLNKIISEIQALQEVVARFRQLRLDATEFACLKCIVTFKAVPTHSGSELRSFRNAAAIAALQDEAQLTLNSYIHTRYPTQPCRFGKLLLLLPALRSISPSTIEEVFFKKTIGNVPITRLLSDMYKSSDI

SEQ ID NO: 58474 - protein, 45 aa, Homo sapiens
  Payload ID: 11437
  Gene Symbol: NR2E1
  Gene Name: nuclear receptor subfamily 2, group E, member 1
  ENSP ID: ENSP00000416908
MNKDAVQHERGPRTSTIRKQVALYFRGHKEENGAAAHFPSAALPA

SEQ ID NO: 58475 - protein, 322 aa, Homo sapiens
  Payload ID: 11438
  Gene Symbol: NR2E3
  Gene Name: nuclear receptor subfamily 2, group E, member 3
  ENSP ID: ENSP00000479254
MCPVDKAHRNQCQACRLKKCLQAGMNQDAVQNERQPRSTAQVHLDSMESNTESRPESLVAPPAPAGRSPRGPTPMSAARALGHHFMASLITAETCAKLEPEDADENIDVTSNDPEFPSSPYSSSSPCGLDSIHETSARLLFMAVKWAKNLPVFSSLPFRDQVILLEEAWSELFLLGAIQWSLPLDSCPLLAPPEASAAGGAQGRLTLASMETRVLQETISRFRALAVDPTEFACMKALVLFKPETRGLKDPEHVEALQDQSQVMLSQHSKAHHPSQPVRFGKLLLLLPSLRFITAERIELLFFRKTIGNTPMEKLLCDMFKN

SEQ ID NO: 58476 - protein, 367 aa, Homo sapiens
  Payload ID: 11438
  Gene Symbol: NR2E3
  Gene Name: nuclear receptor subfamily 2, group E, member 3
  Uniprot ID: Q9Y5X4
  ENSP ID: ENSP00000479962
METRPTALMSSTVAAAAPAAGAASRKESPGRWGLGEDPTGVSPSLQCRVCGDSSSGKHYGIYACNGCSGFFKRSVRRRLIYRCQVGAGMCPVDKAHRNQCQACRLKKCLQAGMNQDAVQNERQPRSTAQVHLDSMESNTESRPESLVAPPAPAGRSPRGPTPMSAARALGHHFMASLITAETCAKLEPEDADENIDVTSNDPEFPSSPYSSSSPCGLDSIHETSARLLFMAVKWAKNLPVFSSLPFRDQVILLEEAWSELFLLGAIQWSLPLDSCPLLAPPEASAAGGAQGRLTLASMETRVLQETISRFRALAVDPTEFACMKALVLFKPETRGLKDPEHVEALQDQSQVMLSQHSKAHHPSQPVR

SEQ ID NO: 58477 - protein, 410 aa, Homo sapiens
  Payload ID: 11438
  Gene Symbol: NR2E3
  Gene Name: nuclear receptor subfamily 2, group E, member 3
  Uniprot ID: Q9Y5X4
  ENSP ID: ENSP00000482504
METRPTALMSSTVAAAAPAAGAASRKESPGRWGLGEDPTGVSPSLQCRVCGDSSSGKHYGIYACNGCSGFFKRSVRRRLIYRCQVGAGMCPVDKAHRNQCQACRLKKCLQAGMNQDAVQNERQPRSTAQVHLDSMESNTESRPESLVAPPAPAGRSPRGPTPMSAARALGHHFMASLITAETCAKLEPEDADENIDVTSNDPEFPSSPYSSSSPCGLDSIHETSARLLFMAVKWAKNLPVFSSLPFRDQVILLEEAWSELFLLGAIQWSLPLDSCPLLAPPEASAAGGAQGRLTLASMETRVLQETISRFRALAVDPTEFACMKALVLFKPETRGLKDPEHVEALQDQSQVMLSQHSKAHHPSQPVRFGKLLLLLPSLRFITAERIELLFFRKTIGNTPMEKLLCDMFKN

SEQ ID NO: 58478 - protein, 423 aa, Homo sapiens
  Payload ID: 11439
  Gene Symbol: NR2F1
  Gene Name: nuclear receptor subfamily 2, group F, member 1
  Uniprot ID: P10589
  ENSP ID: ENSP00000325819
MAMVVSSWRDPQDDVAGGNPGGPNPAAQAARGGGGGAGEQQQQAGSGAPHTPQTPGQPGAPATPGTAGDKGQGPPGSGQSQQHIECVVCGDKSSGKHYGQFTCEGCKSFFKRSVRRNLTYTCRANRNCPIDQHHRNQCQYCRLKKCLKVGMRREAVQRGRMPPTQPNPGQYALTNGDPLNGHCYLSGYISLLLRAEPYPTSRYGSQCMQPNNIMGIENICELAARLLFSAVEWARNIPFFPDLQITDQVSLLRLTWSELFVLNAAQCSMPLHVAPLLAAAGLHASPMSADRVVAFMDHIRIFQEQVEKLKALHVDSAEYSCLKAIVLFTSDACGLSDAAHIESLQEKSQCALEEYVRSQYPNQPSRFGKLLLRLPSLRTVSSSVIEQLFFVRLVGKTPIETLIRDMLLSGSSFNWPYMSIQCS

SEQ ID NO: 58479 - protein, 398 aa, Homo sapiens
  Payload ID: 11439
  Gene Symbol: NR2F1
  Gene Name: nuclear receptor subfamily 2, group F, member 1
  ENSP ID: ENSP00000481517
MAMVVSSWRDPQDDVAGGNPGGPNPAAQTPGQPGAPATPGTAGDKGQGPPGSGQSQQHIECVVCGDKSSGKHYGQFTCEGCKSFFKRSVRRNLTYTCRANRNCPIDQHHRNQCQYCRLKKCLKVGMRREAVQRGRMPPTQPNPGQYALTNGDPLNGHCYLSGYISLLLRAEPYPTSRYGSQCMQPNNIMGIENICELAARLLFSAVEWARNIPFFPDLQITDQVSLLRLTWSELFVLNAAQCSMPLHVAPLLAAAGLHASPMSADRVVAFMDHIRIFQEQVEKLKALHVDSAEYSCLKAIVLFTSDACGLSDAAHIESLQEKSQCALEEYVRSQYPNQPSRFGKLLLRLPSLRTVSSSVIEQLFFVRLVGKTPIETLIRDMLLSGSSFNWPYMSIQCS

SEQ ID NO: 58480 - protein, 414 aa, Homo sapiens
  Payload ID: 11440
  Gene Symbol: NR2F2
  Gene Name: nuclear receptor subfamily 2, group F, member 2
  Uniprot ID: P24468
  ENSP ID: ENSP00000377721
MAMVVSTWRDPQDEVPGSQGSQASQAPPVPGPPPGAPHTPQTPGQGGPASTPAQTAAGGQGGPGGPGSDKQQQQQHIECVVCGDKSSGKHYGQFTCEGCKSFFKRSVRRNLSYTCRANRNCPIDQHHRNQCQYCRLKKCLKVGMRREAVQRGRMPPTQPTHGQFALTNGDPLNCHSYLSGYISLLLRAEPYPTSRFGSQCMQPNNIMGIENICELAARMLFSAVEWARNIPFFPDLQITDQVALLRLTWSELFVLNAAQCSMPLHVAPLLAAAGLHASPMSADRVVAFMDHIRIFQEQVEKLKALHVDSAEYSCLKAIVLFTSDACGLSDVAHVESLQEKSQCALEEYVRSQYPNQPTRFGKLLLRLPSLRTVSSSVIEQLFFVRLVGKTPIETLIRDMLLSGSSFNWPYMAIQ

SEQ ID NO: 58481 - protein, 261 aa, Homo sapiens
  Payload ID: 11440
  Gene Symbol: NR2F2
  Gene Name: nuclear receptor subfamily 2, group F, member 2
  Uniprot ID: P24468
  ENSP ID: ENSP00000377726
MPPTQPTHGQFALTNGDPLNCHSYLSGYISLLLRAEPYPTSRFGSQCMQPNNIMGIENICELAARMLFSAVEWARNIPFFPDLQITDQVALLRLTWSELFVLNAAQCSMPLHVAPLLAAAGLHASPMSADRVVAFMDHIRIFQEQVEKLKALHVDSAEYSCLKAIVLFTSDACGLSDVAHVESLQEKSQCALEEYVRSQYPNQPTRFGKLLLRLPSLRTVSSSVIEQLFFVRLVGKTPIETLIRDMLLSGSSFNWPYMAIQ

SEQ ID NO: 58482 - protein, 261 aa, Homo sapiens; identical to SEQ ID NO: 58481
  Payload ID: 11440
  Gene Symbol: NR2F2
  Gene Name: nuclear receptor subfamily 2, group F, member 2
  Uniprot ID: P24468
  ENSP ID: ENSP00000389853

SEQ ID NO: 58483 - protein, 281 aa, Homo sapiens
  Payload ID: 11440
  Gene Symbol: NR2F2
  Gene Name: nuclear receptor subfamily 2, group F, member 2
  Uniprot ID: P24468
  ENSP ID: ENSP00000401674
MQAVWDLEQGKYGFAVQRGRMPPTQPTHGQFALTNGDPLNCHSYLSGYISLLLRAEPYPTSRFGSQCMQPNNIMGIENICELAARMLFSAVEWARNIPFFPDLQITDQVALLRLTWSELFVLNAAQCSMPLHVAPLLAAAGLHASPMSADRVVAFMDHIRIFQEQVEKLKALHVDSAEYSCLKAIVLFTSDACGLSDVAHVESLQEKSQCALEEYVRSQYPNQPTRFGKLLLRLPSLRTVSSSVIEQLFFVRLVGKTPIETLIRDMLLSGSSFNWPYMAIQ

SEQ ID NO: 58484 - protein, 93 aa, Homo sapiens
  Payload ID: 11440
  Gene Symbol: NR2F2
  Gene Name: nuclear receptor subfamily 2, group F, member 2
  ENSP ID: ENSP00000457112
MPPTQPTHGQFALTNGDPLNCHSYLSGYISLLLRAEPYPTSRFGSQCMQPNNIMGIENICELAARMLFSAVEWARNIPFFPDLQITDQVALLR

SEQ ID NO: 58485 - protein, 404 aa, Homo sapiens
  Payload ID: 11441
  Gene Symbol: NR2F6
  Gene Name: nuclear receptor subfamily 2, group F, member 6
  Uniprot ID: P10588
  ENSP ID: ENSP00000291442
MAMVTGGWGGPGGDTNGVDKAGGYPRAAEDDSASPPGAASDAEPGDEERPGLQVDCVVCGDKSSGKHYGVFTCEGCKSFFKRSIRRNLSYTCRSNRDCQIDQHHRNQCQYCRLKKCFRVGMRKEAVQRGRIPHSLPGAVAASSGSPPGSALAAVASGGDLFPGQPVSELIAQLLRAEPYPAAAGRFGAGGGAAGAVLGIDNVCELAARLLFSTVEWARHAPFFPELPVADQVALLRLSWSELFVLNAAQAALPLHTAPLLAAAGLHAAPMAAERAVAFMDQVRAFQEQVDKLGRLQVDSAEYGCLKAIALFTPDACGLSDPAHVESLQEKAQVALTEYVRAQYPSQPQRFGRLLLRLPALRAVPASLISQLFFMRLVGKTPIETLIRDMLLSGSTFNWPYGSGQ

SEQ ID NO: 58486 - protein, 125 aa, Homo sapiens
  Payload ID: 11441
  Gene Symbol: NR2F6
  Gene Name: nuclear receptor subfamily 2, group F, member 6
  ENSP ID: ENSP00000471686
MRKEAVQRGRIPHSLPGAVAASSGSPPGSALAAVASGGDLFPGQPVSELIAQLLRAEPYPAAAGRFGAGGGAAGAVLGIDNVCELAARLLFSTVEWARHAPFFPELPVADQVALLRLSWSELFVL

SEQ ID NO: 58487 - protein, 778 aa, Homo sapiens
  Payload ID: 11442
  Gene Symbol: NR3C1
  Gene Name: nuclear receptor subfamily 3, group C, member 1 (glucocorticoid receptor)
  Uniprot ID: P04150
  ENSP ID: ENSP00000231509
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGRQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 58488 - protein, 777 aa, Homo sapiens
  Payload ID: 11442
  Gene Symbol: NR3C1
  Gene Name: nuclear receptor subfamily 3, group C, member 1 (glucocorticoid receptor)
  Uniprot ID: P04150
  ENSP ID: ENSP00000343205
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 58489 - protein, 777 aa, Homo sapiens; identical to SEQ ID NO: 58488
  Payload ID: 11442
  Gene Symbol: NR3C1
  Gene Name: nuclear receptor subfamily 3, group C, member 1 (glucocorticoid receptor)
  Uniprot ID: P04150
  ENSP ID: ENSP00000377977

SEQ ID NO: 58490 - protein, 778 aa, Homo sapiens; identical to SEQ ID NO: 58487
  Payload ID: 11442
  Gene Symbol: NR3C1
  Gene Name: nuclear receptor subfamily 3, group C, member 1 (glucocorticoid receptor)
  Uniprot ID: P04150
  ENSP ID: ENSP00000377979

SEQ ID NO: 58491 - protein, 742 aa, Homo sapiens
  Payload ID: 11442
  Gene Symbol: NR3C1
  Gene Name: nuclear receptor subfamily 3, group C, member 1 (glucocorticoid receptor)
  Uniprot ID: P04150
  ENSP ID: ENSP00000387672
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHENVMWLKPESTSHTLI

SEQ ID NO: 58492 - protein, 751 aa, Homo sapiens
  Payload ID: 11442
  Gene Symbol: NR3C1
  Gene Name: nuclear receptor subfamily 3, group C, member 1 (glucocorticoid receptor)
  Uniprot ID: P04150
  ENSP ID: ENSP00000405282
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIASLSQQQDQKPIFNVIPPIPVGSENWNRCQGSGDDNLTSLGTLNFPGRTVFSNGYSSPSMRPDVSSPPSSSSTATTGPPPKLCLVCSDEASGCHYGVLTCGSCKVFFKRAVEGQHNYLCAGRNDCIIDKIRRKNCPACRYRKCLQAGMNLEARKTKKKIKGIQQATTGVSQETSENPGNKTIVPATLPQLTPTLVSLLEVIEPEVLYAGYDSSVPDSTWRIMTTLNMLGGRQVIAAVKWAKAIPGFRNLHLDDQMTLLQYSWMFLMAFALGWRSYRQSSANLLCFAPDLIINEQRMTLPCMYDQCKHMLYVSSELHRLQVSYEEYLCMKTLLLLSSVPKDGLKSQELFDEIRMTYIKELGKAIVKREGNSSQNWQRFYQLTKLLDSMHEVVENLLNYCFQTFLDKTMSIEFPEMLAEIITNQIPKYSNGNIKKLLFHQK

SEQ ID NO: 58493 - protein, 145 aa, Homo sapiens
  Payload ID: 11442
  Gene Symbol: NR3C1
  Gene Name: nuclear receptor subfamily 3, group C, member 1 (glucocorticoid receptor)
  ENSP ID: ENSP00000420856
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSAST

SEQ ID NO: 58494 - protein, 778 aa, Homo sapiens; identical to SEQ ID NO: 58487
  Payload ID: 11442
  Gene Symbol: NR3C1
  Gene Name: nuclear receptor subfamily 3, group C, member 1 (glucocorticoid receptor)
  Uniprot ID: P04150
  ENSP ID: ENSP00000422518

SEQ ID NO: 58495 - protein, 145 aa, Homo sapiens; identical to SEQ ID NO: 58493
  Payload ID: 11442
  Gene Symbol: NR3C1
  Gene Name: nuclear receptor subfamily 3, group C, member 1 (glucocorticoid receptor)
  ENSP ID: ENSP00000424747

SEQ ID NO: 58496 - protein, 145 aa, Homo sapiens; identical to SEQ ID NO: 58493
  Payload ID: 11442
  Gene Symbol: NR3C1
  Gene Name: nuclear receptor subfamily 3, group C, member 1 (glucocorticoid receptor)
  ENSP ID: ENSP00000425313

SEQ ID NO: 58497 - protein, 144 aa, Homo sapiens
  Payload ID: 11442
  Gene Symbol: NR3C1
  Gene Name: nuclear receptor subfamily 3, group C, member 1 (glucocorticoid receptor)
  ENSP ID: ENSP00000425374
MDSKESLTPGREENPSSVLAQERGDVMDFYKTLRGGATVKVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSAS

SEQ ID NO: 58498 - protein, 145 aa, Homo sapiens; identical to SEQ ID NO: 58493
  Payload ID: 11442
  Gene Symbol: NR3C1
  Gene Name: nuclear receptor subfamily 3, group C, member 1 (glucocorticoid receptor)
  ENSP ID: ENSP00000426478

SEQ ID NO: 58499 - protein, 777 aa, Homo sapiens; identical to SEQ ID NO: 58488
  Payload ID: 11442
  Gene Symbol: NR3C1
  Gene Name: nuclear receptor subfamily 3, group C, member 1 (glucocorticoid receptor)
  Uniprot ID: P04150
  ENSP ID: ENSP00000427672

SEQ ID NO: 58500 - protein, 984 aa, Homo sapiens
  Payload ID: 11443
  Gene Symbol: NR3C2
  Gene Name: nuclear receptor subfamily 3, group C, member 2
  ENSP ID: ENSP00000341390
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAVVKSPIMCHEKSPSVCSPLNMTSSVCSPAGINSVSSTTASFGSFPVHSPITQGTPLTCSPNVENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKICLVCGDEASGCHYGVVTCGSCKVFFKRAVEGQHNYLCAGRNDCIIDKIRRKNCPACRLQKCLQAGMNLGARKSKKLGKLKGIHEEQPQQQQPPPPPPPPQSPEEGTTYIAPAKEPSVNTALVPQLSTISRALTPSPVMVLENIEPEIVYAGYDSSKPDTAENLLSTLNRLAGKQMIQVVKWAKVLPGFKNLPLEDQITLIQYSWMCLSSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 58501 - protein, 706 aa, Homo sapiens
  Payload ID: 11443
  Gene Symbol: NR3C2
  Gene Name: nuclear receptor subfamily 3, group C, member 2
  ENSP ID: ENSP00000343907
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAVVKSPIMCHEKSPSVCSPLNMTSSVCSPAGINSVSSTTASFGSFPVHSPITQGTPLTCSPNVENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKICLVCGDEASGCHYGVVTCGSCKVFFKRAVEGQHNYLCAGRNDCIIDKIRRKNCPACRLQKCLQAGMNLGERRCISLPCMNYARGCTKSAFSSFDCSSPLKNTPS

SEQ ID NO: 58502 - protein, 984 aa, Homo sapiens; identical to SEQ ID NO: 58500
  Payload ID: 11443
  Gene Symbol: NR3C2
  Gene Name: nuclear receptor subfamily 3, group C, member 2
  ENSP ID: ENSP00000350815

SEQ ID NO: 58503 - protein, 988 aa, Homo sapiens
  Payload ID: 11443
  Gene Symbol: NR3C2
  Gene Name: nuclear receptor subfamily 3, group C, member 2
  Uniprot ID: P08235
  ENSP ID: ENSP00000421481
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAVVKSPIMCHEKSPSVCSPLNMTSSVCSPAGINSVSSTTASFGSFPVHSPITQGTPLTCSPNVENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKICLVCGDEASGCHYGVVTCGSCKVFFKRAVEGKCSWQHNYLCAGRNDCIIDKIRRKNCPACRLQKCLQAGMNLGARKSKKLGKLKGIHEEQPQQQQPPPPPPPPQSPEEGTTYIAPAKEPSVNTALVPQLSTISRALTPSPVMVLENIEPEIVYAGYDSSKPDTAENLLSTLNRLAGKQMIQVVKWAKVLPGFKNLPLEDQITLIQYSWMCLSSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 58504 - protein, 867 aa, Homo sapiens
  Payload ID: 11443
  Gene Symbol: NR3C2
  Gene Name: nuclear receptor subfamily 3, group C, member 2
  Uniprot ID: P08235
  ENSP ID: ENSP00000423510
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAVVKSPIMCHEKSPSVCSPLNMTSSVCSPAGINSVSSTTASFGSFPVHSPITQGTPLTCSPNVENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKICLVCGDEASGCHYGVVTCGSCKVFFKRAVEGQHNYLCAGRNDCIIDKIRRKNCPACRLQKCLQAGMNLGGFKNLPLEDQITLIQYSWMCLSSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 58505 - protein, 988 aa, Homo sapiens; identical to SEQ ID NO: 58503
  Payload ID: 11443
  Gene Symbol: NR3C2
  Gene Name: nuclear receptor subfamily 3, group C, member 2
  ENSP ID: ENSP00000486719

SEQ ID NO: 58506 - protein, 598 aa, Homo sapiens
  Payload ID: 11444
  Gene Symbol: NR4A1
  Gene Name: nuclear receptor subfamily 4, group A, member 1
  Uniprot ID: P22736
  ENSP ID: ENSP00000243050
MPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEVVRTDSLKGRRGRLPSKPKQPPDASPANLLTSLVRAHLDSGPSTAKLDYSKFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 58507 - protein, 611 aa, Homo sapiens
  Payload ID: 11444
  Gene Symbol: NR4A1
  Gene Name: nuclear receptor subfamily 4, group A, member 1
  Uniprot ID: P22736
  ENSP ID: ENSP00000353427
MWLAKACWSIQSEMPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEVVRTDSLKGRRGRLPSKPKQPPDASPANLLTSLVRAHLDSGPSTAKLDYSKFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 58508 - protein, 598 aa, Homo sapiens; identical to SEQ ID NO: 58506
  Payload ID: 11444
  Gene Symbol: NR4A1
  Gene Name: nuclear receptor subfamily 4, group A, member 1
  Uniprot ID: P22736
  ENSP ID: ENSP00000378301

SEQ ID NO: 58509 - protein, 598 aa, Homo sapiens; identical to SEQ ID NO: 58506
  Payload ID: 11444
  Gene Symbol: NR4A1
  Gene Name: nuclear receptor subfamily 4, group A, member 1
  Uniprot ID: P22736
  ENSP ID: ENSP00000378302

SEQ ID NO: 58510 - protein, 652 aa, Homo sapiens
  Payload ID: 11444
  Gene Symbol: NR4A1
  Gene Name: nuclear receptor subfamily 4, group A, member 1
  ENSP ID: ENSP00000440864
MTSAQYKIKILIEGLHHGQRPGPAPPRQPGSFCWALKADGIMWLAKACWSIQSEMPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEVVRTDSLKGRRGRLPSKPKQPPDASPANLLTSLVRAHLDSGPSTAKLDYSKFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 58511 - protein, 611 aa, Homo sapiens; identical to SEQ ID NO: 58507
  Payload ID: 11444
  Gene Symbol: NR4A1
  Gene Name: nuclear receptor subfamily 4, group A, member 1
  Uniprot ID: P22736
  ENSP ID: ENSP00000449539

SEQ ID NO: 58512 - protein, 325 aa, Homo sapiens
  Payload ID: 11444
  Gene Symbol: NR4A1
  Gene Name: nuclear receptor subfamily 4, group A, member 1
  Uniprot ID: P22736
  ENSP ID: ENSP00000449587
MPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKVPRSPRWGLLLEMERGWPHPIGTCGLPLGSPPS

SEQ ID NO: 58513 - protein, 148 aa, Homo sapiens
  Payload ID: 11444
  Gene Symbol: NR4A1
  Gene Name: nuclear receptor subfamily 4, group A, member 1
  ENSP ID: ENSP00000449858
MPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVAQCRKTPSTSAWLTRTALWTRGGETAASSAASRSAWRWAW

SEQ ID NO: 58514 - protein, 150 aa, Homo sapiens
  Payload ID: 11444
  Gene Symbol: NR4A1
  Gene Name: nuclear receptor subfamily 4, group A, member 1
  ENSP ID: ENSP00000455399
MDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPP

SEQ ID NO: 58515 - protein, 120 aa, Homo sapiens
  Payload ID: 11444
  Gene Symbol: NR4A1
  Gene Name: nuclear receptor subfamily 4, group A, member 1
  ENSP ID: ENSP00000455767
MLGMYSSSTTCSPVLWRSSASGRRRSLALLSCHRLTRTCCWSRPSWSSSSSAWRTGLSQARASSSSAQAWCYTGCSVPVASGTGLTVSWPSQGPCTACLSMSLPSPASLPLSSSPTGMGC

SEQ ID NO: 58516 - protein, 119 aa, Homo sapiens
  Payload ID: 11444
  Gene Symbol: NR4A1
  Gene Name: nuclear receptor subfamily 4, group A, member 1
  ENSP ID: ENSP00000456633
MWLAKACWSIQSEMPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDF

SEQ ID NO: 58517 - protein, 78 aa, Homo sapiens
  Payload ID: 11444
  Gene Symbol: NR4A1
  Gene Name: nuclear receptor subfamily 4, group A, member 1
  ENSP ID: ENSP00000456776
MWLAKACWSIQSGLPETTRKSPQPILGFSLRAVVWDLFPGSKQIVRRKLVSHDSGGAQAPGSATFGCGASPFHCELNS

SEQ ID NO: 58518 - protein, 302 aa, Homo sapiens
  Payload ID: 11444
  Gene Symbol: NR4A1
  Gene Name: nuclear receptor subfamily 4, group A, member 1
  ENSP ID: ENSP00000457070
MWLAKACWSIQSEMPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKG

SEQ ID NO: 58519 - protein, 598 aa, Homo sapiens
  Payload ID: 11445
  Gene Symbol: NR4A2
  Gene Name: nuclear receptor subfamily 4, group A, member 2
  Uniprot ID: P43354
  ENSP ID: ENSP00000344479
MPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEGKLIFCNGVVLHRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 58520 - protein, 150 aa, Homo sapiens
  Payload ID: 11445
  Gene Symbol: NR4A2
  Gene Name: nuclear receptor subfamily 4, group A, member 2
  ENSP ID: ENSP00000385379
  MOD_RES (1)..(1): Any amino acid
XSYHSSGEYSSDFLTPEFVKFSMDLTNTEITATTSLPSFSTFMDNYSTGYDVKPPCLYQMPLSGQQSSIKRTVQKNAKYVCLANKNCPVDKRRRNRCQYCRFQKCLAVGMVKEVVRTDSLKGRRGRLPSKPKSPQEPSPPSPPVSLISAL

SEQ ID NO: 58521 - protein, 598 aa, Homo sapiens; identical to SEQ ID NO: 58519
  Payload ID: 11445
  Gene Symbol: NR4A2
  Gene Name: nuclear receptor subfamily 4, group A, member 2
  Uniprot ID: P43354
  ENSP ID: ENSP00000386747

SEQ ID NO: 58522 - protein, 553 aa, Homo sapiens
  Payload ID: 11445
  Gene Symbol: NR4A2
  Gene Name: nuclear receptor subfamily 4, group A, member 2
  ENSP ID: ENSP00000386993
MPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEEYEHRHFCLLLHCCPGYGHRETRAQGTQESGRTAKQDCKLSQRPRDFQQWGVEPPQLFVQTVGEAPRTSYPLHTGATAHFLPEIGRLGATASNN

SEQ ID NO: 58523 - protein, 106 aa, Homo sapiens
  Payload ID: 11445
  Gene Symbol: NR4A2
  Gene Name: nuclear receptor subfamily 4, group A, member 2
  ENSP ID: ENSP00000388120
MDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTP

SEQ ID NO: 58524 - protein, 535 aa, Homo sapiens
  Payload ID: 11445
  Gene Symbol: NR4A2
  Gene Name: nuclear receptor subfamily 4, group A, member 2
  Uniprot ID: P43354
  ENSP ID: ENSP00000389986
MDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEGKLIFCNGVVLHRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 58525 - protein, 392 aa, Homo sapiens
  Payload ID: 11445
  Gene Symbol: NR4A2
  Gene Name: nuclear receptor subfamily 4, group A, member 2
  ENSP ID: ENSP00000394671
MDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRI

SEQ ID NO: 58526 - protein, 258 aa, Homo sapiens
  Payload ID: 11445
  Gene Symbol: NR4A2
  Gene Name: nuclear receptor subfamily 4, group A, member 2
  ENSP ID: ENSP00000406808
MPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPS

SEQ ID NO: 58527 - protein, 490 aa, Homo sapiens
  Payload ID: 11445
  Gene Symbol: NR4A2
  Gene Name: nuclear receptor subfamily 4, group A, member 2
  ENSP ID: ENSP00000410952
MDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEEYEHRHFCLLLHCCPGYGHRETRAQGTQESGRTAKQDCKLSQRPRDFQQWGVEPPQLFVQTVGEAPRTSYPLHTGATAHFLPEIGRLGATASNN

SEQ ID NO: 58528 - protein, 392 aa, Homo sapiens; identical to SEQ ID NO: 58525
  Payload ID: 11445
  Gene Symbol: NR4A2
  Gene Name: nuclear receptor subfamily 4, group A, member 2
  ENSP ID: ENSP00000415632

SEQ ID NO: 58529 - protein, 637 aa, Homo sapiens
  Payload ID: 11446
  Gene Symbol: NR4A3
  Gene Name: nuclear receptor subfamily 4, group A, member 3
  Uniprot ID: Q92570
  ENSP ID: ENSP00000333122
MHDSIRFGNVDMPCVQAQYSPSPPGSSYAAQTYSSEYTTEIMNPDYTKLTMDLGSTEITATATTSLPSISTFVEGYSSNYELKPSCVYQMQRPLIKVEEGRAPSYHHHHHHHHHHHHHHQQQHQQPSIPPASSPEDEVLPSTSMYFKQSPPSTPTTPAFPPQAGALWDEALPSAPGCIAPGPLLDPPMKAVPTVAGARFPLFHFKPSPPHPPAPSPAGGHHLGYDPTAAAALSLPLGAAAAAGSQAAALESHPYGLPLAKRAAPLAFPPLGLTPSPTASSLLGESPSLPSPPSRSSSSGEGTCAVCGDNAACQHYGVRTCEGCKGFFKRTVQKNAKYVCLANKNCPVDKRRRNRCQYCRFQKCLSVGMVKEVVRTDSLKGRRGRLPSKPKSPLQQEPSQPSPPSPPICMMNALVRALTDSTPRDLDYSRYCPTDQAAAGTDAEHVQQFYNLLTASIDVSRSWAEKIPGFTDLPKEDQTLLIESAFLELFVLRLSIRSNTAEDKFVFCNGLVLHRLQCLRGFGEWLDSIKDFSLNLQSLNLDIQALACLSALSMITERHGLKEPKRVEELCNKITSSLKDHQSKGQALEPTESKVLGALVELRKICTLGLQRIFYLKLEDLVSPPSIIDKLFLDTLPF

SEQ ID NO: 58530 - protein, 443 aa, Homo sapiens
  Payload ID: 11446
  Gene Symbol: NR4A3
  Gene Name: nuclear receptor subfamily 4, group A, member 3
  Uniprot ID: Q92570
  ENSP ID: ENSP00000340301
MPCVQAQYSPSPPGSSYAAQTYSSEYTTEIMNPDYTKLTMDLGSTEITATATTSLPSISTFVEGYSSNYELKPSCVYQMQRPLIKVEEGRAPSYHHHHHHHHHHHHHHQQQHQQPSIPPASSPEDEVLPSTSMYFKQSPPSTPTTPAFPPQAGALWDEALPSAPGCIAPGPLLDPPMKAVPTVAGARFPLFHFKPSPPHPPAPSPAGGHHLGYDPTAAAALSLPLGAAAAAGSQAAALESHPYGLPLAKRAAPLAFPPLGLTPSPTASSLLGESPSLPSPPSRSSSSGEGTCAVCGDNAACQHYGVRTCEGCKGFFKRTVQKNAKYVCLANKNCPVDKRRRNRCQYCRFQKCLSVGMVKEVVRTDSLKGRRGRLPSKPKSPLQQEPSQPSPPSPPICMMNALVRALTDSTPRDLDYSRVSFMISCFQMNDQGLYLWLLVIRVD

SEQ ID NO: 58531 - protein, 626 aa, Homo sapiens
  Payload ID: 11446
  Gene Symbol: NR4A3
  Gene Name: nuclear receptor subfamily 4, group A, member 3
  Uniprot ID: Q92570
  ENSP ID: ENSP00000378531
MPCVQAQYSPSPPGSSYAAQTYSSEYTTEIMNPDYTKLTMDLGSTEITATATTSLPSISTFVEGYSSNYELKPSCVYQMQRPLIKVEEGRAPSYHHHHHHHHHHHHHHQQQHQQPSIPPASSPEDEVLPSTSMYFKQSPPSTPTTPAFPPQAGALWDEALPSAPGCIAPGPLLDPPMKAVPTVAGARFPLFHFKPSPPHPPAPSPAGGHHLGYDPTAAAALSLPLGAAAAAGSQAAALESHPYGLPLAKRAAPLAFPPLGLTPSPTASSLLGESPSLPSPPSRSSSSGEGTCAVCGDNAACQHYGVRTCEGCKGFFKRTVQKNAKYVCLANKNCPVDKRRRNRCQYCRFQKCLSVGMVKEVVRTDSLKGRRGRLPSKPKSPLQQEPSQPSPPSPPICMMNALVRALTDSTPRDLDYSRYCPTDQAAAGTDAEHVQQFYNLLTASIDVSRSWAEKIPGFTDLPKEDQTLLIESAFLELFVLRLSIRSNTAEDKFVFCNGLVLHRLQCLRGFGEWLDSIKDFSLNLQSLNLDIQALACLSALSMITERHGLKEPKRVEELCNKITSSLKDHQSKGQALEPTESKVLGALVELRKICTLGLQRIFYLKLEDLVSPPSIIDKLFLDTLPF

SEQ ID NO: 58532 - protein, 637 aa, Homo sapiens; identical to SEQ ID NO: 58529
  Payload ID: 11446
  Gene Symbol: NR4A3
  Gene Name: nuclear receptor subfamily 4, group A, member 3
  Uniprot ID: Q92570
  ENSP ID: ENSP00000482027

SEQ ID NO: 58533 - protein, 245 aa, Homo sapiens
  Payload ID: 11447
  Gene Symbol: NR5A1
  Gene Name: nuclear receptor subfamily 5, group A, member 1
  ENSP ID: ENSP00000362689
VEEEGDVSNRGVELLQLEPDEDQVRARILGCLQEPTKSRPDQPAAFGLLCRMADQTFISIVDWARRCMVFKELEVADQMTLLQNCWSELLVFDHIYRQVQHGKEGSILLVTGQEVELTTVATQAGSLLHSLVLRAQELVLQLLALQLDRQEFVCLKFIILFSLDLKFLNNHILVKDAQEKANAALLDYTLCHYPHCGDKFQQLLLCLVEVRALSMQAKEYLYHKHLGNEMPRNNLLIEMLQAKQT

SEQ ID NO: 58534 - protein, 461 aa, Homo sapiens
  Payload ID: 11447
  Gene Symbol: NR5A1
  Gene Name: nuclear receptor subfamily 5, group A, member 1
  Uniprot ID: Q13285
  ENSP ID: ENSP00000362690
MDYSYDEDLDELCPVCGDKVSGYHYGLLTCESCKGFFKRTVQNNKHYTCTESQSCKIDKTQRKRCPFCRFQKCLTVGMRLEAVRADRMRGGRNKFGPMYKRDRALKQQKKAQIRANGFKLETGPPMGVPPPPPPAPDYVLPPSLHGPEPKGLAAGPPAGPLGDFGAPALPMAVPGAHGPLAGYLYPAFPGRAIKSEYPEPYASPPQPGLPYGYPEPFSGGPNVPELILQLLQLEPDEDQVRARILGCLQEPTKSRPDQPAAFGLLCRMADQTFISIVDWARRCMVFKELEVADQMTLLQNCWSELLVFDHIYRQVQHGKEGSILLVTGQEVELTTVATQAGSLLHSLVLRAQELVLQLLALQLDRQEFVCLKFIILFSLDLKFLNNHILVKDAQEKANAALLDYTLCHYPHCGDKFQQLLLCLVEVRALSMQAKEYLYHKHLGNEMPRNNLLIEMLQAKQT

SEQ ID NO: 58535 - protein, 177 aa, Homo sapiens
  Payload ID: 11447
  Gene Symbol: NR5A1
  Gene Name: nuclear receptor subfamily 5, group A, member 1
  ENSP ID: ENSP00000393245
MDYSYDEDLDELCPVCGDKVSGYHYGLLTCESCKGFFKRTVQNNKHYTCTESQSCKIDKTQRKRCPFCRFQKCLTVGMRLEAVRADRMRGGRNKFGPMYKRDRALKQQKKAQIRANGFKLETGPPMGVPPPPPPAPDYVLPPSLHGPEPKGLAAGPPAGPLGDFGAPALPMAVPGAH

SEQ ID NO: 58536 - protein, 421 aa, Homo sapiens
  Payload ID: 11447
  Gene Symbol: NR5A1
  Gene Name: nuclear receptor subfamily 5, group A, member 1
  ENSP ID: ENSP00000483309
MDYSYDEDLDELCPVCGDKVSGYHYGLLTCESCKGFFKRTVQNNKHYTCTESQSCKIDKTQRKRCPFCRFQKCLTVGMRLEAVRADRMRGGRNKFGPMYKRDRALKQQKKAQIRANGFKLETGPPMGVPPPPPPAPDYVLPPSLHGPEPKGLAAGPPAGPLGDFGAPALPMAVPGAHGPLAGYLYPAFPGRAIKSEYPEPYASPPQPGLPYGYPEPFSGGPNVPELILQLLQLEPDEDQVRARILGCLQEPTKSRPDQPAAFGLLCRMADQTFISIVDWARRCMVFKELEVELTTVATQAGSLLHSLVLRAQELVLQLLALQLDRQEFVCLKFIILFSLDLKFLNNHILVKDAQEKANAALLDYTLCHYPHCGDKFQQLLLCLVEVRALSMQAKEYLYHKHLGNEMPRNNLLIEMLQAKQT

SEQ ID NO: 58537 - protein, 495 aa, Homo sapiens
  Payload ID: 11448
  Gene Symbol: NR5A2
  Gene Name: nuclear receptor subfamily 5, group A, member 2
  Uniprot ID: O00482
  ENSP ID: ENSP00000236914
MSSNSDTGDLQESLKHGLTPIVSQFKMVNYSYDEDLEELCPVCGDKVSGYHYGLLTCESCKGFFKRTVQNNKRYTCIENQNCQIDKTQRKRCPYCRFQKCLSVGMKLEAVRADRMRGGRNKFGPMYKRDRALKQQKKALIRANGLKLEAMSQVIQAMPSDLTISSAIQNIHSASKGLPLNHAALPPTDYDRSPFVTSPISMTMPPHGSLQGYQTYGHFPSRAIKSEYPDPYTSSPESIMGYSYMDSYQTSSPASIPHLILELLKCEPDEPQVQAKIMAYLQQEQANRSKHEKLSTFGLMCKMADQTLFSIVEWARSSIFFRELKVDDQMKLLQNCWSELLILDHIYRQVVHGKEGSIFLVTGQQVDYSIIASQAGATLNNLMSHAQELVAKLRSLQFDQREFVCLKFLVLFSLDVKNLENFQLVEGVQEQVNAALLDYTMCNYPQQTEKFGQLLLRLPEIRAISMQAEEYLYYKHLNGDVPYNNLLIEMLHAKRA

SEQ ID NO: 58538 - protein, 377 aa, Homo sapiens
  Payload ID: 11448
  Gene Symbol: NR5A2
  Gene Name: nuclear receptor subfamily 5, group A, member 2
  ENSP ID: ENSP00000356326
  MOD_RES (1)..(1): Any amino acid
XDLEELCPVCGDKVSGYHYGLLTCESCKGFFKRTVQNNKRYTCIENQNCQIDKTQRKRCPYCRFQKCLSVGMKLEAVRADRMRGGRNKFGPMYKRDRALKQQKKALIRANGLKLEAMSQVIQAMPSDLTISSAIQNIHSASKGLPLNHAALPPTDYDRSPFVTSPISMTMPPHGSLQGYQTYGHFPSRAIKSEYPDPYTSSPESIMGYSYMDSYQTSSPASIPHLILELLKCEPDEPQVQAKIMAYLQQEQANRSKHEKLSTFGLMCKMADQTLFSIVEWARSSIFFRELKGLTLSPSLECSGTILAHGNLHLLHSSDSPASASRVAGITGVHHNTHLIFVFLVEMGFCHVGQAGLKTPDLRVICLPRPPKVLGLWA

SEQ ID NO: 58539 - protein, 541 aa, Homo sapiens
  Payload ID: 11448
  Gene Symbol: NR5A2
  Gene Name: nuclear receptor subfamily 5, group A, member 2
  Uniprot ID: O00482
  ENSP ID: ENSP00000356331
MSSNSDTGDLQESLKHGLTPIGAGLPDRHGSPIPARGRLVMLPKVETEALGLARSHGEQGQMPENMQVSQFKMVNYSYDEDLEELCPVCGDKVSGYHYGLLTCESCKGFFKRTVQNNKRYTCIENQNCQIDKTQRKRCPYCRFQKCLSVGMKLEAVRADRMRGGRNKFGPMYKRDRALKQQKKALIRANGLKLEAMSQVIQAMPSDLTISSAIQNIHSASKGLPLNHAALPPTDYDRSPFVTSPISMTMPPHGSLQGYQTYGHFPSRAIKSEYPDPYTSSPESIMGYSYMDSYQTSSPASIPHLILELLKCEPDEPQVQAKIMAYLQQEQANRSKHEKLSTFGLMCKMADQTLFSIVEWARSSIFFRELKVDDQMKLLQNCWSELLILDHIYRQVVHGKEGSIFLVTGQQVDYSIIASQAGATLNNLMSHAQELVAKLRSLQFDQREFVCLKFLVLFSLDVKNLENFQLVEGVQEQVNAALLDYTMCNYPQQTEKFGQLLLRLPEIRAISMQAEEYLYYKHLNGDVPYNNLLIEMLHAKRA

SEQ ID NO: 58540 - protein, 71 aa, Homo sapiens
  Payload ID: 11448
  Gene Symbol: NR5A2
  Gene Name: nuclear receptor subfamily 5, group A, member 2
  ENSP ID: ENSP00000414888
  MOD_RES (1)..(1): Any amino acid
XSLKHGLTPIDRGNCRSGCFSFAATLRQRSLLTSCAGLPDRHGSPIPARGRLVMLPKVETEALGLARSHGE

SEQ ID NO: 58541 - protein, 113 aa, Homo sapiens
  Payload ID: 11448
  Gene Symbol: NR5A2
  Gene Name: nuclear receptor subfamily 5, group A, member 2
  ENSP ID: ENSP00000436776
MSSNSDTGDLQESLKHGLTPIDNTENTGTRKMREQHTTISHLFRRAEPPRCAGKESFPAAPRSSGSASGAAARARSGRRRGLRAHGGRALGGSRPRGRSWAPAARSPSWPLPK

SEQ ID NO: 58542 - protein, 469 aa, Homo sapiens
  Payload ID: 11448
  Gene Symbol: NR5A2
  Gene Name: nuclear receptor subfamily 5, group A, member 2
  Uniprot ID: O00482
  ENSP ID: ENSP00000439116
MVNYSYDEDLEELCPVCGDKVSGYHYGLLTCESCKGFFKRTVQNNKRYTCIENQNCQIDKTQRKRCPYCRFQKCLSVGMKLEAVRADRMRGGRNKFGPMYKRDRALKQQKKALIRANGLKLEAMSQVIQAMPSDLTISSAIQNIHSASKGLPLNHAALPPTDYDRSPFVTSPISMTMPPHGSLQGYQTYGHFPSRAIKSEYPDPYTSSPESIMGYSYMDSYQTSSPASIPHLILELLKCEPDEPQVQAKIMAYLQQEQANRSKHEKLSTFGLMCKMADQTLFSIVEWARSSIFFRELKVDDQMKLLQNCWSELLILDHIYRQVVHGKEGSIFLVTGQQVDYSIIASQAGATLNNLMSHAQELVAKLRSLQFDQREFVCLKFLVLFSLDVKNLENFQLVEGVQEQVNAALLDYTMCNYPQQTEKFGQLLLRLPEIRAISMQAEEYLYYKHLNGDVPYNNLLIEMLHAKRA

SEQ ID NO: 58543 - protein, 479 aa, Homo sapiens
  Payload ID: 11449
  Gene Symbol: NR6A1
  Gene Name: nuclear receptor subfamily 6, group A, member 1
  Uniprot ID: Q15406
  ENSP ID: ENSP00000341135
MERDEPPPSGGGGGGGSAGFLEPPAALPPPPRNGFCQDELAELDPGTISVSDDRAEQRTCLICGDRATGLHYGIISCEGCKGFFKRSICNKRVYRCSRDKNCVMSRKQRNRCQYCRLLKCLQMGMNRKAIREDGMPGGRNKSIGPVQISEEEIERIMSGQEFEEEANHWSNHGDSDHSSPGNRASESNQPSPGSTLSSRSVELNGFMAFREQYMGMSVPPHYQYIPHLFSYSGHSPLLPQQARSLDPQSYSLIHQLLSAEDLEPLGTPMLIEDGYAVTQAELFALLCRLADELLFRQIAWIKKLPFFCELSIKDYTCLLSSTWQELILLSSLTVYSKQIFGELADVTAKYSPSDEELHRFSDEGMEVIERLIYLYHKFHQLKVSNEEYACMKAINFLNQDIRGLTSASQLEQLNKRYWYICQDFTEYKYTHQPNRFPDLMMCLPEIRYIAGKMVNVPLEQLPLLFKVVLHSCKTSVGKE

SEQ ID NO: 58544 - protein, 476 aa, Homo sapiens
  Payload ID: 11449
  Gene Symbol: NR6A1
  Gene Name: nuclear receptor subfamily 6, group A, member 1
  Uniprot ID: Q15406
  ENSP ID: ENSP00000362686
MERDEPPPSGGGGGGGSAGFLEPPAALPPPPRNGFCQDELAELDPGTNDRAEQRTCLICGDRATGLHYGIISCEGCKGFFKRSICNKRVYRCSRDKNCVMSRKQRNRCQYCRLLKCLQMGMNRKAIREDGMPGGRNKSIGPVQISEEEIERIMSGQEFEEEANHWSNHGDSDHSSPGNRASESNQPSPGSTLSSSRSVELNGFMAFREQYMGMSVPPHYQYIPHLFSYSGHSPLLPQQARSLDPQSYSLIHQLLSAEDLEPLGTPMLIEDGYAVTQAELFALLCRLADELLFRQIAWIKKLPFFCELSIKDYTCLLSSTWQELILLSSLTVYSKQIFGELADVTAKYSPSDEELHRFSDEGMEVIERLIYLYHKFHQLKVSNEEYACMKAINFLNQDIRGLTSASQLEQLNKRYWYICQDFTEYKYTHQPNRFPDLMMCLPEIRYIAGKMVNVPLEQLPLLFKVVLHSCKTSVGKE

SEQ ID NO: 58545 - protein, 475 aa, Homo sapiens
  Payload ID: 11449
  Gene Symbol: NR6A1
  Gene Name: nuclear receptor subfamily 6, group A, member 1
  Uniprot ID: Q15406
  ENSP ID: ENSP00000413701
MERDEPPPSGGGGGGGSAGFLEPPAALPPPPRNGFCQDELAELDPGTNDRAEQRTCLICGDRATGLHYGIISCEGCKGFFKRSICNKRVYRCSRDKNCVMSRKQRNRCQYCRLLKCLQMGMNRKAIREDGMPGGRNKSIGPVQISEEEIERIMSGQEFEEEANHWSNHGDSDHSSPGNRASESNQPSPGSTLSSRSVELNGFMAFREQYMGMSVPPHYQYIPHLFSYSGHSPLLPQQARSLDPQSYSLIHQLLSAEDLEPLGTPMLIEDGYAVTQAELFALLCRLADELLFRQIAWIKKLPFFCELSIKDYTCLLSSTWQELILLSSLTVYSKQIFGELADVTAKYSPSDEELHRFSDEGMEVIERLIYLYHKFHQLKVSNEEYACMKAINFLNQDIRGLTSASQLEQLNKRYWYICQDFTEYKYTHQPNRFPDLMMCLPEIRYIAGKMVNVPLEQLPLLFKVVLHSCKTSVGKE

SEQ ID NO: 58546 - protein, 480 aa, Homo sapiens
  Payload ID: 11449
  Gene Symbol: NR6A1
  Gene Name: nuclear receptor subfamily 6, group A, member 1
  Uniprot ID: Q15406
  ENSP ID: ENSP00000420267
MERDEPPPSGGGGGGGSAGFLEPPAALPPPPRNGFCQDELAELDPGTISVSDDRAEQRTCLICGDRATGLHYGIISCEGCKGFFKRSICNKRVYRCSRDKNCVMSRKQRNRCQYCRLLKCLQMGMNRKAIREDGMPGGRNKSIGPVQISEEEIERIMSGQEFEEEANHWSNHGDSDHSSPGNRASESNQPSPGSTLSSSRSVELNGFMAFREQYMGMSVPPHYQYIPHLFSYSGHSPLLPQQARSLDPQSYSLIHQLLSAEDLEPLGTPMLIEDGYAVTQAELFALLCRLADELLFRQIAWIKKLPFFCELSIKDYTCLLSSTWQELILLSSLTVYSKQIFGELADVTAKYSPSDEELHRFSDEGMEVIERLIYLYHKFHQLKVSNEEYACMKAINFLNQDIRGLTSASQLEQLNKRYWYICQDFTEYKYTHQPNRFPDLMMCLPEIRYIAGKMVNVPLEQLPLLFKVVLHSCKTSVGKE

SEQ ID NO: 58547 - protein, 232 aa, Homo sapiens
  Payload ID: 11449
  Gene Symbol: NR6A1
  Gene Name: nuclear receptor subfamily 6, group A, member 1
  ENSP ID: ENSP00000420587
METWEVSVSDDRAEQRTCLICGDRATGLHYGIISCEGCKGFFKRSICNKRVYRCSRDKNCVMSRKQRNRCQYCRLLKCLQMGMNRKAIREDGMPGGRNKSIGPVQISEEEIERIMSGQEFEEEANHWSNHGDSDHSSPGNRASESNQPSPGSTLSSSRSVELNGFMAFREQYMGMSVPPHYQYIPHLFSYSGHSPLLPQQARSLDPQSYSLIHQLLSAEDLEPLGTPMLIED

SEQ ID NO: 58548 - protein, 503 aa, Homo sapiens
  Payload ID: 11450
  Gene Symbol: NRF1
  Gene Name: nuclear respiratory factor 1
  Uniprot ID: Q16656
  ENSP ID: ENSP00000223190
MEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQAQLRAFIPEMLKYSTGRGKPGWGKESCKPIWWPEDIPWANVRSDVRTEEQKQRVSWTQALRTIVKNCYKQHGREDLLYAFEDQQTQTQATATHSIAHLVPSQTVVQTFSNPDGTVSLIQVGTGATVATLADASELPTTVTVAQVNYSAVADGEVEQNWATLQGGEMTIQTTQASEATQAVASLAEAAVAASQEMQQGATVTMALNSEAAAHAVATLAEATLQGGGQIVLSGETAAAVGALTGVQDANGLVQIPVSMYQTVVTSLAQGNGPVQVAMAPVTTRISDSAVTMDGQAVEVVTLEQ

SEQ ID NO: 58549 - protein, 522 aa, Homo sapiens
  Payload ID: 11450
  Gene Symbol: NRF1
  Gene Name: nuclear respiratory factor 1
  Uniprot ID: Q16656
  ENSP ID: ENSP00000309826
MEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQAQLRAFIPEMLKYSTGRGKPGWGKESCKPIWWPEDIPWANVRSDVRTEEQKQRVSWTQALRTIVKNCYKQHGREDLLYAFEDQQTQTQATATHSIAHLVPSQTVVQTFSNPDGTVSLIQVGTGATVATLADASELPTTVTVAQVNYSAVADGEVEQNWATLQGGEMTIQTTQASEATQAVASLAEAAVAASQEMQQGATVTMALNSEAAAHAVATLAEATLQGGGQIVLSGETAAAVGALTGVQDANGLFMADRAGRKWILTDKATGLVQIPVSMYQTVVTSLAQGNGPVQVAMAPVTTRISDSAVTMDGQAVEVVTLEQ

SEQ ID NO: 58550 - protein, 522 aa, Homo sapiens; identical to SEQ ID NO: 58549
  Payload ID: 11450
  Gene Symbol: NRF1
  Gene Name: nuclear respiratory factor 1
  Uniprot ID: Q16656
  ENSP ID: ENSP00000342351

SEQ ID NO: 58551 - protein, 503 aa, Homo sapiens; identical to SEQ ID NO: 58548
  Payload ID: 11450
  Gene Symbol: NRF1
  Gene Name: nuclear respiratory factor 1
  Uniprot ID: Q16656
  ENSP ID: ENSP00000376922

SEQ ID NO: 58552 - protein, 503 aa, Homo sapiens; identical to SEQ ID NO: 58548
  Payload ID: 11450
  Gene Symbol: NRF1
  Gene Name: nuclear respiratory factor 1
  Uniprot ID: Q16656
  ENSP ID: ENSP00000376924

SEQ ID NO: 58553 - protein, 209 aa, Homo sapiens
  Payload ID: 11450
  Gene Symbol: NRF1
  Gene Name: nuclear respiratory factor 1
  ENSP ID: ENSP00000394877
MEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQAQLRAFI

SEQ ID NO: 58554 - protein, 619 aa, Homo sapiens
  Payload ID: 11451
  Gene Symbol: NXF1
  Gene Name: nuclear RNA export factor 1
  Uniprot ID: Q9UBU9
  ENSP ID: ENSP00000294172
MADEGKSYSEHDDERVNFPQRKKKGRGPFRWKYGEGNRRSGRGGSGIRSSRLEEDDGDVAMSDAQDGPRVRYNPYTTRPNRRGDTWHDRDRIHVTVRRDRAPPERGGAGTSQDGTSKNWFKITIPYGRKYDKAWLLSMIQSKCSVPFTPIEFHYENTRAQFFVEDASTASALKAVNYKILDRENRRISIIINSSAPPHTILNELKPEQVEQLKLIMSKRYDGSQQALDLKGLRSDPDLVAQNIDVVLNRRSCMAATLRIIEENIPELLSLNLSNNRLYRLDDMSSIVQKAPNLKILNLSGNELKSERELDKIKGLKLEELWLDGNSLCDTFRDQSTYISAIRERFPKLLRLDGHELPPPIAFDVEAPTTLPPCKGSYFGTENLKSLVLHFLQQYYAIYDSGDRQGLLDAYHDGACCSLSIPFIPQNPARSSLAEYFKDSRNVKKLKDPTLRFRLLKHTRLNVVAFLNELPKTQHDVNSFVVDISAQTSTLLCFSVNGVFKEVDGKSRDSLRAFTRTFIAVPASNSGLCIVNDELFVRNASSEEIQRAFAMPAPTPSSSPVPTLSPEQQEMLQAFSTQSGMNLEWSQKCLQDNNWDYTRSAQAFTHLKAKGEIPEVAFMK

SEQ ID NO: 58555 - protein, 115 aa, Homo sapiens
  Payload ID: 11451
  Gene Symbol: NXF1
  Gene Name: nuclear RNA export factor 1
  ENSP ID: ENSP00000431381
MSDAQDGPRVRYNPYTTRPNRRGDTWHDRDRIHVTVRRDRAPPERGGAGTSQDGTSKNWFKITIPYGRKYDKAWLLSMIQSKCSVPFTPIEFHYENTRAQFFVEDASTASALKAV

SEQ ID NO: 58556 - protein, 76 aa, Homo sapiens
  Payload ID: 11451
  Gene Symbol: NXF1
  Gene Name: nuclear RNA export factor 1
  ENSP ID: ENSP00000432530
MADEGKSYSEHDDERVNFPQRKKKGRGPFRWKYGEGNRRSGRGGSGIRSSRLEEDDGDVAMSDAQDGPRQPLYHPT

SEQ ID NO: 58557 - protein, 124 aa, Homo sapiens
  Payload ID: 11451
  Gene Symbol: NXF1
  Gene Name: nuclear RNA export factor 1
  ENSP ID: ENSP00000434301
  MOD_RES (1)..(1): Any amino acid
XISAQTSTLLCFSVNGVFKEVDGKSRDSLRAFTRTFIAVPASNSGSEEIQRAFAMPAPTPSSSPVPTLSPEQQEMLQAFSTQSGMNLEWSQKCLQDNNWDYTRSAQAFTHLKAKGEIPEVAFMK

SEQ ID NO: 58558 - protein, 603 aa, Homo sapiens
  Payload ID: 11451
  Gene Symbol: NXF1
  Gene Name: nuclear RNA export factor 1
  ENSP ID: ENSP00000435742
MADEGKSYSVSTSFFKSPTQFSSNFSLMLPSHREGSFLWIGSGVCMEMASVVKHDDERVNFPQRKKKGRGPFRWKYGEGNRRSGRGGSGIRSSRLEEDDGDVAMSDAQDGPRVRYNPYTTRPNRRGDTWHDRDRIHVTVRRDRAPPERGGAGTSQDGTSKNWFKITIPYGRKYDKAWLLSMIQSKCSVPFTPIEFHYENTRAQFFVEDASTASALKAVNYKILDRENRRISIIINSSAPPHTILNELKPEQVEQLKLIMSKRYDGSQQALDLKGLRSDPDLVAQNIDVVLNRRSCMAATLRIIEENIPELLSLNLSNNRLYRLDDMSSIVQKAPNLKILNLSGNELKSERELDKIKGLKLEELWLDGNSLCDTFRDQSTYISAIRERFPKLLRLDGHELPPPIAFDVEAPTTLPPCKGSYFGTENLKSLVLHFLQQYYAIYDSGDRQGLLDAYHDGACCSLSIPFIPQNPARSSLAEYFKDSRNVKKLKDPTLRFRLLKHTRLNVVAFLNELPKTQHDVNSFVVDISAQTSTLLCFSVNGVFKEVDGKSRDSLRAFTRTFIAVPASNSGLCIVNDELFVRNASSEEIQRAFAMPAPTPSSSPV

SEQ ID NO: 58559 - protein, 619 aa, Homo sapiens; identical to SEQ ID NO: 58554
  Payload ID: 11451
  Gene Symbol: NXF1
  Gene Name: nuclear RNA export factor 1
  Uniprot ID: Q9UBU9
  ENSP ID: ENSP00000436679

SEQ ID NO: 58560 - protein, 63 aa, Homo sapiens
  Payload ID: 11451
  Gene Symbol: NXF1
  Gene Name: nuclear RNA export factor 1
  ENSP ID: ENSP00000437296
MSDAQDGPRVRYNPYTTRPNRRGDTWHDRDRIHVTVRRDRAPPERGGAGTSQDGTSKNWFKIT

SEQ ID NO: 58561 - protein, 356 aa, Homo sapiens
  Payload ID: 11451
  Gene Symbol: NXF1
  Gene Name: nuclear RNA export factor 1
  Uniprot ID: Q9UBU9
  ENSP ID: ENSP00000453885
MADEGKSYSEHDDERVNFPQRKKKGRGPFRWKYGEGNRRSGRGGSGIRSSRLEEDDGDVAMSDAQDGPRVRYNPYTTRPNRRGDTWHDRDRIHVTVRRDRAPPERGGAGTSQDGTSKNWFKITIPYGRKYDKAWLLSMIQSKCSVPFTPIEFHYENTRAQFFVEDASTASALKAVNYKILDRENRRISIIINSSAPPHTILNELKPEQVEQLKLIMSKRYDGSQQALDLKGLRSDPDLVAQNIDVVLNRRSCMAATLRIIEENIPELLSLNLSNNRLYRLDDMSSIVQKAPNLKILNLSGNELKSERELDKIKGLKLEELWLDGNSLCDTFRDQSTYIRSVVACVSPPGDLHPLGG

SEQ ID NO: 58562 - protein, 219 aa, Homo sapiens
  Payload ID: 11451
  Gene Symbol: NXF1
  Gene Name: nuclear RNA export factor 1
  ENSP ID: ENSP00000477375
MIQSKCSVPFTPIEFHYENTRAQFFVEDASTASALKAVNYKILDRENRRISIIINSSAPPHTILNELKPEQVEQLKLIMSKRYDGSQQALDLKGLRSDPDLVAQNIDVVLNRRSCMAATLRIIEENIPELLSLNLSNNRLYRLDDMSSIVQKAPNLKILNLSGNELKSERELDKIKGLKLEELWLDGNSLCDTFRDQSTYIRSVVACVSPPGDLHPLGG

SEQ ID NO: 58563 - protein, 626 aa, Homo sapiens
  Payload ID: 11452
  Gene Symbol: NXF2
  Gene Name: nuclear RNA export factor 2
  Uniprot ID: Q9GZY0
  ENSP ID: ENSP00000474598
MCSTLKKCGTYRTEVAECHDHGSTFQGRKKGGSSFRDNFDKRSCHYEHGGYERPPSHCQENDGSVEMRDVHKDQQLRHTPYSIRCERRMKWHSEDEIRITTWRNRKPPERKMSQNTQDGYTRNWFKVTIPYGIKYDKAWLMNSIQSHCSDRFTPVDFHYVRNRACFFVQDASAASALKDVSYKIYDDENQKICIFVNHSTAPYSVKNKLKPGQMEMLKLTMNKRYNVSQQALDLQNLRFDPDLMGRDIDIILNRRNCMAATLKIIERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQYYSIYDSGDRQGLLGAYHDEACFSLAIPFDPKDSAPSSLCKYFEDSRNMKTLKDPYLKGELLRRTKRDIVDSLSALPKTQHDLSSILVDVWCQTERMLCFSVNGVFKEVEGQSQGSVLAFTRTFIATPGSSSSLCIVNDELFVRDASPQETQSAFSIPVSTLSSSSEPSLSQEQQEMVQAFSAQSGMKLEWSQKCLQDNEWNYTRAGQAFTMLQTEGKIPAEAFKQIS

SEQ ID NO: 58564 - protein, 626 aa, Homo sapiens; identical to SEQ ID NO: 58563
  Payload ID: 11452
  Gene Symbol: NXF2
  Gene Name: nuclear RNA export factor 2
  Uniprot ID: Q9GZY0
  ENSP ID: ENSP00000485586

SEQ ID NO: 58565 - protein, 626 aa, Homo sapiens; identical to SEQ ID NO: 58563
  Payload ID: 11453
  Gene Symbol: NXF2B
  Gene Name: nuclear RNA export factor 2B
  Uniprot ID: Q9GZY0
  ENSP ID: ENSP00000472530

SEQ ID NO: 58566 - protein, 626 aa, Homo sapiens; identical to SEQ ID NO: 58563
  Payload ID: 11453
  Gene Symbol: NXF2B
  Gene Name: nuclear RNA export factor 2B
  Uniprot ID: Q9GZY0
  ENSP ID: ENSP00000474659

SEQ ID NO: 58567 - protein, 409 aa, Homo sapiens
  Payload ID: 11453
  Gene Symbol: NXF2B
  Gene Name: nuclear RNA export factor 2B
  ENSP ID: ENSP00000482525
MKWHSEDEIRITTWRNRKPPERKMSQNTQDGYTRNWFKVTIPYGIKYDKAWLMNSIQSHCSDRFTPVDFHYVRNRACFFVQDASAASALKDVSYKIYDDENQKICIFVNHSTAPYSVKNKLKPGQMEMLKLTMNKRYNVSQQALDLQNLRFDPDLMGRDIDIILNRRNCMAATLKIIERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQYYSIYDSGDRQGLLGAYHDEACFSLAIPFDPKDSAPSSLCKYFEDSRNMKTLKDPYLKGELLRRTKRDIVDSLSALPKTQHDLSSILVDVWCQTVPSGQ

SEQ ID NO: 58568 - protein, 626 aa, Homo sapiens; identical to SEQ ID NO: 58563
  Payload ID: 11453
  Gene Symbol: NXF2B
  Gene Name: nuclear RNA export factor 2B
  Uniprot ID: Q9GZY0
  ENSP ID: ENSP00000484645

SEQ ID NO: 58569 - protein, 531 aa, Homo sapiens
  Payload ID: 11454
  Gene Symbol: NXF3
  Gene Name: nuclear RNA export factor 3
  Uniprot ID: Q9H4D5
  ENSP ID: ENSP00000378504
MSLPSGHTTGHTDQVVQRRARCWDIYQRRFSSRSEPVNPGMHSSSHQQQDGDAAMHGAHMDSPVRYTPYTISPYNRKGSFRKQDQTHVNMEREQKPPERRMEGNMPDGTLGSWFKITVPFGIKYNEKWLLNLIQNECSVPFVPVEFHYENMHASFFVENASIAYALKNVSGKIWDEDNEKISIFVNPAGIPHFVHRELKSEKVEQIKLAMNQQCDVSQEALDIQRLPFYPDMVNRDTKMASNPRKCMAASLDVHEENIPTVMSAGEMDKWKGIEPGEKCADRSPVCTTFSDTSSNINSILELFPKLLCLDGQQSPRATLCGTEAHKRLPTCKGSFFGSEMLKNLVLQFLQQYYLIYDSGDRQGLLSAYHDEACFSLSIPFNPEDSAPSSFCKFFKDSRNIKILKDPYLRGELLKHTKLDIVDSLSALPKTQHDLSSFLVDMWYQTEWMLCFSVNGVFKEVEGQSQGSVLAFTRTFIATPGSSSSLCIVNDKLFVRDTSHQGTQSALFTLVPTAFSSSVPAFSQEQQKMLPS

SEQ ID NO: 58570 - protein, 361 aa, Homo sapiens
  Payload ID: 11454
  Gene Symbol: NXF3
  Gene Name: nuclear RNA export factor 3
  ENSP ID: ENSP00000404017
  MOD_RES (1)..(1): Any amino acid
XNEKWLLNLIQNECSVPFVPVEFHYENMHASFFVENASIAYALKNVSGKIWDEDNEKISIFVNPAGIPHFVHRELKSEKVEQIKLAMNQQCDVSQEALDIQRLPFYPDMVNRDTKMASNPRKCMAASLDVHEENIPTVMSAGEMDKWKGIEPGEKCADRSPVCTTFSDTSSNINSILELFPKLLCLDGQQSPRATLCGTEAHKRLPTCKGSFFGSEMLKNLVLQFLQQYYLIYDSGDRQGLLSAYHDEACFSLSIPFNPEDSAPSSFCKFFKDSRNIKILKDPYLRGELLKHTKLDIVDSLSALPKTQHDLSSFLVDMWYQTEWMLCFSVNGVFKEVSGFCSRLHPDLHCYPWQQFQSVHR

SEQ ID NO: 58571 - protein, 397 aa, Homo sapiens
  Payload ID: 11455
  Gene Symbol: NXF5
  Gene Name: nuclear RNA export factor 5
  Uniprot ID: Q9H1B4
  ENSP ID: ENSP00000263032
MRRNTQDENMRKWFKVTIPYGIKYDKAWLMNSIQSNCSVPFTPVDFHYIRNRACFFVQVASAASALKDVSYKIYDDENQKICIFVSHFTAPYSVKNKLKPGQMEMLKLTMNKRYNVSQQALDLQNLRFDPDLMGRDIDIILNRRNCMAATLKITERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQSNLCKYFKDSRNIKILKDPYLQRKLLKHTKCPRNVDSLSALPETQHDFTSILVDMWYQTVNTCFLPRAGPESQRWWCLLSLKWKDGLRVLILPSCGPSSLPLAAIPVCAS

SEQ ID NO: 58572 - protein, 302 aa, Homo sapiens
  Payload ID: 11455
  Gene Symbol: NXF5
  Gene Name: nuclear RNA export factor 5
  Uniprot ID: Q9H1B4
  ENSP ID: ENSP00000331535
MRRNTQDENMRKWFKVTICIFVSHFTAPYSVKNKLKPGQMEMLKLTMNKRYNVSQQALDLQNLRFDPDLMGRDIDIILNRRNCMAATLKITERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQSNLCKYFKDSRNIKILKDPYLQRKLLKHTKCPRNVDSLSALPETQHDFTSILVDMWYQTVNTCFLPRAGPESQRWVGG

SEQ ID NO: 58573 - protein, 305 aa, Homo sapiens
  Payload ID: 11455
  Gene Symbol: NXF5
  Gene Name: nuclear RNA export factor 5
  Uniprot ID: Q9H1B4
  ENSP ID: ENSP00000354539
MRRNTQDENMRKWFKVTICIFVSHFTAPYSVKNKLKPGQMEMLKLTMNKRYNVSQQALDLQNLRFDPDLMGRDIDIILNRRNCMAATLKITERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQSNLCKYFKDSRNIKILKDPYLQRKLLKHTKCPRNVDSLSALPETQHDFTSILVDMWYQTVNTCFLPRAGPESQSGRMVSGF

SEQ ID NO: 58574 - protein, 368 aa, Homo sapiens
  Payload ID: 11455
  Gene Symbol: NXF5
  Gene Name: nuclear RNA export factor 5
  Uniprot ID: Q9H1B4
  ENSP ID: ENSP00000361889
MRRNTQDENMRKWFKVTIPYGIKYDKAWLMNSIQSNCSVPFTPVDFHYIRNRACFFVQVASAASALKDVSYKIYDDENQKICIFVSHFTAPYSVKNKLKPGQMEMLKLTMNKRYNVSQQALDLQNLRFDPDLMGRDIDIILNRRNCMAATLKITERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQSNLCKYFKDSRNIKILKDPYLQRKLLKHTKCPRNVDSLSALPETQHDFTSILVDMWYQTVNTCFLPRAGPESQSGRMVSGF

SEQ ID NO: 58575 - protein, 168 aa, Homo sapiens
  Payload ID: 11455
  Gene Symbol: NXF5
  Gene Name: nuclear RNA export factor 5
  Uniprot ID: Q9H1B4
  ENSP ID: ENSP00000422976
MRRNTQDENMRKWFKVTIPYGIKYDKAWLMNSIQSNCSVPFTPVDFHYIRNRACFFVQVASAASALKDVSYKIYDDENQKICIFVSHFTAPYSVKNKLKPGQMEMLKLTMNKRYNVSQQALDLQNLRFDPDLMGRDIDIILNRRNCMAATLKITERNFPERRLPKSRP

SEQ ID NO: 58576 - protein, 365 aa, Homo sapiens
  Payload ID: 11455
  Gene Symbol: NXF5
  Gene Name: nuclear RNA export factor 5
  Uniprot ID: Q9H1B4
  ENSP ID: ENSP00000426978
MRRNTQDENMRKWFKVTIPYGIKYDKAWLMNSIQSNCSVPFTPVDFHYIRNRACFFVQVASAASALKDVSYKIYDDENQKICIFVSHFTAPYSVKNKLKPGQMEMLKLTMNKRYNVSQQALDLQNLRFDPDLMGRDIDIILNRRNCMAATLKITERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQSNLCKYFKDSRNIKILKDPYLQRKLLKHTKCPRNVDSLSALPETQHDFTSILVDMWYQTVNTCFLPRAGPESQSLRPL

SEQ ID NO: 58577 - protein, 397 aa, Homo sapiens; identical to SEQ ID NO: 58571
  Payload ID: 11455
  Gene Symbol: NXF5
  Gene Name: nuclear RNA export factor 5
  Uniprot ID: Q9H1B4
  ENSP ID: ENSP00000442401

SEQ ID NO: 58578 - protein, 558 aa, Homo sapiens
  Payload ID: 11456
  Gene Symbol: NSRP1
  Gene Name: nuclear speckle splicing regulatory protein 1
  Uniprot ID: Q9H0G5
  ENSP ID: ENSP00000247026
MAIPGRQYGLILPKKTQQLHPVLQKPSVFGNDSDDDDETSVSESLQREAAKKQAMKQTKLEIQKALAEDATVYEYDSIYDEMQKKKEENNPKLLLGKDRKPKYIHNLLKAVEIRKKEQEKRMEKKIQREREMEKGEFDDKEAFVTSAYKKKLQERAEEEEREKRAAALEACLDVTKQKDLSGFYRHLLNQAVGEEEVPKCSFREARSGIKEEKSRGFSNEVSSKNRIPQEKCILQTDVKVEENPDADSDFDAKSSADDEIEETRVNCRREKVIETPENDFKHHRSQNHSRSPSEERGHSTRHHTKGSRTSRGHEKREDQHQQKQSRDQENHYTDRDYRKERDSHRHREASHRDSHWKRHEQEDKPRARDQRERSDRVWKREKDREKYSQREQERDRQQNDQNRPSEKGEKEEKSKAKEEHMKVRKERYENNDKYRDREKREVGVQSSERNQDRKESSPNSRAKDKFLDQERSNKMRNMAKDKERNQEKPSNSESSLGAKHRLTEEGQEKGKEQERPPEAVSKFAKRNNEETVMSARDRYLARQMARVNAKTYIEKEDD

SEQ ID NO: 58579 - protein, 50 aa, Homo sapiens
  Payload ID: 11456
  Gene Symbol: NSRP1
  Gene Name: nuclear speckle splicing regulatory protein 1
  ENSP ID: ENSP00000378303
MAIPGRQWGFTLVAQAGVQWCNLGSPQPPPPGFKRFSCLSLPNSCNYRPL

SEQ ID NO: 58580 - protein, 42 aa, Homo sapiens
  Payload ID: 11456
  Gene Symbol: NSRP1
  Gene Name: nuclear speckle splicing regulatory protein 1
  ENSP ID: ENSP00000462820
MAIPGRQYGLILPKKTQQLHPVLQKPSVFGNDSDDDDEVFGI

SEQ ID NO: 58581 - protein, 74 aa, Homo sapiens
  Payload ID: 11456
  Gene Symbol: NSRP1
  Gene Name: nuclear speckle splicing regulatory protein 1
  ENSP ID: ENSP00000463722
MAIPGRQYGLILPKKTQQLHPVLQKPSVFGNDSDDDDEMGFHSCCPGWSAMVQSRLTATSTSWVQAIFLPQPPK

SEQ ID NO: 58582 - protein, 92 aa, Homo sapiens
  Payload ID: 11456
  Gene Symbol: NSRP1
  Gene Name: nuclear speckle splicing regulatory protein 1
  ENSP ID: ENSP00000464237
MAIPGRQYGLILPKKTQQLHPVLQKPSVFGNDSDDDDEDLALSPRMECNLCSHNSWQPQPPRPKHASHLSLPSSWDHRHTPPCLANFLIYFL

SEQ ID NO: 58583 - protein, 41 aa, Homo sapiens
  Payload ID: 11456
  Gene Symbol: NSRP1
  Gene Name: nuclear speckle splicing regulatory protein 1
  ENSP ID: ENSP00000464569
MAIPGRQNIVLRSHRKRVWAYFAKENTAVAPCFAKTISVWE

SEQ ID NO: 58584 - protein, 64 aa, Homo sapiens
  Payload ID: 11456
  Gene Symbol: NSRP1
  Gene Name: nuclear speckle splicing regulatory protein 1
  ENSP ID: ENSP00000465442
MKQTKLEIQKALAEDATVYEYDSIYDEMQKKKEENNPKLLLGKDRKPKYIHNLLKAVEIRKKEQ

SEQ ID NO: 58585 - protein, 104 aa, Homo sapiens
  Payload ID: 11456
  Gene Symbol: NSRP1
  Gene Name: nuclear speckle splicing regulatory protein 1
  ENSP ID: ENSP00000466463
MKQTKLEIQKALAEDATVYEYDSIYDEMQKKKEENNPKLLLGKDRKPKYIHNLLKAVEIRKKEQEKRMEKKIQREREMEKGEFDDKEAFVTSAYKKKLQERAEE

SEQ ID NO: 58586 - protein, 41 aa, Homo sapiens; identical to SEQ ID NO: 58583
  Payload ID: 11456
  Gene Symbol: NSRP1
  Gene Name: nuclear speckle splicing regulatory protein 1
  ENSP ID: ENSP00000466640

SEQ ID NO: 58587 - protein, 68 aa, Homo sapiens
  Payload ID: 11456
  Gene Symbol: NSRP1
  Gene Name: nuclear speckle splicing regulatory protein 1
  ENSP ID: ENSP00000467856
  MOD_RES (1)..(1): Any amino acid
XYGLILPKKTQQLHPVLQKPSVFGNDSDDDDEMGFHSCCPGWSAMVQSRLTATSTSWVQAIFLPQPPK

SEQ ID NO: 58588 - protein, 157 aa, Homo sapiens
  Payload ID: 11456
  Gene Symbol: NSRP1
  Gene Name: nuclear speckle splicing regulatory protein 1
  ENSP ID: ENSP00000468327
MKQTKLEIQKALAEDATVYEYDSIYDEMQKKKEENNPKLLLGKDRKPKYIHNLLKAVEIRKKEQEKRMEKKIQREREMEKGEFDDKEAFVTSAYKKKLQERAEEEEREKRAAALEACLDVTKQKDLSGFYRHLLNQAVGEEEVPKCSFREARSGIKE

SEQ ID NO: 58589 - protein, 504 aa, Homo sapiens
  Payload ID: 11456
  Gene Symbol: NSRP1
  Gene Name: nuclear speckle splicing regulatory protein 1
  ENSP ID: ENSP00000477862
MKQTKLEIQKALAEDATVYEYDSIYDEMQKKKEENNPKLLLGKDRKPKYIHNLLKAVEIRKKEQEKRMEKKIQREREMEKGEFDDKEAFVTSAYKKKLQERAEEEEREKRAAALEACLDVTKQKDLSGFYRHLLNQAVGEEEVPKCSFREARSGIKEEKSRGFSNEVSSKNRIPQEKCILQTDVKVEENPDADSDFDAKSSADDEIEETRVNCRREKVIETPENDFKHHRSQNHSRSPSEERGHSTRHHTKGSRTSRGHEKREDQHQQKQSRDQENHYTDRDYRKERDSHRHREASHRDSHWKRHEQEDKPRARDQRERSDRVWKREKDREKYSQREQERDRQQNDQNRPSEKGEKEEKSKAKEEHMKVRKERYENNDKYRDREKREVGVQSSERNQDRKESSPNSRAKDKFLDQERSNKMRNMAKDKERNQEKPSNSESSLGAKHRLTEEGQEKGKEQERPPEAVSKFAKRNNEETVMSARDRYLARQMARVNAKTYIEKEDD

SEQ ID NO: 58590 - protein, 318 aa, Homo sapiens
  Payload ID: 11457
  Gene Symbol: NFYA
  Gene Name: nuclear transcription factor Y, alpha
  Uniprot ID: P23511
  ENSP ID: ENSP00000229418
MEQYTANSNSSTEQIVVQAGQIQQQVQGQPLMVQVSGGQLITSTGQPIMVQAVPGGQGQTIMQVPVSGTQGLQQIQLVPPGQIQIQGGQAVQVQGQQGQTQQIIIQQPQTAVTAGQTQTQQQIAVQGQQVAQTAEGQTIVYQPVNADGTILQQVTVPVSGMITIPAASLAGAQIVQTGANTNTTSSGQGTVTVTLPVAGNVVNSGGMVMMVPGAGSVPAIQRIPLPGAEMLEEEPLYVNAKQYHRILKRRQARAKLEAEGKIPKERRKYLHESRHRHAMARKRGEGGRFFSPKEKDSPHMQDPNQADEEAMTQIIRVS

SEQ ID NO: 58591 - protein, 347 aa, Homo sapiens
  Payload ID: 11457
  Gene Symbol: NFYA
  Gene Name: nuclear transcription factor Y, alpha
  Uniprot ID: P23511
  ENSP ID: ENSP00000345702
MEQYTANSNSSTEQIVVQAGQIQQQQQGGVTAVQLQTEAQVASASGQQVQTLQVVQGQPLMVQVSGGQLITSTGQPIMVQAVPGGQGQTIMQVPVSGTQGLQQIQLVPPGQIQIQGGQAVQVQGQQGQTQQIIIQQPQTAVTAGQTQTQQQIAVQGQQVAQTAEGQTIVYQPVNADGTILQQVTVPVSGMITIPAASLAGAQIVQTGANTNTTSSGQGTVTVTLPVAGNVVNSGGMVMMVPGAGSVPAIQRIPLPGAEMLEEEPLYVNAKQYHRILKRRQARAKLEAEGKIPKERRKYLHESRHRHAMARKRGEGGRFFSPKEKDSPHMQDPNQADEEAMTQIIRVS

SEQ ID NO: 58592 - protein, 207 aa, Homo sapiens
  Payload ID: 11458
  Gene Symbol: NFYB
  Gene Name: nuclear transcription factor Y, beta
  Uniprot ID: P25208
  ENSP ID: ENSP00000240055
MTMDGDSSTTDASQLGISADYIGGSHYVIQPHDDTEDSMNDHEDTNGSKESFREQDIYLPIANVARIMKNAIPQTGKIAKDAKECVQECVSEFISFITSEASERCHQEKRKTINGEDILFAMSTLGFDSYVEPLKLYLQKFREAMKGEKGIGGAVTATDGLSEELTEEAFTNQLPAGLITTDGQQQNVMVYTTSYQQISGVQQIQFS

SEQ ID NO: 58593 - protein, 207 aa, Homo sapiens; identical to SEQ ID NO: 58592
  Payload ID: 11458
  Gene Symbol: NFYB
  Gene Name: nuclear transcription factor Y, beta
  Uniprot ID: P25208
  ENSP ID: ENSP00000447486

SEQ ID NO: 58594 - protein, 131 aa, Homo sapiens
  Payload ID: 11458
  Gene Symbol: NFYB
  Gene Name: nuclear transcription factor Y, beta
  ENSP ID: ENSP00000448250
MNLMDGDSSTTDASQLGISADYIGGSHYVIQPHDDTEDSMNDHEDTNGSKESFREQDIYLPIANVARIMKNAIPQTGKIAKDAKECVQECVSEFISFITSEASERCHQEKRKTINGEDILFAMSTLGFDSY

SEQ ID NO: 58595 - protein, 458 aa, Homo sapiens
  Payload ID: 11459
  Gene Symbol: NFYC
  Gene Name: nuclear transcription factor Y, gamma
  Uniprot ID: Q13952
  ENSP ID: ENSP00000312617
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQGQRNASQGKPRRCLKETLQITQTEVQQGQQQFSQFTDGQRNSVQQARVSELTGEAEPREVKATGNSTPCTSSLPTTHPPSHRAGASCVCCSQPQQSSTSPPPSDALQWVVVEVSGTPNQLETHRELHAPLPGMTSLSPLHPSQQLYQIQQVTMPAGQDLAQPMFIQSANQPSDGQAPQVTGD

SEQ ID NO: 58596 - protein, 335 aa, Homo sapiens
  Payload ID: 11459
  Gene Symbol: NFYC
  Gene Name: nuclear transcription factor Y, gamma
  Uniprot ID: Q13952
  ENSP ID: ENSP00000361734
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQQLYQIQQVTMPAGQDLAQPMFIQSANQPSDGQAPQVTGD

SEQ ID NO: 58597 - protein, 439 aa, Homo sapiens
  Payload ID: 11459
  Gene Symbol: NFYC
  Gene Name: nuclear transcription factor Y, gamma
  Uniprot ID: Q13952
  ENSP ID: ENSP00000361736
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQRNSVQQARVSELTGEAEPREVKATGNSTPCTSSLPTTHPPSHRAGASCVCCSQPQQSSTSPPPSDALQWVVVEVSGTPNQLETHRELHAPLPGMTSLSPLHPSQQLYQIQQVTMPAGQDLAQPMFIQSANQPSDGQAPQVTGD

SEQ ID NO: 58598 - protein, 301 aa, Homo sapiens
  Payload ID: 11459
  Gene Symbol: NFYC
  Gene Name: nuclear transcription factor Y, gamma
  Uniprot ID: Q13952
  ENSP ID: ENSP00000361737
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTMQVMQQIITNTGEIQQIPVQLNAGQLQYIRLAQPVSGTQVVQGQIQTLATNAQQITQTEVQQGQQQFSQFTDGQQLYQIQQVTMPAGQDLAQPMFIQSANQPSDGQAPQVTGD

SEQ ID NO: 58599 - protein, 335 aa, Homo sapiens; identical to SEQ ID NO: 58596
  Payload ID: 11459
  Gene Symbol: NFYC
  Gene Name: nuclear transcription factor Y, gamma
  Uniprot ID: Q13952
  ENSP ID: ENSP00000361738

SEQ ID NO: 58600 - protein, 313 aa, Homo sapiens
  Payload ID: 11459
  Gene Symbol: NFYC
  Gene Name: nuclear transcription factor Y, gamma
  ENSP ID: ENSP00000361754
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPETGLAVSLRLMKCSGLISAHCSFRLPGSSDSPASASRVAGIIGAAECRPAAVYPLSPACIRHSSCAGTDPDTC

SEQ ID NO: 58601 - protein, 354 aa, Homo sapiens
  Payload ID: 11459
  Gene Symbol: NFYC
  Gene Name: nuclear transcription factor Y, gamma
  Uniprot ID: Q13952
  ENSP ID: ENSP00000396620
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQGQRNASQGKPRRCLKETLQITQTEVQQGQQQFSQFTDGQQLYQIQQVTMPAGQDLAQPMFIQSANQPSDGQAPQVTGD

SEQ ID NO: 58602 - protein, 129 aa, Homo sapiens
  Payload ID: 11459
  Gene Symbol: NFYC
  Gene Name: nuclear transcription factor Y, gamma
  ENSP ID: ENSP00000397647
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQ

SEQ ID NO: 58603 - protein, 335 aa, Homo sapiens; identical to SEQ ID NO: 58596
  Payload ID: 11459
  Gene Symbol: NFYC
  Gene Name: nuclear transcription factor Y, gamma
  Uniprot ID: Q13952
  ENSP ID: ENSP00000404427

SEQ ID NO: 58604 - protein, 297 aa, Homo sapiens
  Payload ID: 11459
  Gene Symbol: NFYC
  Gene Name: nuclear transcription factor Y, gamma
  Uniprot ID: Q13952
  ENSP ID: ENSP00000408315
MSTEGGFGGTSSSDAQQSLQSFWPRVMEEIRNLTVKDFRVQELPLARIKKIMKLDEDVKRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQQLYQIQQVTMPAGQDLAQPMFIQSANQPSDGQAPQVTGD

SEQ ID NO: 58605 - protein, 334 aa, Homo sapiens
  Payload ID: 11459
  Gene Symbol: NFYC
  Gene Name: nuclear transcription factor Y, gamma
  Uniprot ID: Q13952
  ENSP ID: ENSP00000408867
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQLYQIQQVTMPAGQDLAQPMFIQSANQPSDGQAPQVTGD

SEQ ID NO: 58606 - protein, 179 aa, Homo sapiens
  Payload ID: 11459
  Gene Symbol: NFYC
  Gene Name: nuclear transcription factor Y, gamma
  ENSP ID: ENSP00000409219
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQEEVRQSVTPAEPVQYYFTLAQQPTAVQVQGQQQGQQTTSSTTTIQPGQIIIAQPQQGQTTPVTMQVGEGQQVQIVQAQPQGQ

SEQ ID NO: 58607 - protein, 335 aa, Homo sapiens; identical to SEQ ID NO: 58596
  Payload ID: 11459
  Gene Symbol: NFYC
  Gene Name: nuclear transcription factor Y, gamma
  Uniprot ID: Q13952
  ENSP ID: ENSP00000414299

SEQ ID NO: 58608 - protein, 186 aa, Homo sapiens
  Payload ID: 11459
  Gene Symbol: NFYC
  Gene Name: nuclear transcription factor Y, gamma
  ENSP ID: ENSP00000416403
  MOD_RES (1)..(1): Any amino acid
XPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLAMETFFAFKRQIYSLWRVGGFIATLFSPRDPGN

SEQ ID NO: 58609 - protein, 95 aa, Homo sapiens
  Payload ID: 11459
  Gene Symbol: NFYC
  Gene Name: nuclear transcription factor Y, gamma
  ENSP ID: ENSP00000433413
MSTEGGFGGTSSSDAQQSLQSFWPRVMEEIRNLTVMISAEAPVLFAKAAQIFITELTLRAWIHTEDNKRRTLQRNDIAMAITKFDQFDFLIDIVP

SEQ ID NO: 58610 - protein, 52 aa, Homo sapiens
  Payload ID: 11459
  Gene Symbol: NFYC
  Gene Name: nuclear transcription factor Y, gamma
  ENSP ID: ENSP00000433820
MSTEGGFGGTSSSDAQQSLQSFWPRVMEEIRNLTVKDFRVQELPLARIKKIM

SEQ ID NO: 58611 - protein, 60 aa, Homo sapiens
  Payload ID: 11459
  Gene Symbol: NFYC
  Gene Name: nuclear transcription factor Y, gamma
  ENSP ID: ENSP00000434404
MSTEGGFGGTSSSDAQQSLQSFWPRVMEEIRNLTVKDFRVQELPLARIKKIMKLDEDVKM

SEQ ID NO: 58612 - protein, 141 aa, Homo sapiens
  Payload ID: 11459
  Gene Symbol: NFYC
  Gene Name: nuclear transcription factor Y, gamma
  ENSP ID: ENSP00000436710
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEVRQSVTPAEPV

SEQ ID NO: 58613 - protein, 233 aa, Homo sapiens
  Payload ID: 11459
  Gene Symbol: NFYC
  Gene Name: nuclear transcription factor Y, gamma
  ENSP ID: ENSP00000480994
MAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQQLYQIQQVTMRARTSPSPCSSSQPTSPPTGPPGDRRLRA

SEQ ID NO: 58614 - protein, 833 aa, Homo sapiens
  Payload ID: 11460
  Gene Symbol: NFX1
  Gene Name: nuclear transcription factor, X-box binding 1
  Uniprot ID: Q12986
  ENSP ID: ENSP00000317695
MAEAPPVSGTFKFNTDAAEFIPQEKKNSGLNCGTQRRLDSNRIGRRNYSSPPPCHLSRQVPYDEISAVHQHSYHPSGSKPKSQQTSFQSSPCNKSPKSHGLQNQPWQKLRNEKHHIRVKKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTGSLIEQLTTEKYECMVCCELVRVTAPVWSCQSCYHVFHLNCIKKWARSPASQADGQSGWRCPACQNVSAHVPNTYTCFCGKVKNPEWSRNEIPHSCGEVCRKKQPGQDCPHSCNLLCHPGPCPPCPAFMTKTCECGRTRHTVRCGQAVSVHCSNPCENILNCGQHQCAELCHGGQCQPCQIILNQVCYCGSTSRDVLCGTDVGKSDGFGDFSCLKICGKDLKCGNHTCSQVCHPQPCQQCPRLPQLVRCCPCGQTPLSQLLELGSSSRKTCMDPVPSCGKVCGKPLPCGSLDFIHTCEKLCHEGDCGPCSRTSVISCRCSFRTKELPCTSLKSEDATFMCDKRCNKKRLCGRHKCNEICCVDKEHKCPLICGRKLRCGLHRCEEPCHRGNCQTCWQASFDELTCHCGASVIYPPVPCGTRPPECTQTCARVHECDHPVYHSCHSEEKCPPCTFLTQKWCMGKHEQSHYWASTQKKRSHYMKKIPAHACL

SEQ ID NO: 58615 - protein, 1024 aa, Homo sapiens
  Payload ID: 11460
  Gene Symbol: NFX1
  Gene Name: nuclear transcription factor, X-box binding 1
  Uniprot ID: Q12986
  ENSP ID: ENSP00000368836
MAEAPPVSGTFKFNTDAAEFIPQEKKNSGLNCGTQRRLDSNRIGRRNYSSPPPCHLSRQVPYDEISAVHQHSYHPSGSKPKSQQTSFQSSPCNKSPKSHGLQNQPWQKLRNEKHHIRVKKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTGSLIEQLTTEKYECMVCCELVRVTAPVWSCQSCYHVFHLNCIKKWARSPASQADGQSGWRCPACQNVSAHVPNTYTCFCGKVKNPEWSRNEIPHSCGEVCRKKQPGQDCPHSCNLLCHPGPCPPCPAFMTKTCECGRTRHTVRCGQAVSVHCSNPCENILNCGQHQCAELCHGGQCQPCQIILNQVCYCGSTSRDVLCGTDVGKSDGFGDFSCLKICGKDLKCGNHTCSQVCHPQPCQQCPRLPQLVRCCPCGQTPLSQLLELGSSSRKTCMDPVPSCGKVCGKPLPCGSLDFIHTCEKLCHEGDCGPCSRTSVISCRCSFRTKELPCTSLKSEDATFMCDKRCNKKRLCGRHKCNEICCVDKEHKCPLICGRKLRCGLHRCEEPCHRGNCQTCWQASFDELTCHCGASVIYPPVPCGTRPPECTQTCARVHECDHPVYHSCHSEEKCPPCTFLTQKWCMGKHEFRSNIPCHLVDISCGLPCSATLPCGMHKCQRLCHKGECLVDEPCKQPCTTPRADCGHPCMAPCHTSSPCPVTACKAKVELQCECGRRKEMVICSEASSTYQRIAAISMASKITDMQLGGSVEISKLITKKEVHQARLECDEECSALERKKRLAEAFHISEDSDPFNIRSSGSKFSDSLKEDARKDLKFVSDVEKEMETLVEAVNKVEVETSHWTFL

SEQ ID NO: 58616 - protein, 1120 aa, Homo sapiens
  Payload ID: 11460
  Gene Symbol: NFX1
  Gene Name: nuclear transcription factor, X-box binding 1
  Uniprot ID: Q12986
  ENSP ID: ENSP00000368856
MAEAPPVSGTFKFNTDAAEFIPQEKKNSGLNCGTQRRLDSNRIGRRNYSSPPPCHLSRQVPYDEISAVHQHSYHPSGSKPKSQQTSFQSSPCNKSPKSHGLQNQPWQKLRNEKHHIRVKKAQSLAEQTSDTAGLESSTRSESGTDLREHSPSESEKEVVGADPRGAKPKKATQFVYSYGRGPKVKGKLKCEWSNRTTPKPEDAGPESTKPVGVFHPDSSEASSRKGVLDGYGARRNEQRRYPQKRPPWEVEGARPRPGRNPPKQEGHRHTNAGHRNNMGPIPKDDLNERPAKSTCDSENLAVINKSSRRVDQEKCTVRRQDPQVVSPFSRGKQNHVLKNVETHTGSLIEQLTTEKYECMVCCELVRVTAPVWSCQSCYHVFHLNCIKKWARSPASQADGQSGWRCPACQNVSAHVPNTYTCFCGKVKNPEWSRNEIPHSCGEVCRKKQPGQDCPHSCNLLCHPGPCPPCPAFMTKTCECGRTRHTVRCGQAVSVHCSNPCENILNCGQHQCAELCHGGQCQPCQIILNQVCYCGSTSRDVLCGTDVGKSDGFGDFSCLKICGKDLKCGNHTCSQVCHPQPCQQCPRLPQLVRCCPCGQTPLSQLLELGSSSRKTCMDPVPSCGKVCGKPLPCGSLDFIHTCEKLCHEGDCGPCSRTSVISCRCSFRTKELPCTSLKSEDATFMCDKRCNKKRLCGRHKCNEICCVDKEHKCPLICGRKLRCGLHRCEEPCHRGNCQTCWQASFDELTCHCGASVIYPPVPCGTRPPECTQTCARVHECDHPVYHSCHSEEKCPPCTFLTQKWCMGKHEFRSNIPCHLVDISCGLPCSATLPCGMHKCQRLCHKGECLVDEPCKQPCTTPRADCGHPCMAPCHTSSPCPVTACKAKVELQCECGRRKEMVICSEASSTYQRIAAISMASKITDMQLGGSVEISKLITKKEVHQARLECDEECSALERKKRLAEAFHISEDSDPFNIRSSGSKFSDSLKEDARKDLKFVSDVEKEMETLVEAVNKGKNSKKSHSFPPMNRDHRRIIHDLAQVYGLESVSYDSEPKRNVVVTAIRGKSVCPPTTLTGVLEREMQARPPPPIPHHRHQSDKNPGSSNLQKITKEPIIDYFDVQD

SEQ ID NO: 58617 - protein, 911 aa, Homo sapiens
  Payload ID: 11461
  Gene Symbol: NFXL1
  Gene Name: nuclear transcription factor, X-box binding-like 1
  Uniprot ID: Q6ZNB6
  ENSP ID: ENSP00000333113
MEASWRQVAGGRGRSRGRATAAPSGNGVHLRGAGGGREKGSVGAVPSGTSPGGVATTAAAGSRHSPAGSQALQTTAASELMSQKKFEEIKKANQAAARKLVEEQFSSSSEEGDEDFEGKQGKILANTFITYTTQTDGDTRELERTKQYVNEAFQAGAMTCLICIASVKRNQAVWSCSGCFCIFHMPCIQKWAKDSQFLVSSVTDDDFGKKDCPWPCPKCRFEYKRSETPSRYYCYCGKVEDPPLDPWLVPHSCGQVCEREFKPPCGHKCLLLCHPGPCPPCPKMVTTTCYCKKAKPIPRRCSAKEWSCQLPCGQKLLCGQHKCENPCHAGSCQPCPRVSRQKCVCGKKVAERSCASPLWHCDQVCGKTLPCGNHTCEQVCHVGACGECPRSGKRFCPCQKSKFSLPCTEDVPTCGDSCDKVLECGIHRCSQRCHRGPCETCRQEVEKHCRCGKHTKRMPCHKPYLCETKCVKMRDCQKHQCRRKCCPGNCPPCDQNCGRTLGCRNHKCPSVCHRGSCYPCPETVDVKCNCGNTKVTVPCGRERTTRPPKCKEQCSRPPTCHHTSQEKHRCHFGSCPPCHQPCQKVLEKCGHLCPAPCHDQALIKQTGRHQPTGPWEQPSEPAFIQTALPCPPCQVPIPMECLGKHEVSPLPCHAVGPYSCKRVCGRILDCQNHTCMKECHKVTKTDGCTGKNKAGPECLHCEEGCSKSRPLGCLHPCILRCHPGECPPCVQMLRIKCHCKITSLYVECRKITTADVNEKNLLSCCKNQCPKELPCGHRCKEMCHPGECPFNCNQKVKLRCPCKRIKKELQCNKVRENQVSIECDTTCKEMKRKASEIKEAEAKAALEEEKRRQQAELEAFENRLKGRRKKNRKRDEVAVELSLWQKHKYYLISVCGVVVVVFAWYITHDVN

SEQ ID NO: 58618 - protein, 911 aa, Homo sapiens; identical to SEQ ID NO: 58617
  Payload ID: 11461
  Gene Symbol: NFXL1
  Gene Name: nuclear transcription factor, X-box binding-like 1
  Uniprot ID: Q6ZNB6
  ENSP ID: ENSP00000370949

SEQ ID NO: 58619 - protein, 911 aa, Homo sapiens; identical to SEQ ID NO: 58617
  Payload ID: 11461
  Gene Symbol: NFXL1
  Gene Name: nuclear transcription factor, X-box binding-like 1
  Uniprot ID: Q6ZNB6
  ENSP ID: ENSP00000422037

SEQ ID NO: 58620 - protein, 733 aa, Homo sapiens
  Payload ID: 11461
  Gene Symbol: NFXL1
  Gene Name: nuclear transcription factor, X-box binding-like 1
  Uniprot ID: Q6ZNB6
  ENSP ID: ENSP00000425812
MEASWRQVAGGRGRSRGRATAAPSGNGVHLRGAGGGREKGSVGAVPSGTSPGGVATTAAAGSRHSPAGSQALQTTAASELMSQKKFEEIKKANQAAARKLVEEQFSSSSEEGDEDFEGKQGKILANTFITYTTQTDGDTRELERTKQYVNEAFQAGAMTCLICIASVKRNQAVWSCSGCFCIFHMPCIQKWAKDSQFLVSSVTDDDFGKKDCPWPCPKCRFEYKRSETPSRYYCYCGKVEDPPLDPWLVPHSCGQVCEREFKPPCGHKCLLLCHPGPCPPCPKMVTTTCYCKKAKPIPRRCSAKEWSCQLPCGQKLLCGQHKCENPCHAGSCQPCPRVSRQKCVCGKKVAERSCASPLWHCDQVCGKTLPCGNHTCEQVCHVGACGECPRSGKRFCPCQKSKFSLPCTEDVPTCGDSCDKVLECGIHRCSQRCHRGPCETCRQEVEKHCRCGKHTKRMPCHKPYLCETKCVKMRDCQKHQCRRKCCPGNCPPCDQNCGRTLGCRNHKCPSVCHRGSCYPCPETVDVKCNCGNTKVTVPCGRERTTRPPKCKEQCSRPPTCHHTSQEKHRCHFGSCPPCHQPCQKVLEKCGHLCPAPCHDQALIKQTGRHQPTGPWEQPSEPAFIQTALPCPPCQVPIPMECLGKHEVSPLPCHAVGPYSCKRVCGRILDCQNHTCMKECHKVTKTDGCTGKNKIGKLKLCDLSMILQQESSKSESTVPDLLTPSPMCSSTHVI

SEQ ID NO: 58621 - protein, 127 aa, Homo sapiens
  Payload ID: 11462
  Gene Symbol: NUTF2
  Gene Name: nuclear transport factor 2
  Uniprot ID: P61970
  ENSP ID: ENSP00000219169
MGDKPIWEQIGSSFIQHYYQLFDNDRTQLGAIYIDASCLTWEGQQFQGKAAIVEKLSSLPFQKIQHSITAQDHQPTPDSCIISMVVGQLKADEDPIMGFHQMFLLKNINDAWVCTNDMFRLALHNFG

SEQ ID NO: 58622 - protein, 107 aa, Homo sapiens
  Payload ID: 11462
  Gene Symbol: NUTF2
  Gene Name: nuclear transport factor 2
  ENSP ID: ENSP00000456428
MGDKPIWEQIGSSFIQHYYQLFDNDRTQLGAIYIDASCLTWEGQQFQGKAAIVEKLSSLPFQKIQHSITAQDHQPTPDSCIISMVVGQLKADEDPIMGFHQMFLLKN

SEQ ID NO: 58623 - protein, 127 aa, Homo sapiens; identical to SEQ ID NO: 58621
  Payload ID: 11462
  Gene Symbol: NUTF2
  Gene Name: nuclear transport factor 2
  Uniprot ID: P61970
  ENSP ID: ENSP00000457022

SEQ ID NO: 58624 - protein, 127 aa, Homo sapiens; identical to SEQ ID NO: 58621
  Payload ID: 11462
  Gene Symbol: NUTF2
  Gene Name: nuclear transport factor 2
  Uniprot ID: P61970
  ENSP ID: ENSP00000457989

SEQ ID NO: 58625 - protein, 140 aa, Homo sapiens
  Payload ID: 11463
  Gene Symbol: NXT1
  Gene Name: nuclear transport factor 2-like export factor 1
  Uniprot ID: Q9UKK6
  ENSP ID: ENSP00000254998
MASVDFKTYVDQACRAAEEFVNVYYTTMDKRRRLLSRLYMGTATLVWNGNAVSGQESLSEFFEMLPSSEFQISVVDCQPVHDEATPSQTTVLVVICGSVKFEGNKQRDFNQNFILTAQASPSNTVWKIASDCFRFQDWAS

SEQ ID NO: 58626 - protein, 197 aa, Homo sapiens
  Payload ID: 11464
  Gene Symbol: NXT2
  Gene Name: nuclear transport factor 2-like export factor 2
  Uniprot ID: Q9NPJ8
  ENSP ID: ENSP00000218004
MRKYRSHWSQGDREGYQRRSNYYEGPHTSHSSPADRTREEVVTPTLPEHTATRSQMATSLDFKTYVDQACRAAEEFVNIYYETMDKRRRALTRLYLDKATLIWNGNAVSGLDALNNFFDTLPSSEFQVNMLDCQPVHEQATQSQTTVLVVTSGTVKFDGNKQHFFNQNFLLTAQSTPNNTVWKIASDCFRFQDWSSS

SEQ ID NO: 58627 - protein, 114 aa, Homo sapiens
  Payload ID: 11464
  Gene Symbol: NXT2
  Gene Name: nuclear transport factor 2-like export factor 2
  Uniprot ID: Q9NPJ8
  ENSP ID: ENSP00000361175
MDKRRRALTRLYLDKATLIWNGNAVSGLDALNNFFDTLPSSEFQVNMLDCQPVHEQATQSQTTVLVVTSGTVKFDGNKQHFFNQNFLLTAQSTPNNTVWKIASDCFRFQDWSSS

SEQ ID NO: 58628 - protein, 142 aa, Homo sapiens
  Payload ID: 11464
  Gene Symbol: NXT2
  Gene Name: nuclear transport factor 2-like export factor 2
  Uniprot ID: Q9NPJ8
  ENSP ID: ENSP00000361178
MATSLDFKTYVDQACRAAEEFVNIYYETMDKRRRALTRLYLDKATLIWNGNAVSGLDALNNFFDTLPSSEFQVNMLDCQPVHEQATQSQTTVLVVTSGTVKFDGNKQHFFNQNFLLTAQSTPNNTVWKIASDCFRFQDWSSS

SEQ ID NO: 58629 - protein, 114 aa, Homo sapiens; identical to SEQ ID NO: 58627
  Payload ID: 11464
  Gene Symbol: NXT2
  Gene Name: nuclear transport factor 2-like export factor 2
  Uniprot ID: Q9NPJ8
  ENSP ID: ENSP00000361179

SEQ ID NO: 58630 - protein, 856 aa, Homo sapiens
  Payload ID: 11465
  Gene Symbol: NVL
  Gene Name: nuclear VCP-like
  Uniprot ID: O15381
  ENSP ID: ENSP00000281701
MKPRPAGFVDNKLKQRVIQYLTSNKCGKYVDIGVLASDLQRVYSIDYGRRKRNAFRIQVEKVFSIISSEKELKNLTELEDEHLAKRARQGEEDNEYTESYSDDDSSMEDYPDPQSANHMNSSLLSLYRKGNPDSVSNTPEMEQRETTSSTPRISSKTGSIPLKTPAKDSEGGWFIDKTPSVKKDSFFLDLSCEKSNPKKPITEIQDSKDSSLLESDMKRKGKLKNKGSKRKKEDLQEVDGEIEAVLQKKAKARGLEFQISNVKFEDVGGNDMTLKEVCKMLIHMRHPEVYHHLGVVPPRGVLLHGPPGCGKTLLAHAIAGELDLPILKVAAPEIVSGVSGESEQKLRELFEQAVSNAPCIIFIDEIDAITPKREVASKDMERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDRETGASVRVVNQLLTEMDGLEARQQVFIMAATNRPDIIDPAILRPGRLDKTLFVGLPPPADRLAILKTITKNGTKPPLDADVNLEAIAGDLRCDCYTGADLSALVREASICALRQEMARQKSGNEKGELKVSHKHFEEAFKKVRSSISKKDQIMYERLQESLSR

SEQ ID NO: 58631 - protein, 667 aa, Homo sapiens
  Payload ID: 11465
  Gene Symbol: NVL
  Gene Name: nuclear VCP-like
  Uniprot ID: O15381
  ENSP ID: ENSP00000341362
MKRKGKLKNKGSKRKKEDLQEVDGEIEAVLQKKAKARGLEFQISNVKFEDVGGNDMTLKEVCKMLIHMRHPEVYHHLGVVPPRGVLLHGPPGCGKTLLAHAIAGAECSGMITAHCSFDFSGSNDPPASASQELDLPILKVAAPEIVSGVSGESEQKLRELFEQAVSNAPCIIFIDEIDAITPKREVASKDMERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDRETGASVRVVNQLLTEMDGLEARQQVFIMAATNRPDIIDPAILRPGRLDKTLFVGLPPPADRLAILKTITKNGTKPPLDADVNLEAIAGDLRCDCYTGADLSALVREASICALRQEMARQKSGNEKGELKVSHKHFEEAFKKVRSSISKKDQIMYERLQESLSR

SEQ ID NO: 58632 - protein, 750 aa, Homo sapiens
  Payload ID: 11465
  Gene Symbol: NVL
  Gene Name: nuclear VCP-like
  Uniprot ID: O15381
  ENSP ID: ENSP00000375747
MEDYPDPQSANHMNSSLLSLYRKGNPDSVSNTPEMEQRETTSSTPRISSKTGSIPLKTPAKDSEGGWFIDKTPSVKKDSFFLDLSCEKSNPKKPITEIQDSKDSSLLESDMKRKGKLKNKGSKRKKEDLQEVDGEIEAVLQKKAKARGLEFQISNVKFEDVGGNDMTLKEVCKMLIHMRHPEVYHHLGVVPPRGVLLHGPPGCGKTLLAHAIAGELDLPILKVAAPEIVSGVSGESEQKLRELFEQAVSNAPCIIFIDEIDAITPKREVASKDMERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDRETGASVRVVNQLLTEMDGLEARQQVFIMAATNRPDIIDPAILRPGRLDKTLFVGLPPPADRLAILKTITKNGTKPPLDADVNLEAIAGDLRCDCYTGADLSALVREASICALRQEMARQKSGNEKGELKVSHKHFEEAFKKVRSSISKKDQIMYERLQESLSR

SEQ ID NO: 58633 - protein, 171 aa, Homo sapiens
  Payload ID: 11465
  Gene Symbol: NVL
  Gene Name: nuclear VCP-like
  ENSP ID: ENSP00000394884
MAYRSLDVPGPSDPPTAASQVAGITGNPDSVSNTPEMEQRETTSSTPRISSKTGSIPLKTPAKDSEGGWFIDKTPSVKKDSFFLDLSCEKSNPKKPITEIQDSKDSSLLESDMKRKGKLKNKGSKRKKEDLQEVDGEIEAVLQKKAKARGLEFQISNVKFEDVGGNDMTLK

SEQ ID NO: 58634 - protein, 667 aa, Homo sapiens; identical to SEQ ID NO: 58631
  Payload ID: 11465
  Gene Symbol: NVL
  Gene Name: nuclear VCP-like
  Uniprot ID: O15381
  ENSP ID: ENSP00000417213

SEQ ID NO: 58635 - protein, 765 aa, Homo sapiens
  Payload ID: 11465
  Gene Symbol: NVL
  Gene Name: nuclear VCP-like
  Uniprot ID: O15381
  ENSP ID: ENSP00000417826
MKPRPAGFVDNKLKQRVIQYLTSNKCGKYVDIGVLASDLQRVYSIDYGRRKRNAFRIQVEKVFSIISSEKELKNLTELEDEHLAKRARQGEEDNEYTESYSDDDSSMEDYPDPQDSKDSSLLESDMKRKGKLKNKGSKRKKEDLQEVDGEIEAVLQKKAKARGLEFQISNVKFEDVGGNDMTLKEVCKMLIHMRHPEVYHHLGVVPPRGVLLHGPPGCGKTLLAHAIAGELDLPILKVAAPEIVSGVSGESEQKLRELFEQAVSNAPCIIFIDEIDAITPKREVASKDMERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDRETGASVRVVNQLLTEMDGLEARQQVFIMAATNRPDIIDPAILRPGRLDKTLFVGLPPPADRLAILKTITKNGTKPPLDADVNLEAIAGDLRCDCYTGADLSALVREASICALRQEMARQKSGNEKGELKVSHKHFEEAFKKVRSSISKKDQIMYERLQESLSR

SEQ ID NO: 58636 - protein, 175 aa, Homo sapiens
  Payload ID: 11465
  Gene Symbol: NVL
  Gene Name: nuclear VCP-like
  ENSP ID: ENSP00000418085
MKPRPAGFVDNKLKQRVIQYLTSNKCGKYVDIGVLASDLQRVYSIDYGRRKRNAFRIQVEKVFSIISSEKELKNLTELEDEHLAKRARQGEEDNDVSLCHPGFSALAQSWLTAVLTSQAQAILPPQPHRYTESYSDDDSSMEDYPDPQSANHMNSSLLSLYRKGNPDSVSNTPEM

SEQ ID NO: 58637 - protein, 180 aa, Homo sapiens
  Payload ID: 11465
  Gene Symbol: NVL
  Gene Name: nuclear VCP-like
  ENSP ID: ENSP00000418380
MKPRPAGFVDNKLKQRVIQSANHMNSSLLSLYRKGNPDSVSNTPEMEQRETTSSTPRISSKTGSIPLKTPAKDSEGGWFIDKTPSVKKDSFFLDLSCEKSNPKKPITEIQDSKDSSLLESDMKRKGKLKNKGSKRKKEDLQEVDGEIEAVLQKKAKARGLEFQISNVKFEDVGGNDMTLK

SEQ ID NO: 58638 - protein, 659 aa, Homo sapiens
  Payload ID: 11465
  Gene Symbol: NVL
  Gene Name: nuclear VCP-like
  Uniprot ID: O15381
  ENSP ID: ENSP00000419420
MEDYPDPQDSKDSSLLESDMKRKGKLKNKGSKRKKEDLQEVDGEIEAVLQKKAKARGLEFQISNVKFEDVGGNDMTLKEVCKMLIHMRHPEVYHHLGVVPPRGVLLHGPPGCGKTLLAHAIAGELDLPILKVAAPEIVSGVSGESEQKLRELFEQAVSNAPCIIFIDEIDAITPKREVASKDMERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDRETGASVRVVNQLLTEMDGLEARQQVFIMAATNRPDIIDPAILRPGRLDKTLFVGLPPPADRLAILKTITKNGTKPPLDADVNLEAIAGDLRCDCYTGADLSALVREASICALRQEMARQKSGNEKGELKVSHKHFEEAFKKVRSSISKKDQIMYERLQESLSR

SEQ ID NO: 58639 - protein, 53 aa, Homo sapiens
  Payload ID: 11465
  Gene Symbol: NVL
  Gene Name: nuclear VCP-like
  ENSP ID: ENSP00000419586
MKPRPAGFVDNKLKQRVIQYLTSNKCGKYVDIGVLASDLQRVYRLWSKKKKCF

SEQ ID NO: 58640 - protein, 184 aa, Homo sapiens
  Payload ID: 11465
  Gene Symbol: NVL
  Gene Name: nuclear VCP-like
  ENSP ID: ENSP00000419828
MKPRPAGFVDNKLKQRVIQYLTSNKCGKYVDIGVLASDLQRVYSIDYGRRKRNAFRIQVEKVFSIISSEKELKNLTELEDEHLAKRARQGEEDNEYTESYSDDDSSMEDYPDPQDSKDSSLLESDMKRKGKLKNKGSKRKKEDLQEVDGEIEAVLQKKAKARGLEFQISNVKFEDVGGNDMTLK

SEQ ID NO: 58641 - protein, 296 aa, Homo sapiens
  Payload ID: 11465
  Gene Symbol: NVL
  Gene Name: nuclear VCP-like
  ENSP ID: ENSP00000419930
MKPRPAGFVDNKLKQRVIQYLTSNKCGKYVDIGVLASDLQRVYSIDYGRRKRNAFRIQVEKVFSIISSEKELKNLTELEDEHLAKRARQGEEDNEYTESYSDDDSSMEDYPDPQSANHMNSSLLSLYRKGNPDSVSNTPEMEQRETTSSTPRISSKTGSIPLKTPAKDSEGGWFIDKTPSVKKDSFFLDLSCEKSNPKKPITEIQDSKDSSLLESDMKRKGKLKNKGSKRKKEDLQEVDGEIEAVLQKKGGLQDAHTHASPGGVPPPGRRAPSWSSPSWTTRLWEDITCTCNCWGT

SEQ ID NO: 58642 - protein, 48 aa, Homo sapiens
  Payload ID: 11465
  Gene Symbol: NVL
  Gene Name: nuclear VCP-like
  ENSP ID: ENSP00000479235
  MOD_RES (1)..(1): Any amino acid
XGADLSALVREASICALRQEMARQKSGNEKVETGFHHVSQDGLDLLTS

SEQ ID NO: 58643 - protein, 134 aa, Homo sapiens
  Payload ID: 11466
  Gene Symbol: NABP1
  Gene Name: nucleic acid binding protein 1
  Uniprot ID: Q96AH0
  ENSP ID: ENSP00000307968
MNRVNDPLIFIRDIKPGLKNLNVVFIVLEIGRVTKTKDGHEVRSCKVADKTGSITISVWDEIGGLIQPGDIIRLTRGYASMWKGCLTLYTGRGGELQKIGDLGAVQAAAMRDSIHYYPGNDLHPDLEEPSSLGV

SEQ ID NO: 58644 - protein, 54 aa, Homo sapiens
  Payload ID: 11466
  Gene Symbol: NABP1
  Gene Name: nucleic acid binding protein 1
  ENSP ID: ENSP00000310819
MWKGCLTLYTGRGGELQKIGDLGAVQAAAMRDSIHYYPGNDLHPDLEEPSSLGV

SEQ ID NO: 58645 - protein, 124 aa, Homo sapiens
  Payload ID: 11466
  Gene Symbol: NABP1
  Gene Name: nucleic acid binding protein 1
  Uniprot ID: Q96AH0
  ENSP ID: ENSP00000386605
MWKGCLTLYTGRGGELQKIGEFCMVYSEVPNFSEPNPDYRGQQNKGAQSEQKNNSMNSNMGTGTFGPVGNGVHTGPESREHQFSHAGRSNGRGLINPQLQGTASNQTVMTTISNGRDPRRAFKR

SEQ ID NO: 58646 - protein, 124 aa, Homo sapiens; identical to SEQ ID NO: 58645
  Payload ID: 11466
  Gene Symbol: NABP1
  Gene Name: nucleic acid binding protein 1
  Uniprot ID: Q96AH0
  ENSP ID: ENSP00000387243

SEQ ID NO: 58647 - protein, 134 aa, Homo sapiens; identical to SEQ ID NO: 58643
  Payload ID: 11466
  Gene Symbol: NABP1
  Gene Name: nucleic acid binding protein 1
  Uniprot ID: Q96AH0
  ENSP ID: ENSP00000390901

SEQ ID NO: 58648 - protein, 168 aa, Homo sapiens
  Payload ID: 11466
  Gene Symbol: NABP1
  Gene Name: nucleic acid binding protein 1
  ENSP ID: ENSP00000397041
  MOD_RES (1)..(1): Any amino acid
XRVTKTKDGHEVRSCKVADKTGSITISVWDEIGGLIQPGDIIRLTRGYASMWKGCLTLYTGRGGELQKIGEFCMVYSEVPNFSEPNPDYRGQQNKGAQSEQKNNSMNSNMGTGNGVHTGPESREHQFSHAGRSNGRGLINPQLQGTASNQTVMTTISNGRDPRRAFKR

SEQ ID NO: 58649 - protein, 204 aa, Homo sapiens
  Payload ID: 11466
  Gene Symbol: NABP1
  Gene Name: nucleic acid binding protein 1
  Uniprot ID: Q96AH0
  ENSP ID: ENSP00000403683
MNRVNDPLIFIRDIKPGLKNLNVVFIVLEIGRVTKTKDGHEVRSCKVADKTGSITISVWDEIGGLIQPGDIIRLTRGYASMWKGCLTLYTGRGGELQKIGEFCMVYSEVPNFSEPNPDYRGQQNKGAQSEQKNNSMNSNMGTGTFGPVGNGVHTGPESREHQFSHAGRSNGRGLINPQLQGTASNQTVMTTISNGRDPRRAFKR

SEQ ID NO: 58650 - protein, 211 aa, Homo sapiens
  Payload ID: 11467
  Gene Symbol: NABP2
  Gene Name: nucleic acid binding protein 2
  Uniprot ID: Q9BQ15
  ENSP ID: ENSP00000267023
MTTETFVKDIKPGLKNLNLIFIVLETGRVTKTKDGHEVRTCKVADKTGSINISVWDDVGNLIQPGDIIRLTKGYASVFKGCLTLYTGRGGDLQKIGEFCMVYSEVPNFSEPNPEYSTQQAPNKAVQNDSNPSASQPTTGPSAASPASENQNGNGLSAPPGPGGGPHPPHTPSHPPSTRITRSQPNHTPAGPPGPSSNPVSNGKETRRSSKR

SEQ ID NO: 58651 - protein, 211 aa, Homo sapiens; identical to SEQ ID NO: 58650
  Payload ID: 11467
  Gene Symbol: NABP2
  Gene Name: nucleic acid binding protein 2
  Uniprot ID: Q9BQ15
  ENSP ID: ENSP00000368862

SEQ ID NO: 58652 - protein, 211 aa, Homo sapiens; identical to SEQ ID NO: 58650
  Payload ID: 11467
  Gene Symbol: NABP2
  Gene Name: nucleic acid binding protein 2
  Uniprot ID: Q9BQ15
  ENSP ID: ENSP00000369545

SEQ ID NO: 58653 - protein, 151 aa, Homo sapiens
  Payload ID: 11467
  Gene Symbol: NABP2
  Gene Name: nucleic acid binding protein 2
  ENSP ID: ENSP00000408616
MTTETFVKDIKPGLKNLNLIFIVLETGRVTKTKDGHEVRTCKVADKTGSINISVWDDVGNLIQPGDIIRLTKGYASVFKGCLTLYTGRGGDLQKIGEFCMVYSEVPNFSEPNPEYSTQQAPNKAVQNDSNPSASQPTTGPSAASPASENQN

SEQ ID NO: 58654 - protein, 144 aa, Homo sapiens
  Payload ID: 11467
  Gene Symbol: NABP2
  Gene Name: nucleic acid binding protein 2
  ENSP ID: ENSP00000413902
MTTETFVKDIKPGLKNLNLIFIVLETGRVTKTKDGHEVRTCKVADKTGSINISVWDDVGNLIQPGDIIRLTKGYASVFKGCLTLYTGRGGDLQKIGEFCMVYSEVPNFSEPNPEYSTQQAPNKAVQNDSNPSASQPTTGPSAAS

SEQ ID NO: 58655 - protein, 461 aa, Homo sapiens
  Payload ID: 11468
  Gene Symbol: NUCB1
  Gene Name: nucleobindin 1
  Uniprot ID: Q02818
  ENSP ID: ENSP00000385211
MPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSRLRMLLKAKMDAEQDPNVQVDHLNLLKQFEHLDPQNQHTFEARDLELLIQTATRDLAQYDAAHHEEFKRYEMLKEHERRRYLESLGEEQRKEAERKLEEQQRRHREHPKVNVPGSQAQLKEVWEELDGLDPNRFNPKTFFILHDINSDGVLDEQELEALFTKELEKVYDPKNEEDDMREMEEERLRMREHVMKNVDTNQDRLVTLEEFLASTQRKEFGDTGEGWETVEMHPAYTEEELRRFEEELAAREAELNAKAQRLSQETEALGRSQGRLEAQKRELQQAVLHMEQRKQQQQQQQGHKAPAAHPEGQLKFHPDTDDVPVPAPAGDQKEVDTSEKKLLERLPEVEVPQHL

SEQ ID NO: 58656 - protein, 461 aa, Homo sapiens; identical to SEQ ID NO: 58655
  Payload ID: 11468
  Gene Symbol: NUCB1
  Gene Name: nucleobindin 1
  Uniprot ID: Q02818
  ENSP ID: ENSP00000385923

SEQ ID NO: 58657 - protein, 267 aa, Homo sapiens
  Payload ID: 11468
  Gene Symbol: NUCB1
  Gene Name: nucleobindin 1
  ENSP ID: ENSP00000389007
MPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSRLRMLLKAKMDAEQDPNVQVDHLNLLKQFEHLDPQNQHTFEARDLELLIQTATRDLAQYDAAHHEEFKRYEMLKEHERRRYLESLGEEQRKEAERKLEEQQRRHREHPKVNVPGSQAQLKEVWEELDGLDPNRDLTHPVLGPLRYLAILFPSDINSDG

SEQ ID NO: 58658 - protein, 295 aa, Homo sapiens
  Payload ID: 11468
  Gene Symbol: NUCB1
  Gene Name: nucleobindin 1
  ENSP ID: ENSP00000389734
  MOD_RES (1)..(1): Any amino acid
XPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEFEHLDPQNQHTFEARDLELLIQTATRDLAQYDAAHHEEFKRYEMLKEHERRRYLESLGEEQRKEAERKLEEQQRRHREHPKVNVPGSQAQLKEVWEELDGLDPNRFNPKTFFILHDINSDGVLDEQELEALFTKELEKVYDPKNEEDDMREMEEERLRMREHVMKNVDTNQDRLVTLEEFLASTQRKE

SEQ ID NO: 58659 - protein, 110 aa, Homo sapiens
  Payload ID: 11468
  Gene Symbol: NUCB1
  Gene Name: nucleobindin 1
  ENSP ID: ENSP00000397201
MPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSR

SEQ ID NO: 58660 - protein, 75 aa, Homo sapiens
  Payload ID: 11468
  Gene Symbol: NUCB1
  Gene Name: nucleobindin 1
  ENSP ID: ENSP00000397608
MPPSGPRGTLLLLPLLLLLLLRAVLAVPLERGAPNKEETPATESPVSGPALLSSQVFAVVLQLLQTPVPVGRMLQ

SEQ ID NO: 58661 - protein, 124 aa, Homo sapiens
  Payload ID: 11468
  Gene Symbol: NUCB1
  Gene Name: nucleobindin 1
  ENSP ID: ENSP00000410519
MPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSRLRMLLKAKMDAEQD

SEQ ID NO: 58662 - protein, 420 aa, Homo sapiens
  Payload ID: 11469
  Gene Symbol: NUCB2
  Gene Name: nucleobindin 2
  ENSP ID: ENSP00000320168
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNEVDTNKDRLVTLEEFLKATEKKEFLEPDSWETLDQQQFFTEEELKEYENIIALQENELKKKADELQKQKEELQRQHDQLEAQKLEYHQVIQQMEQKKLQQGIPPSGPAGELKFEPRV

SEQ ID NO: 58663 - protein, 390 aa, Homo sapiens
  Payload ID: 11469
  Gene Symbol: NUCB2
  Gene Name: nucleobindin 2
  ENSP ID: ENSP00000408702
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNETLDQQQFFTEEELKEYENIIALQENELKKKADELQKQKEELQRQHDQLEAQKLEYHQVIQQMEQKKLQQGIPPSGPAGELKFEPHI

SEQ ID NO: 58664 - protein, 33 aa, Homo sapiens
  Payload ID: 11469
  Gene Symbol: NUCB2
  Gene Name: nucleobindin 2
  ENSP ID: ENSP00000431136
MRWRTILLQYCFLLITCLLTALEAVPIDIDKTK

SEQ ID NO: 58665 - protein, 34 aa, Homo sapiens
  Payload ID: 11469
  Gene Symbol: NUCB2
  Gene Name: nucleobindin 2
  ENSP ID: ENSP00000431328
MRWRTILLQYCFLLITCLLTALEAVPIDIDKTKV

SEQ ID NO: 58666 - protein, 195 aa, Homo sapiens
  Payload ID: 11469
  Gene Symbol: NUCB2
  Gene Name: nucleobindin 2
  ENSP ID: ENSP00000431334
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTL

SEQ ID NO: 58667 - protein, 73 aa, Homo sapiens
  Payload ID: 11469
  Gene Symbol: NUCB2
  Gene Name: nucleobindin 2
  ENSP ID: ENSP00000432741
  MOD_RES (1)..(1): Any amino acid
XEERLRMREHVMNEVDTNKDRLVTLEEFLKATEKKEFLEPDSWEVIQQMEQKKLQQGIPPSGPAGELKFEPHI

SEQ ID NO: 58668 - protein, 90 aa, Homo sapiens
  Payload ID: 11469
  Gene Symbol: NUCB2
  Gene Name: nucleobindin 2
  ENSP ID: ENSP00000433194
MRWRTILLQYCFLLITCLLTALEAVPIDIDKTKVQNIHPVESAKIEPPDTGLYYDEYLKQVIDVLETDKHFREKLQKADIEEIKSGRLSK

SEQ ID NO: 58669 - protein, 338 aa, Homo sapiens
  Payload ID: 11469
  Gene Symbol: NUCB2
  Gene Name: nucleobindin 2
  ENSP ID: ENSP00000433542
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNEVDTNKDRLVTLEEFLKATEKKEFLEPDSWESPSI

SEQ ID NO: 58670 - protein, 198 aa, Homo sapiens
  Payload ID: 11469
  Gene Symbol: NUCB2
  Gene Name: nucleobindin 2
  ENSP ID: ENSP00000435160
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEE

SEQ ID NO: 58671 - protein, 69 aa, Homo sapiens
  Payload ID: 11469
  Gene Symbol: NUCB2
  Gene Name: nucleobindin 2
  ENSP ID: ENSP00000435558
MRWRTILLQYCFLLITCLLTALEAVPIDIDKTKVQNIHPVESAKIEPPDTGLYYDEYLKQVIDVLETDK

SEQ ID NO: 58672 - protein, 198 aa, Homo sapiens
  Payload ID: 11469
  Gene Symbol: NUCB2
  Gene Name: nucleobindin 2
  ENSP ID: ENSP00000435787
  MOD_RES (1)..(1): Any amino acid
XTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNETLDQQQFFTEEELKEYENIIALQENELKKKADELQKQKEELQRQHDQLEAQKLEYHQVIQQMEQKKLQQGIPPSGPAGELKFEPHI

SEQ ID NO: 58673 - protein, 39 aa, Homo sapiens
  Payload ID: 11469
  Gene Symbol: NUCB2
  Gene Name: nucleobindin 2
  ENSP ID: ENSP00000435968
MRWRTILLQYCFLLITCLLTALEAVPIDIDKTKVQNIHP

SEQ ID NO: 58674 - protein, 69 aa, Homo sapiens; identical to SEQ ID NO: 58671
  Payload ID: 11469
  Gene Symbol: NUCB2
  Gene Name: nucleobindin 2
  ENSP ID: ENSP00000436215

SEQ ID NO: 58675 - protein, 420 aa, Homo sapiens
  Payload ID: 11469
  Gene Symbol: NUCB2
  Gene Name: nucleobindin 2
  ENSP ID: ENSP00000436455
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMNEVDTNKDRLVTLEEFLKATEKKEFLEPDSWETLDQQQFFTEEELKEYENIIALQENELKKKADELQKQKEELQRQHDQLEAQKLEYHQVIQQMEQKKLQQGIPPSGPAGELKFEPHI

SEQ ID NO: 58676 - protein, 420 aa, Homo sapiens; identical to SEQ ID NO: 58675
  Payload ID: 11469
  Gene Symbol: NUCB2
  Gene Name: nucleobindin 2
  ENSP ID: ENSP00000481959

SEQ ID NO: 58677 - protein, 708 aa, Homo sapiens
  Payload ID: 11470
  Gene Symbol: NOLC1
  Gene Name: nucleolar and coiled-body phosphoprotein 1
  ENSP ID: ENSP00000359024
  MOD_RES (1)..(1): Any amino acid
XDAGIRRVVPSDLYPLVLGFLRDNQLSEVANKFAKATGATQQDANASSLLDIYSFWLKSAKVPERKLQANGPVAKKAKKKASSSDSEDSSEEEEEVQGPPAKKAAVPAKRVGLPPGKAAAKASESSSSEESSDDDDEEDQKKQPVQKGVKPQAKAAKAPPKKAKSSDSDSDSSSEDEPPKNQKPKITPVTVKAQTKAPPKPARAAPKIANGKAASSSSSSSSSSSSDDSEEEKAAATPKKVWTITSVRAETVPKKQVVAKAPVKAATTPTRKSSSSEDSSSDEEEEQKKPMKNKPGPYSSVPPPSAPPPKKSLGTQPPKKAVEKQQPVESSEDSSDESDSSSEEEKKPPTKAVVSKATTKPPPAKKAAESSSDSSDSDSSEDDEAPSKPAGTTKNSSNKPAVTTKSPAVKPAAAPKQPVGGGQKLLTRKADSSSSEEESSSSEEEKTKKMVATTKPKATAKAALSLPAKQAPQGSRDSSSDSDSSSSEEEEEKTSKSAVKKKPQKVAGGAAPSKPASAKKGKAESSNSSSSDDSSEEEEEKLKGKGSPRPQAPKANGTSALTAQNGKAAKNSEEEEEEKKKAAVVVSKSGSLKKRKQNEAAKEAETPQAKKIKLQTPNTFPKRKKGEKRASSPFRRVREEEIEVDSRVADNSFDAKRGAAGDWGERANQVLKFTKGKSFRHEKTKKKRGSYRGGSISVQVNSIKFDSE

SEQ ID NO: 58678 - protein, 709 aa, Homo sapiens
  Payload ID: 11470
  Gene Symbol: NOLC1
  Gene Name: nucleolar and coiled-body phosphoprotein 1
  Uniprot ID: Q14978
  ENSP ID: ENSP00000385410
MADAGIRRVVPSDLYPLVLGFLRDNQLSEVANKFAKATGATQQDANASSLLDIYSFWLKSAKVPERKLQANGPVAKKAKKKASSSDSEDSSEEEEEVQGPPAKKAAVPAKRVGLPPGKAAAKASESSSSEESSDDDDEEDQKKQPVQKGVKPQAKAAKAPPKKAKSSDSDSDSSSEDEPPKNQKPKITPVTVKAQTKAPPKPARAAPKIANGKAASSSSSSSSSSSSDDSEEEKAAATPKKVWTITSVRAETVPKKQVVAKAPVKAATTPTRKSSSSEDSSSDEEEEQKKPMKNKPGPYSSVPPPSAPPPKKSLGTQPPKKAVEKQQPVESSEDSSDESDSSSEEEKKPPTKAVVSKATTKPPPAKKAAESSSDSSDSDSSEDDEAPSKPAGTTKNSSNKPAVTTKSPAVKPAAAPKQPVGGGQKLLTRKADSSSSEEESSSSEEEKTKKMVATTKPKATAKAALSLPAKQAPQGSRDSSSDSDSSSSEEEEEKTSKSAVKKKPQKVAGGAAPSKPASAKKGKAESSNSSSSDDSSEEEEEKLKGKGSPRPQAPKANGTSALTAQNGKAAKNSEEEEEEKKKAAVVVSKSGSLKKRKQNEAAKEAETPQAKKIKLQTPNTFPKRKKGEKRASSPFRRVREEEIEVDSRVADNSFDAKRGAAGDWGERANQVLKFTKGKSFRHEKTKKKRGSYRGGSISVQVNSIKFDSE

SEQ ID NO: 58679 - protein, 73 aa, Homo sapiens
  Payload ID: 11470
  Gene Symbol: NOLC1
  Gene Name: nucleolar and coiled-body phosphoprotein 1
  ENSP ID: ENSP00000473910
MADAGIRRVVPSDLYPLVLGFLRDNQLSEVANKFAKATGATQQDANASSLLDIYSFWLNRSASWEGCSQSIRE

SEQ ID NO: 58680 - protein, 258 aa, Homo sapiens
  Payload ID: 11470
  Gene Symbol: NOLC1
  Gene Name: nucleolar and coiled-body phosphoprotein 1
  ENSP ID: ENSP00000473927
MADAGIRRVVPSDLYPLVLGFLRDNQLSEVANKFAKATGAKGVKPQAKAAKAPPKKAKSSDSDSDSSSEDEPPKNQKPKITPVTVKAQTKAPPKPARAAPKIANGKAASSSSSSSSSSSSDDSEEEKAAATPKKTVPKKQVVAKAPVKAATTPTRKSSSSEDSSSDEEEEQKKPMKNKPGPYSSVPPPSAPPPKKSLGTQPPKKAVEKQQPVESSEDSSDESDSDSSEDDEAPSKPAGTTKNSSNKPAVTTKSPAVKP

SEQ ID NO: 58681 - protein, 281 aa, Homo sapiens
  Payload ID: 11470
  Gene Symbol: NOLC1
  Gene Name: nucleolar and coiled-body phosphoprotein 1
  ENSP ID: ENSP00000474140
  MOD_RES (1)..(1): Any amino acid
XRTPAFAAWFPATCIPSCSASCAITNSQRWPISSPKRQELSAKVPERKLQANGPVAKKAKKKASSSDSEDSSEEEEEVQGPPAKKAAVPAKRVGLPPGKAAAKASESSSSEESSDDDDEEDQKKQPVQKGVKPQAKAAKAPPKKAKSSDSDSDSSSEDEPPKNQKPKITPVTVKAQTKAPPKPARAAPKIANGKAASSSSSSSSSSSSDDSEEEKAAATPKKTVPKKQVVAKAPVKAATTPTRKSSSSEDSSSDEEEEQKKPMKNKPGPYSSVPPPSAPPP

SEQ ID NO: 58682 - protein, 699 aa, Homo sapiens
  Payload ID: 11470
  Gene Symbol: NOLC1
  Gene Name: nucleolar and coiled-body phosphoprotein 1
  Uniprot ID: Q14978
  ENSP ID: ENSP00000474710
MADAGIRRVVPSDLYPLVLGFLRDNQLSEVANKFAKATGATQQDANASSLLDIYSFWLKSAKVPERKLQANGPVAKKAKKKASSSDSEDSSEEEEEVQGPPAKKAAVPAKRVGLPPGKAAAKASESSSSEESSDDDDEEDQKKQPVQKGVKPQAKAAKAPPKKAKSSDSDSDSSSEDEPPKNQKPKITPVTVKAQTKAPPKPARAAPKIANGKAASSSSSSSSSSSSDDSEEEKAAATPKKTVPKKQVVAKAPVKAATTPTRKSSSSEDSSSDEEEEQKKPMKNKPGPYSSVPPPSAPPPKKSLGTQPPKKAVEKQQPVESSEDSSDESDSSSEEEKKPPTKAVVSKATTKPPPAKKAAESSSDSSDSDSSEDDEAPSKPAGTTKNSSNKPAVTTKSPAVKPAAAPKQPVGGGQKLLTRKADSSSSEEESSSSEEEKTKKMVATTKPKATAKAALSLPAKQAPQGSRDSSSDSDSSSSEEEEEKTSKSAVKKKPQKVAGGAAPSKPASAKKGKAESSNSSSSDDSSEEEEEKLKGKGSPRPQAPKANGTSALTAQNGKAAKNSEEEEEEKKKAAVVVSKSGSLKKRKQNEAAKEAETPQAKKIKLQTPNTFPKRKKGEKRASSPFRRVREEEIEVDSRVADNSFDAKRGAAGDWGERANQVLKFTKGKSFRHEKTKKKRGSYRGGSISVQVNSIKFDSE

SEQ ID NO: 58683 - protein, 46 aa, Homo sapiens
  Payload ID: 11470
  Gene Symbol: NOLC1
  Gene Name: nucleolar and coiled-body phosphoprotein 1
  ENSP ID: ENSP00000474924
MADAGIRRVVPSDLYPLVLGFLRDNQLSEVANKFAKATGALEQHLK

SEQ ID NO: 58684 - protein, 700 aa, Homo sapiens
  Payload ID: 11470
  Gene Symbol: NOLC1
  Gene Name: nucleolar and coiled-body phosphoprotein 1
  Uniprot ID: Q14978
  ENSP ID: ENSP00000475080
MADAGIRRVVPSDLYPLVLGFLRDNQLSEVANKFAKATGATQQDANASSLLDIYSFWLNRSAKVPERKLQANGPVAKKAKKKASSSDSEDSSEEEEEVQGPPAKKAAVPAKRVGLPPGKAAAKASESSSSEESSDDDDEEDQKKQPVQKGVKPQAKAAKAPPKKAKSSDSDSDSSSEDEPPKNQKPKITPVTVKAQTKAPPKPARAAPKIANGKAASSSSSSSSSSSSDDSEEEKAAATPKKTVPKKQVVAKAPVKAATTPTRKSSSSEDSSSDEEEEQKKPMKNKPGPYSSVPPPSAPPPKKSLGTQPPKKAVEKQQPVESSEDSSDESDSSSEEEKKPPTKAVVSKATTKPPPAKKAAESSSDSSDSDSSEDDEAPSKPAGTTKNSSNKPAVTTKSPAVKPAAAPKQPVGGGQKLLTRKADSSSSEEESSSSEEEKTKKMVATTKPKATAKAALSLPAKQAPQGSRDSSSDSDSSSSEEEEEKTSKSAVKKKPQKVAGGAAPSKPASAKKGKAESSNSSSSDDSSEEEEEKLKGKGSPRPQAPKANGTSALTAQNGKAAKNSEEEEEEKKKAAVVVSKSGSLKKRKQNEAAKEAETPQAKKIKLQTPNTFPKRKKGEKRASSPFRRVREEEIEVDSRVADNSFDAKRGAAGDWGERANQVLKFTKGKSFRHEKTKKKRGSYRGGSISVQVNSIKFDSE

SEQ ID NO: 58685 - protein, 426 aa, Homo sapiens
  Payload ID: 11471
  Gene Symbol: NUSAP1
  Gene Name: nucleolar and spindle associated protein 1
  Uniprot ID: Q9BXS6
  ENSP ID: ENSP00000260359
MIIPSLEELDSLKYSDLQNLAKSLGLRANLRATKLLKALKGYIKHEARKGNENQDESQTSASSCDETEIQISNQEEAERQPLGHVTKTRRRCKTVRVDPDSQNHEKQESQDLRATAKVPSPPDEHQEAENAVSSGNRDSKVPSEGKKSLYTDESSKPGKNKRTAITTPNFKKLHEAHFKEMESIDQYIERKKKHFEEHNSMNELKQQPINKGGVRTPVPPRGRLSVASTPISQRRSQGRSCGPASQSTLGLKGSLKRSAISAAKTGVRFSAATKDNEHKRSLTKTPARKSAHVTVSGGTPKGEAVLGTHKLKTITGNSAAVITPFKLTTEATQTPVSNKKPVFDLKASLSRPLNYEPHKGKLKPWGQSKENNYLNQHVNRINFYKKTYKQPHLQTKEEQRKKREQERKEKKAKVLGMRRGLILAED

SEQ ID NO: 58686 - protein, 440 aa, Homo sapiens
  Payload ID: 11471
  Gene Symbol: NUSAP1
  Gene Name: nucleolar and spindle associated protein 1
  Uniprot ID: Q9BXS6
  ENSP ID: ENSP00000400746
MIIPSLEELDSLKYSDLQNLAKSLGLRANLRATKLLKALKGYIKHEARKGNENQDESQTSASSCDETEIQISNQEEAERQPLGHVTKTRRRCKTVRVDPDSQQNHSEIKISNPTEFQNHEKQESQDLRATAKVPSPPDEHQEAENAVSSGNRDSKVPSEGKKSLYTDESSKPGKNKRTAITTPNFKKLHEAHFKEMESIDQYIERKKKHFEEHNSMNELKQPINKGGVRTPVPPRGRLSVASTPISQRRSQGRSCGPASQSTLGLKGSLKRSAISAAKTGVRFSAATKDNEHKRSLTKTPARKSAHVTVSGGTPKGEAVLGTHKLKTITGNSAAVITPFKLTTEATQTPVSNKKPVFDLKASLSRPLNYEPHKGKLKPWGQSKENNYLNQHVNRINFYKKTYKQPHLQTKEEQRKKREQERKEKKAKVLGMRRGLILAED

SEQ ID NO: 58687 - protein, 378 aa, Homo sapiens
  Payload ID: 11471
  Gene Symbol: NUSAP1
  Gene Name: nucleolar and spindle associated protein 1
  Uniprot ID: Q9BXS6
  ENSP ID: ENSP00000401014
MIIPSLEELDSLKYSDLQNLAKSLGLRANLRDESQTSASSCDETEIQISNQEEAERQPLGHVTKTRRRCKTVRVDPDSQQNHSEIKISNPTEFQNHEKQESQDLRATAKVPSPPDEHQEAENAVSSGNRDSKVPSEGKKSLYTDESSKPGKNKRTAITTPNFKKLHEAHFKEMESIDQYIERKKKHFEEHNSMNELKQPINKGGVRTPVPPRGRLSVASTPISQRRSQGRSCGPASQSTLGLKGSLKRSAISAAKTGVRFSAATKDNEHKRSLTKTPARKSAHVTVSGGTPKGEAVLGTHKLKTITGNSAAGKLKPWGQSKENNYLNQHVNRINFYKKTYKQPHLQTKEEQRKKREQERKEKKAKVLGMRRGLILAED

SEQ ID NO: 58688 - protein, 76 aa, Homo sapiens
  Payload ID: 11471
  Gene Symbol: NUSAP1
  Gene Name: nucleolar and spindle associated protein 1
  ENSP ID: ENSP00000452725
MIIPSLEELDSLKYSDLQNLAKSLGLRANLRATKLLKALKGYIKHEARKGNENQFHSCCPGWSAMTRSRLTATSTS

SEQ ID NO: 58689 - protein, 441 aa, Homo sapiens
  Payload ID: 11471
  Gene Symbol: NUSAP1
  Gene Name: nucleolar and spindle associated protein 1
  Uniprot ID: Q9BXS6
  ENSP ID: ENSP00000453403
MIIPSLEELDSLKYSDLQNLAKSLGLRANLRATKLLKALKGYIKHEARKGNENQDESQTSASSCDETEIQISNQEEAERQPLGHVTKTRRRCKTVRVDPDSQQNHSEIKISNPTEFQNHEKQESQDLRATAKVPSPPDEHQEAENAVSSGNRDSKVPSEGKKSLYTDESSKPGKNKRTAITTPNFKKLHEAHFKEMESIDQYIERKKKHFEEHNSMNELKQQPINKGGVRTPVPPRGRLSVASTPISQRRSQGRSCGPASQSTLGLKGSLKRSAISAAKTGVRFSAATKDNEHKRSLTKTPARKSAHVTVSGGTPKGEAVLGTHKLKTITGNSAAVITPFKLTTEATQTPVSNKKPVFDLKASLSRPLNYEPHKGKLKPWGQSKENNYLNQHVNRINFYKKTYKQPHLQTKEEQRKKREQERKEKKAKVLGMRRGLILAED

SEQ ID NO: 58690 - protein, 68 aa, Homo sapiens
  Payload ID: 11471
  Gene Symbol: NUSAP1
  Gene Name: nucleolar and spindle associated protein 1
  ENSP ID: ENSP00000453428
  MOD_RES (1)..(1): Any amino acid
XLKALKGYIKHEARKGNENQDSSTSKRKTLCGFYSHQPTTLARPVLWPCKSEYLGSEGVTQALCYLCS

SEQ ID NO: 58691 - protein, 144 aa, Homo sapiens
  Payload ID: 11471
  Gene Symbol: NUSAP1
  Gene Name: nucleolar and spindle associated protein 1
  ENSP ID: ENSP00000453558
QEAENAVSSGNRDSKVPSEGKKSLYTDESSKPGKNKRTAITTPNFKKLHEAHFKEMESIDQYIERKKKHFEEHNSMNELKQPINKGGVRTPVPPRGRLSVASTPISQRRSQGRSCGPASQSTLGLKGSLKRSAISAAKTGVRFK

SEQ ID NO: 58692 - protein, 440 aa, Homo sapiens
  Payload ID: 11471
  Gene Symbol: NUSAP1
  Gene Name: nucleolar and spindle associated protein 1
  Uniprot ID: Q9BXS6
  ENSP ID: ENSP00000453657
MIIPSLEELDSLKYSDLQNLAKSLGLRANLRATKLLKALKGYIKHEARKGNENQDESQTSASSCDETEIQISNQEEAERQPLGHVTKTRRRCKTVRVDPDSQNHSEIKISNPTEFQNHEKQESQDLRATAKVPSPPDEHQEAENAVSSGNRDSKVPSEGKKSLYTDESSKPGKNKRTAITTPNFKKLHEAHFKEMESIDQYIERKKKHFEEHNSMNELKQQPINKGGVRTPVPPRGRLSVASTPISQRRSQGRSCGPASQSTLGLKGSLKRSAISAAKTGVRFSAATKDNEHKRSLTKTPARKSAHVTVSGGTPKGEAVLGTHKLKTITGNSAAVITPFKLTTEATQTPVSNKKPVFDLKASLSRPLNYEPHKGKLKPWGQSKENNYLNQHVNRINFYKKTYKQPHLQTKEEQRKKREQERKEKKAKVLGMRRGLILAED

SEQ ID NO: 58693 - protein, 439 aa, Homo sapiens
  Payload ID: 11471
  Gene Symbol: NUSAP1
  Gene Name: nucleolar and spindle associated protein 1
  Uniprot ID: Q9BXS6
  ENSP ID: ENSP00000454097
MIIPSLEELDSLKYSDLQNLAKSLGLRANLRATKLLKALKGYIKHEARKGNENQDESQTSASSCDETEIQISNQEEAERQPLGHVTKTRRRCKTVRVDPDSQNHSEIKISNPTEFQNHEKQESQDLRATAKVPSPPDEHQEAENAVSSGNRDSKVPSEGKKSLYTDESSKPGKNKRTAITTPNFKKLHEAHFKEMESIDQYIERKKKHFEEHNSMNELKQPINKGGVRTPVPPRGRLSVASTPISQRRSQGRSCGPASQSTLGLKGSLKRSAISAAKTGVRFSAATKDNEHKRSLTKTPARKSAHVTVSGGTPKGEAVLGTHKLKTITGNSAAVITPFKLTTEATQTPVSNKKPVFDLKASLSRPLNYEPHKGKLKPWGQSKENNYLNQHVNRINFYKKTYKQPHLQTKEEQRKKREQERKEKKAKVLGMRRGLILAED

SEQ ID NO: 58694 - protein, 516 aa, Homo sapiens
  Payload ID: 11472
  Gene Symbol: NOC4L
  Gene Name: nucleolar complex associated 4 homolog
  Uniprot ID: Q9BVI4
  ENSP ID: ENSP00000328854
MEREPGAAGVRRALGRRLEAVLASRSEANAVFDILAVLQSEDQEEIQEAVRTCSRLFGALLERGELFVGQLPSEEMVMTGSQGATRKYKVWMRHRYHSCCNRLGELLGHPSFQVKELALSALLKFVQLEGAHPLEKSKWEGNYLFPRELFKLVVGGLLSPEEDQSLLLSQFREYLDYDDTRYHTMQAAVDAVARVTGQHPEVPPAFWNNAFTLLSAVSLPRREPTVSSFYVKRAELWDTWKVAHLKEHRRVFQAMWLSFLKHKLPLSLYKKVLLIVHDAILPQLAQPTLMIDFLTRACDLGGALSLLALNGLFILIHKHNLEYPDFYRKLYGLLDPSVFHVKYRARFFHLADLFLSSSHLPAYLVAAFAKRLARLALTAPPEALLMVLPFICNLLRRHPACRVLVHRPHGPELDADPYDPGEEDPAQSRALESSLWELQALQRHYHPEVSKAASVINQALSMPEVSIAPLLELTAYEIFERDLKKKGPEPVPLEFIPAQGLLGRPGELCAQHFTLS

SEQ ID NO: 58695 - protein, 270 aa, Homo sapiens
  Payload ID: 11472
  Gene Symbol: NOC4L
  Gene Name: nucleolar complex associated 4 homolog
  ENSP ID: ENSP00000438255
MVMTGSQGATRKYKVWMRHRYHSCCNRLGELLGHPSFQVKTLLIRGIIRYVASSTHRRVRSSFSLWLSSSASYSTARIVQPLELALSALLKFVQLEGAHPLEKSKWEGNYLFPRELFKLVVGGLLSPEEDQSLLLSQFREYLDYDDTRYHTMQAAVDAVARVTGQHPEVPPAFWNNAFTLLSAVSLPRREPTVSSFYVKRAELWDTWKVAHLKEHRRVFQAMWLSFLKHKLPLSLYKKVLLIVHDAILPQLAQPTLMIDFLTRACDLGEC

SEQ ID NO: 58696 - protein, 638 aa, Homo sapiens
  Payload ID: 11473
  Gene Symbol: NOL10
  Gene Name: nucleolar protein 10
  Uniprot ID: Q9BSC4
  ENSP ID: ENSP00000263837
MQVSSLNEVKIYSLSCGKSLPEWLSDRKKRALQKKDVDVRRRIELIQDFEMPTVCTTIKVSKDGQYILATGTYKPRVRCYDTYQLSLKFERCLDSEVVTFEILSDDYSKIVFLHNDRYIEFHSQSGFYYKTRIPKFGRDFSYHYPSCDLYFVGASSEVYRLNLEQGRYLNPLQTDAAENNVCDINSVHGLFATGTIEGRVECWDPRTRNRVGLLDCALNSVTADSEINSLPTISALKFNGALTMAVGTTTGQGKIFTSLEPEHDLNDVCLYPNSGMLLTANETPKMGIYYIPVLGPAPRWCSFLDNLTEELEENPESTVYDDYKFVTKKDLENLGLTHLIGSPFLRAYMHGFFMDIRLYHKVKLMVNPFAYEEYRKDKIRQKIEETRAQRVQLKKLPKVNKELALKLIEEEEEKQKSTWKKKVKSLPNILTDDRFKVMFENPDFQVDEESEEFRLLNPLVSKISEKRKKKLRLLEQQELREKEEEEEPEGKPSDAESSESSDDEKAWVEEVRKQRRLLQQEEKVKRQERLKEDQQTVLKPQFYEIKAGEEFRSFKDSATKQKLMNKTLEDRLKIEAKNGTLSVSDTTVGSKQLTFTLKRSEQQKKQQEAEKLHRQERKRLRRSAGHLKSRHKRGRSFH

SEQ ID NO: 58697 - protein, 688 aa, Homo sapiens
  Payload ID: 11473
  Gene Symbol: NOL10
  Gene Name: nucleolar protein 10
  Uniprot ID: Q9BSC4
  ENSP ID: ENSP00000371101
MQVSSLNEVKIYSLSCGKSLPEWLSDRKKRALQKKDVDVRRRIELIQDFEMPTVCTTIKVSKDGQYILATGTYKPRVRCYDTYQLSLKFERCLDSEVVTFEILSDDYSKIVFLHNDRYIEFHSQSGFYYKTRIPKFGRDFSYHYPSCDLYFVGASSEVYRLNLEQGRYLNPLQTDAAENNVCDINSVHGLFATGTIEGRVECWDPRTRNRVGLLDCALNSVTADSEINSLPTISALKFNGALTMAVGTTTGQVLLYDLRSDKPLLVKDHQYGLPIKSVHFQDSLDLILSADSRIVKMWNKNSGKIFTSLEPEHDLNDVCLYPNSGMLLTANETPKMGIYYIPVLGPAPRWCSFLDNLTEELEENPESTVYDDYKFVTKKDLENLGLTHLIGSPFLRAYMHGFFMDIRLYHKVKLMVNPFAYEEYRKDKIRQKIEETRAQRVQLKKLPKVNKELALKLIEEEEEKQKSTWKKKVKSLPNILTDDRFKVMFENPDFQVDEESEEFRLLNPLVSKISEKRKKKLRLLEQQELREKEEEEEPEGKPSDAESSESSDDEKAWVEEVRKQRRLLQQEEKVKRQERLKEDQQTVLKPQFYEIKAGEEFRSFKDSATKQKLMNKTLEDRLKIEAKNGTLSVSDTTVGSKQLTFTLKRSEQQKKQQEAEKLHRQERKRLRRSAGHLKSRHKRGRSFH

SEQ ID NO: 58698 - protein, 252 aa, Homo sapiens
  Payload ID: 11473
  Gene Symbol: NOL10
  Gene Name: nucleolar protein 10
  ENSP ID: ENSP00000403170
IVFLHNDRYIEFHSQSGFYYKTRIPKFGRDFSYHYPSCDLYFVGASSEVYRLNLEQGRYLNPLQTDAAENNVCDINSVHGLFATGTIEGRVECWDPRTRNRVGLLDCALNSVTADSEINSLPTISALKFNGALTMAVGTTTGQVLLYDLRSDKPLLVKDHQYGLPIKSVHFQDSLDLILSADSRIVKMWNKNSGKIFTSLEPEHDLNDVCLYPNSGMLLTANETPKMGIYYIPFSKPVLSSSLNQSLPPAFL

SEQ ID NO: 58699 - protein, 662 aa, Homo sapiens
  Payload ID: 11473
  Gene Symbol: NOL10
  Gene Name: nucleolar protein 10
  Uniprot ID: Q9BSC4
  ENSP ID: ENSP00000439663
MQVSSLNEVKIYSLSCGKSLPEWLSDRKKRALQKKDVDVRRRIELIQDFEMPTVCTTIKVSKDGQYILATVVTFEILSDDYSKIVFLHNDRYIEFHSQSGFYYKTRIPKFGRDFSYHYPSCDLYFVGASSEVYRLNLEQGRYLNPLQTDAAENNVCDINSVHGLFATGTIEGRVECWDPRTRNRVGLLDCALNSVTADSEINSLPTISALKFNGALTMAVGTTTGQVLLYDLRSDKPLLVKDHQYGLPIKSVHFQDSLDLILSADSRIVKMWNKNSGKIFTSLEPEHDLNDVCLYPNSGMLLTANETPKMGIYYIPVLGPAPRWCSFLDNLTEELEENPESTVYDDYKFVTKKDLENLGLTHLIGSPFLRAYMHGFFMDIRLYHKVKLMVNPFAYEEYRKDKIRQKIEETRAQRVQLKKLPKVNKELALKLIEEEEEKQKSTWKKKVKSLPNILTDDRFKVMFENPDFQVDEESEEFRLLNPLVSKISEKRKKKLRLLEQQELREKEEEEEPEGKPSDAESSESSDDEKAWVEEVRKQRRLLQQEEKVKRQERLKEDQQTVLKPQFYEIKAGEEFRSFKDSATKQKLMNKTLEDRLKIEAKNGTLSVSDTTVGSKQLTFTLKRSEQQKKQQEAEKLHRQERKRLRRSAGHLKSRHKRGRSFH

SEQ ID NO: 58700 - protein, 719 aa, Homo sapiens
  Payload ID: 11474
  Gene Symbol: NOL11
  Gene Name: nucleolar protein 11
  Uniprot ID: Q9H8H0
  ENSP ID: ENSP00000253247
MAALEEEFTLSSVVLSAGPEGLLGVEQSDKTDQFLVTDSGRTVILYKVSDQKPLGSWSVKQGQIITCPAVCNFQTGEYVVVHDNKVLRIWNNEDVNLDKVFKATLSAEVYRILSVQGTEPLVLFKEGAVRGLEALLADPQQKIETVISDEEVIKWTKFFVVFRHPVLIFITEKHGNYFAYVQMFNSRILTKYTLLLGQDENSVIKSFTASVDRKFISLMSLSSDGCIYETLIPIRPADPEKNQSLVKSLLLKAVVSGNARNGVALTALDQDHVAVLGSPLAASKECLSVWNIKFQTLQTSKELPQGTSGQLWYYGEHLFMLHGKSLTVIPYKCEVSSLAGALGKLKHSQDPGTHVVSHFVNWETPQGCGLGFQNSEQSRRILRRRKIEVSLQPEVPPSKQLLSTIMKDSEKHIEVEVRKFLALKQTPDFHTVIGDTVTGLLERCKAEPSFYPRNCLMQLIQTHVLSYSLCPDLMEIALKKKDVQLLQLCLQQFPDIPESVTCACLKIFLSIGDDSLQETDVNMESVFDYSINSVHDEKMEEQTEILQNGFNPEEDKCNNCDQELNKKPQDETKESTSCPVVQKRAALLNAILHSAYSETFLLPHLKDIPAQHITLFLKYLYFLYLKCSENATMTLPGIHPPTLNQIMDWICLLLDANFTVVVMMPEAKRLLINLYKLVKSQISVYSELNKIEVSFRELQKLNQEKNNRGLYSIEVLELF

SEQ ID NO: 58701 - protein, 169 aa, Homo sapiens
  Payload ID: 11474
  Gene Symbol: NOL11
  Gene Name: nucleolar protein 11
  Uniprot ID: Q9H8H0
  ENSP ID: ENSP00000463219
MAALEEEFTLSSVVLSAGPEGLLGVEQSDKTDQFLVTDSGRTVILYKVSDQKPLGSWSVKQGQIITCPAVCNFQTGEYVVVHDNKVLRIWNNEDVNLDKVFKATLSAEVYRILSVQGTEPLVLFKEGAVRGLEALLADPQQKIETVISDEEVINMEITLLTCKCLTHVS

SEQ ID NO: 58702 - protein, 85 aa, Homo sapiens
  Payload ID: 11474
  Gene Symbol: NOL11
  Gene Name: nucleolar protein 11
  ENSP ID: ENSP00000463248
  MOD_RES (1)..(1): Any amino acid
XSENATMTLPGIHPPTLNQIMDWICLLLDANFTVVVMMPEAKRLLINLYKLVKSQARTVFCLRPSQCQEKRVSEYLDHHLTDAPG

SEQ ID NO: 58703 - protein, 189 aa, Homo sapiens
  Payload ID: 11474
  Gene Symbol: NOL11
  Gene Name: nucleolar protein 11
  ENSP ID: ENSP00000463662
MAALEEEFTLSSVVLSAGPEGLLGVEQSDKTDQFLVTDSGRTVILYKRFGRTRWFTPVIPELREAQVSDQKPLGSWSVKQGQIITCPAVCNFQTGEYVVVHDNKVLRIWNNEDVNLDKVFKATLSAEVYRILSVQGTEPLVLFKEGAVRGLEALLADPQQKIETVISDEEVIKWTKFFVVFRHPVLIFI

SEQ ID NO: 58704 - protein, 271 aa, Homo sapiens
  Payload ID: 11474
  Gene Symbol: NOL11
  Gene Name: nucleolar protein 11
  ENSP ID: ENSP00000464015
VRGLEALLADPQQKIETVISDEEVIKWTKFFVVFRHPVLIFITEKHGNYFAYVQMFNSRILTKYTLLLGQDENSVIKSFTASVDRKFISLMSLSSDGCIYETLIPIRPADPEKNQSLVKSLLLKAVVSGNARNGVALTALDQDHVAVLGSPLAASKGTHVVSHFVNWETPQGCGLGFQNSEQSRRILRRRKIEVSLQPEVPPSKQLLSTIMKDSEKHIEVEVRKFLALKQTPDFHTVIGDTVTGLLERCKAEPSFYPRNCLMQLIQTHVLS

SEQ ID NO: 58705 - protein, 213 aa, Homo sapiens
  Payload ID: 11475
  Gene Symbol: NOL12
  Gene Name: nucleolar protein 12
  Uniprot ID: Q9UGY1
  ENSP ID: ENSP00000352021
MGRNKKKKRDGDDRRPRLVLSFDEEKRREYLTGFHKRKVERKKAAIEEIKQRLKEEQRKLREERHQEYLKMLAEREEALEEADELDRLVTAKTESVQYDHPNHTVTVTTISDLDLSGARLLGLTPPEGGAGDRSEEEASSTEKPTKALPRKSRDPLLSQRISSLTASLHAHSRKKVKRKHPRRAQDSKKPPRAPRTSKAQRRRLTGKARHSGE

SEQ ID NO: 58706 - protein, 213 aa, Homo sapiens; identical to SEQ ID NO: 58705
  Payload ID: 11475
  Gene Symbol: NOL12
  Gene Name: nucleolar protein 12
  Uniprot ID: Q9UGY1
  ENSP ID: ENSP00000403059

SEQ ID NO: 58707 - protein, 213 aa, Homo sapiens; identical to SEQ ID NO: 58705
  Payload ID: 11475
  Gene Symbol: NOL12
  Gene Name: nucleolar protein 12
  Uniprot ID: Q9UGY1
  ENSP ID: ENSP00000482349

SEQ ID NO: 58708 - protein, 208 aa, Homo sapiens
  Payload ID: 11476
  Gene Symbol: NOL3
  Gene Name: nucleolar protein 3 (apoptosis repressor with CARD domain)
  Uniprot ID: O60936
  ENSP ID: ENSP00000268605
MGNAQERPSETIDRERKRLVETLQADSGLLLDALLARGVLTGPEYEALDALPDAERRVRRLLLLVQGKGEAACQELLRCAQRTAGAPDPAWDWQHVGPGYRDRSYDPPCPGHWTPEAPGSGTTCPGLPRASDPDEAGGPEGSEAVQSGTPEEPEPELEAEASKEAEPEPEPEPELEPEAEAEPEPELEPEPDPEPEPDFEERDESEDS

SEQ ID NO: 58709 - protein, 138 aa, Homo sapiens
  Payload ID: 11476
  Gene Symbol: NOL3
  Gene Name: nucleolar protein 3 (apoptosis repressor with CARD domain)
  ENSP ID: ENSP00000454256
MGNAQERPSETIDRERKRLVETLQADSGLLLDALLARGVLTGPEYEALDALPDAERRVRRLLLLVQGKGEAACQELLRCAQRTAGAPDPAWDWQHVGPGYRDRSYDPPCPGHWTPEAPGSGTTCPGLPRASDPDEAGG

SEQ ID NO: 58710 - protein, 219 aa, Homo sapiens
  Payload ID: 11476
  Gene Symbol: NOL3
  Gene Name: nucleolar protein 3 (apoptosis repressor with CARD domain)
  Uniprot ID: O60936
  ENSP ID: ENSP00000454598
MGNAQERPSETIDRERKRLVETLQADSGLLLDALLARGVLTGPEYEALDALPDAERRVRRLLLLVQGKGEAACQELLRCAQRTAGAPDPAWDWQHATGTAAMTLHAQATGRRRHPARGPHAPGCPELQTLTRPGALRAPRRCNPGPRRSQSQSWKLRPLKRLNRSRSQSQSWNPRLKQNQSRNWSQNRTQSPSPTSRKGTSPKIPEGQSSDRRCPAHAG

SEQ ID NO: 58711 - protein, 216 aa, Homo sapiens
  Payload ID: 11476
  Gene Symbol: NOL3
  Gene Name: nucleolar protein 3 (apoptosis repressor with CARD domain)
  ENSP ID: ENSP00000455808
  MOD_RES (1)..(1): Any amino acid
XGQSVWRGRRTPSSPCWPPGPVLAEPSGGWDRAPTMGNAQERPSETIDRERKRLVETLQADSGLLLDALLARGVLTGPEYEALDALPDAERRATGTAAMTLHAQATGRRRHPARGPHAPGCPELQTLTRPGALRAPRRCNPGPRRSQSQSWKLRPLKRLNRSRSQSQSWNPRLKQNQSRNWSQNRTQSPSPTSRKGTSPKIPEGQSSDRRCPAHAG

SEQ ID NO: 58712 - protein, 270 aa, Homo sapiens
  Payload ID: 11476
  Gene Symbol: NOL3
  Gene Name: nucleolar protein 3 (apoptosis repressor with CARD domain)
  Uniprot ID: O60936
  ENSP ID: ENSP00000457243
MPVLGKAGEERRATADAWGQKEEPEEETGQSVWRGRRTPSSPCWPPGPVLAEPSGGWDRAPTMGNAQERPSETIDRERKRLVETLQADSGLLLDALLARGVLTGPEYEALDALPDAERRVRRLLLLVQGKGEAACQELLRCAQRTAGAPDPAWDWQHVGPGYRDRSYDPPCPGHWTPEAPGSGTTCPGLPRASDPDEAGGPEGSEAVQSGTPEEPEPELEAEASKEAEPEPEPEPELEPEAEAEPEPELEPEPDPEPEPDFEERDESEDS

SEQ ID NO: 58713 - protein, 206 aa, Homo sapiens
  Payload ID: 11476
  Gene Symbol: NOL3
  Gene Name: nucleolar protein 3 (apoptosis repressor with CARD domain)
  ENSP ID: ENSP00000457720
MGNAQERPSETIDRERKRLVETLQADSGLLLDALLARGVLTGPEYEALDALPDAERRVRRLLLLVQGKGEAACQELLRCAQRTAGAPDPAWDWQHVGPGYRDRSYDPPCPGHWTPEAPGSGTTCPGLPRASDPDEAGGPEGSEAVQSGTPEEPEPELEAEASKEAEPEPEPEPELEPEAEAEPEPELEPEPDPEPEPDFEERDESE

SEQ ID NO: 58714 - protein, 174 aa, Homo sapiens
  Payload ID: 11476
  Gene Symbol: NOL3
  Gene Name: nucleolar protein 3 (apoptosis repressor with CARD domain)
  ENSP ID: ENSP00000457732
MGNAQERPSETIDRERKRLVETLQADSGLLLDALLARGVLTGPEYEALDALPDAERRVRRLLLLVQGKGEAACQELLRCAQRTAGAPDPAWDWQHVGPGYRDRSYDPPCPGHWTPEAPGSGTTCPGLPRASDPDEAGGPEGSEAVQSGTPEEPEPELEAEASKEAEPEPEPEPE

SEQ ID NO: 58715 - protein, 106 aa, Homo sapiens
  Payload ID: 11476
  Gene Symbol: NOL3
  Gene Name: nucleolar protein 3 (apoptosis repressor with CARD domain)
  ENSP ID: ENSP00000463685
  MOD_RES (1)..(1): Any amino acid
XSWNPRLKQNQSRNWSQNRTQSPSPTSRKGTSPKVFLKARALTGGAPPMLDRTWDAAGAESDATKARSSPVPLEVNKLRRVGRDLGSLHDSGCLPRNLGWVPLSPR

SEQ ID NO: 58716 - protein, 131 aa, Homo sapiens
  Payload ID: 11476
  Gene Symbol: NOL3
  Gene Name: nucleolar protein 3 (apoptosis repressor with CARD domain)
  ENSP ID: ENSP00000463698
  MOD_RES (1)..(1): Any amino acid
XSSPCWPPGPVLAEPSGGWDRGYRDRSYDPPCPGHWTPEAPGSGTTCPGLPRASDPDEAGGPEGSEAVQSGTPEEPEPELEAEASKEAEPEPEPEPELEPEAEAEPEPELEPEPDPEPEPDFEERDESEDS

SEQ ID NO: 58717 - protein, 638 aa, Homo sapiens
  Payload ID: 11477
  Gene Symbol: NOL4
  Gene Name: nucleolar protein 4
  Uniprot ID: O94818
  ENSP ID: ENSP00000261592
MESERDMYRQFQDWCLRTYGDSGKTKTVTRKKYERIVQLLNGSESSSTDNAKFKFWVKSKGFQLGQPDEVRGGGGGAKQVLYVPVKTTDGVGVDEKLSLRRVAVVEDFFDIIYSMHVETGPNGEQIRKHAGQKRTYKAISESYAFLPREAVTRFLMSCSECQKRMHLNPDGTDHKDNGKPPTLVTSMIDYNMPITMAYMKHMKLQLLNSQQDEDESSIESDEFDMSDSTRMSAVNSDLSSNLEERMQSPQNLHGQQDDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNMFVRLFVDENLDRMVPISKQPKEKIQAIIDSCRRQFPEYQERARKRIRTYLKSCRRMKRSGFEMSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 58718 - protein, 564 aa, Homo sapiens
  Payload ID: 11477
  Gene Symbol: NOL4
  Gene Name: nucleolar protein 4
  Uniprot ID: O94818
  ENSP ID: ENSP00000443472
MADLMQETFLHHATDGVGVDEKLSLRRVAVVEDFFDIIYSMHVETGPNGEQIRKHAGQKRTYKAISESYAFLPREAVTRFLMSCSECQKRMHLNPDGTDHKDNGKPPTLVTSMIDYNMPITMAYMKHMKLQLLNSQQDEDESSIESDEFDMSDSTRMSAVNSDLSSNLEERMQSPQNLHGQQDDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNMFVRLFVDENLDRMVPISKQPKEKIQAIIDSCRRQFPEYQERARKRIRTYLKSCRRMKRSGFEMSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 58719 - protein, 353 aa, Homo sapiens
  Payload ID: 11477
  Gene Symbol: NOL4
  Gene Name: nucleolar protein 4
  Uniprot ID: O94818
  ENSP ID: ENSP00000445733
MGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNMFVRLFVDENLDRMVPISKQPKEKIQAIIDSCRRQFPEYQERARKRIRTYLKSCRRMKRSGFEMSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 58720 - protein, 69 aa, Homo sapiens
  Payload ID: 11477
  Gene Symbol: NOL4
  Gene Name: nucleolar protein 4
  ENSP ID: ENSP00000464704
MADLMQETFLHHATDGVGVDEKLSLRRVAVVEDFFDIIYSMHVETGPNGEQIRKHAGQKRTYKAIQKNV

SEQ ID NO: 58721 - protein, 24 aa, Homo sapiens
  Payload ID: 11477
  Gene Symbol: NOL4
  Gene Name: nucleolar protein 4
  ENSP ID: ENSP00000464790
MADLMQETFLHHATGYTTIYPFTC

SEQ ID NO: 58722 - protein, 536 aa, Homo sapiens
  Payload ID: 11477
  Gene Symbol: NOL4
  Gene Name: nucleolar protein 4
  Uniprot ID: O94818
  ENSP ID: ENSP00000465450
MESERDMYRQFQDWCLRTYGDSGKTKTVTRKKYERIVQLLNGSESSSTDNAKFKFWVKSKGFQLGQPDEVRGGGGGAKQVLYVPVKTTDGVGVDEKLSLRRVAVVEDFFDIIYSMHVETGPNGEQIRKHAGQKRTYKAISESYAFLPREAVTRFLMSCSECQKRMHLNPDGTDHKDNGKPPTLVTSMIDYNMPITMAYMKHMKLQLLNSQQDEDESSIESDEFDMSDSTRMSAVNSDLSSNLEERMQSPQNLHGQQDDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 58723 - protein, 219 aa, Homo sapiens
  Payload ID: 11477
  Gene Symbol: NOL4
  Gene Name: nucleolar protein 4
  ENSP ID: ENSP00000467015
MDQTMLDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNSRPIPSHLTSAVAESILASACESESRNAAKRMRLERQQDESAPADKQCKPEATQATYS

SEQ ID NO: 58724 - protein, 69 aa, Homo sapiens
  Payload ID: 11477
  Gene Symbol: NOL4
  Gene Name: nucleolar protein 4
  ENSP ID: ENSP00000467326
MADLMQETFLHHATDGVGVDEKLSLRRVAVVEDFFDIIYSMHVETGPNGEQIRKHAGQKRTYKAGPREI

SEQ ID NO: 58725 - protein, 558 aa, Homo sapiens
  Payload ID: 11477
  Gene Symbol: NOL4
  Gene Name: nucleolar protein 4
  ENSP ID: ENSP00000467629
RTYGDSGKTKTVTRKKYERIVQLLNGSESSSTDNAKFKFWVKSKGFQLGQPDEVRGGGGGAKQVLYVPVKTTDGVGVDEKLSLRRVAVVEDFFDIIYSMHVETGPNGEQIRKHAGQKRTYKAISESYAFLPREAVTRFLMSCSECQKRMHLNPDGTDHKDNGKPPTLVTSMIDYNMPITMAYMKHMKLQLLNSQQDEDESSIESDEFDMSDSTRMSAVNSDLSSNLEERMQSPQNLHGQQDDDSAAESFNGNETLGHSSIASGGTHSREMGDSNSDGKTGLEQDEQPLNLSDSPLSAQLTSEYRIDDHNSNGKNKYKNLLISDLKMEREARENGSKSPAHSYSSYDSGKNESVDRGAEDLSLNRGDEDEDDHEDHDDSEKVNETDGVEAERLKAFNSRPIPSHLTSAVAESILASACESESRNAAKRMRLERQQDESAPADKQCKPEATQATYSTSAVPGSQDVLYINGNGTYSYHSYRGLGGGLLNLNDASSSGPTDLSMKRQLATSSGSSSSSNSRPQLSPTEINAVRQLVAGYRESAAFLLRSADELENLILQQN

SEQ ID NO: 58726 - protein, 175 aa, Homo sapiens
  Payload ID: 11478
  Gene Symbol: NOL4L
  Gene Name: nucleolar protein 4-like
  ENSP ID: ENSP00000201961
MGQVVYVPVKTGSGADGLSEPEGISLKRVAVVEDFFDIIYSMHVESSAEPGKAPKHAGQKKTYRAIAETYAFLPREAVTRFLMSCTECQKRMHFNSNGLEPKENEPPSPLVSGIIDYNMPLTSTYLKQMKLRVMNSQEQCLPSGAEDIMSGGPTLEAAEFDDLIGKCLPDRPIAE

SEQ ID NO: 58727 - protein, 91 aa, Homo sapiens
  Payload ID: 11478
  Gene Symbol: NOL4L
  Gene Name: nucleolar protein 4-like
  ENSP ID: ENSP00000317413
MSDSTWMSADPHLASSLSPSQDERMRSPQNLHSQEDGPHRLSHLSQGLNIICSLDTSLRARNPRVSAERNDFSFRGRSRCVTSNSLAKDGY

SEQ ID NO: 58728 - protein, 436 aa, Homo sapiens
  Payload ID: 11478
  Gene Symbol: NOL4L
  Gene Name: nucleolar protein 4-like
  Uniprot ID: Q96MY1
  ENSP ID: ENSP00000352704
MSDSTWMSADPHLASSLSPSQDERMRSPQNLHSQEDDDSSSESGSGNGSSTLNPSTSSSTQGDPAFPEMNGNGAVAPMDFTTAAEDQPINLCDKLPPATALGTASYPSDGCGADGLRSRVKYGVKTTPESPPYSSGSYDSIKTEVSGCPEDLTVGRAPTADDDDDDHDDHEDNDKMNDSEGMDPERLKAFNMFVRLFVDENLDRMVPISKQPKEKIQAIIESCSRQFPEFQERARKRIRTYLKSCRRMKKNGMEMTRPTPPHLTSAMAENILAAACESETRKAAKRMRLEIYQSSQDEPIALDKQHSRDSAAITHSTYSLPASSYSQDPVYANGGLNYSYRGYGALSSNLQPPASLQTGNHSNGPTDLSMKGGASTTSTTPTPTPSSTSTSRPVPTAQLSPTEISAVRQLIAGYRESAAFLLRSADELENLILQQN

SEQ ID NO: 58729 - protein, 113 aa, Homo sapiens
  Payload ID: 11478
  Gene Symbol: NOL4L
  Gene Name: nucleolar protein 4-like
  ENSP ID: ENSP00000364829
MKLRVMNSQEQDETSVSSEDFDMSDSTWMSADPHLASSLSPSQDERMRSPQNLHSQEDGPHRLSHLSQGLNIICSLDTSLRARNPRVSAERNDFSFRGRSRCVTSNSLAKDGY

SEQ ID NO: 58730 - protein, 155 aa, Homo sapiens
  Payload ID: 11478
  Gene Symbol: NOL4L
  Gene Name: nucleolar protein 4-like
  ENSP ID: ENSP00000364830
MHVESSAEPGKAPKHAGQKKTYRAIAETYAFLPREAVTRFLMSCTECQKRMHFNSNGLEPKENEPPSPLVSGIIDYNMPLTSTYLKQMKLRVMNSQEQDETSVSSEDFDMSDSTWMSADPHLASSLSPSQDERMRSPQNLHSQEDGGVCLQGPTA

SEQ ID NO: 58731 - protein, 76 aa, Homo sapiens
  Payload ID: 11478
  Gene Symbol: NOL4L
  Gene Name: nucleolar protein 4-like
  ENSP ID: ENSP00000410774
  MOD_RES (1)..(1): Any amino acid
XQKRMHFNSNGLEPKENEPPSPLVSGIIDYNMPLTSTYLKQMKLRVMNSQEQPSSLSPAPGFVNTVITVLICAHEE

SEQ ID NO: 58732 - protein, 400 aa, Homo sapiens [sequence omitted]

SEQ ID NO: 58733 - protein, 680 aa, Homo sapiens
  Payload ID: 11478
  Gene Symbol: NOL4L
  Gene Name: nucleolar protein 4-like
  ENSP ID: ENSP00000483523
MPKPTLLLRGGWERERSPGDSELGRQFRDWCLRTYGDSAKTKTVTRSKYQRIAEVLQGGGGTGAGSGPAAGEKGKFQFWVRSKGFRLGSGREPKMGQVVYVPVKTGSGADGLSEPEGISLKRVAVVEDFFDIIYSMHVESSAEPGKAPKHAGQKKTYRAIAETYAFLPREAVTRFLMSCTECQKRMHFNSNGLEPKENEPPSPLVSGIIDYNMPLTSTYLKQMKLRVMNSQEQDETSVSSEDFDMSDSTWMSADPHLASSLSPSQDERMRSPQNLHSQEDDDSSSESGSGNGSSTLNPSTSSSTQGDPAFPEMNGNGAVAPMDFTTAAEDQPINLCDKLPPATALGTASYPSDGCGADGLRSRVKYGVKTTPESPPYSSGSYDSIKTEVSGCPEDLTVGRAPTADDDDDDHDDHEDNDKMNDSEGMDPERLKAFNMFVRLFVDENLDRMVPISKQPKEKIQAIIESCSRQFPEFQERARKRIRTYLKSCRRMKKNGMEMTRPTPPHLTSAMAENILAAACESETRKAAKRMRLEIYQSSQDEPIALDKQHSRDSAAITHSTYSLPASSYSQDPVYANGGLNYSYRGYGALSSNLQPPASLQTGNHSNGPTDLSMKGGASTTSTTPTPTPSSTSTSRPVPTAQLSPTEISAVRQLIAGYRESAAFLLRSADELENLILQQN

SEQ ID NO: 58734 - protein, 1146 aa, Homo sapiens
  Payload ID: 11479
  Gene Symbol: NOL6
  Gene Name: nucleolar protein 6 (RNA-associated)
  Uniprot ID: Q9H6R4
  ENSP ID: ENSP00000297990
MGPAPAGEQLRGATGEPEVMEPALEGTGKEGKKASSRKRTLAEPPAKGLLQPVKLSRAELYKEPTNEELNRLRETEILFHSSLLRLQVEELLKEVRLSEKKKDRIDAFLREVNQRVVRVPSVPETELTDQAWLPAGVRVPLHQVPYAVKGCFRFLPPAQVTVVGSYLLGTCIRPDINVDVALTMPREILQDKDGLNQRYFRKRALYLAHLAHHLAQDPLFGSVCFSYTNGCHLKPSLLLRPRGKDERLVTVRLHPCPPPDFFRPCRLLPTKNNVRSAWYRGQSPAGDGSPEPPTPRYNTWVLQDTVLESHLQLLSTILSSAQGLKDGVALLKVWLRQRELDKGQGGFTGFLVSMLVVFLVSTRKIHTTMSGYQVLRSVLQFLATTDLTVNGISLCLSSDPSLPALADFHQAFSVVFLDSSGHLNLCADVTASTYHQVQHEARLSMMLLDSRADDGFHLLLMTPKPMIRAFDHVLHLRPLSRLQAACHRLKLWPELQDNGGDYVSAALGPLTTLLEQGLGARLNLLAHSRPPVPEWDISQDPPKHKDSGTLTLGLLLRPEGLTSVLELGPEADQPEAAKFRQFWGSRSELRRFQDGAIREAVVWEAASMSQKRLIPHQVVTHLLALHADIPETCVHYVGGPLDALIQGLKETSSTGEEALVAAVRCYDDLSRLLWGLEGLPLTVSAVQGAHPVLRYTEVFPPTPVRPAFSFYETLRERSSLLPRLDKPCPAYVEPMTVVCHLEGSGQWPQDAEAVQRVRAAFQLRLAELLTQQHGLQCRATATHTDVLKDGFVFRIRVAYQREPQILKEVQSPEGMISLRDTAASLRLERDTRQLPLLTSALHGLQQQHPAFSGVARLAKRWVRAQLLGEGFADESLDLVAAALFLHPEPFTPPSSPQVGFLRFLFLVSTFDWKNNPLFVNLNNELTVEEQVEIRSGFLAARAQLPVMVIVTPQDRKNSVWTQDGPSAQILQQLVVLAAEALPMLEKQLMDPRGPGDIRTVFRPPLDIYDVLIRLSPRHIPRHRQAVDSPAASFCRGLLSQPGPSSLMPVLGYDPPQLYLTQLREAFGDLALFFYDQHGGEVIGVLWKPTSFQPQPFKASSTKGRMVMSRGGELVMVPNVEAILEDFAVLGEGLVQTVEARSERWTV

SEQ ID NO: 58735 - protein, 699 aa, Homo sapiens
  Payload ID: 11479
  Gene Symbol: NOL6
  Gene Name: nucleolar protein 6 (RNA-associated)
  Uniprot ID: Q9H6R4
  ENSP ID: ENSP00000313978
MGPAPAGEQLRGATGEPEVMEPALEGTGKEGKKASSRKRTLAEPPAKGLLQPVKLSRAELYKEPTNEELNRLRETEILFHSSLLRLQVEELLKEVRLSEKKKDRIDAFLREVNQRVVRVPSVPETELTDQAWLPAGVRVPLHQVPYAVKGCFRFLPPAQVTVVGSYLLGTCIRPDINVDVALTMPREILQDKDGLNQRYFRKRALYLAHLAHHLAQDPLFGSVCFSYTNGCHLKPSLLLRPRGKDERLVTVRLHPCPPPDFFRPCRLLPTKNNVRSAWYRGQSPAGDGSPEPPTPRYNTWVLQDTVLESHLQLLSTILSSAQGLKDGVALLKVWLRQRELDKGQGGFTGFLVSMLVVFLVSTRKIHTTMSGYQVLRSVLQFLATTDLTVNGISLCLSSDPSLPALADFHQAFSVVFLDSSGHLNLCADVTASTYHQVQHEARLSMMLLDSRADDGFHLLLMTPKPMIRAFDHVLHLRPLSRLQAACHRLKLWPELQDNGGDYVSAALGPLTTLLEQGLGARLNLLAHSRPPVPEWDISQDPPKHKDSGTLTLGLLLRPEGLTSVLELGPEADQPEAAKFRQFWGSRSELRRFQDGAIREAVVWEAASMSQKRLIPHQVVTHLLALHADIPETCVHYVGGPLDALIQGLKEASSTKGRMVMSRGGELVMVPNVEAILEDFAVLGEGLVQTVEARSERWTV

SEQ ID NO: 58736 - protein, 200 aa, Homo sapiens
  Payload ID: 11479
  Gene Symbol: NOL6
  Gene Name: nucleolar protein 6 (RNA-associated)
  ENSP ID: ENSP00000368783
MVIVTPQDRKNSVWTQDGPSAQILQQLVVLAAEALPMLEKQLMDPRGPGDIRTVFRPPLDIYDVLIRLSPRHIPRHRQAVDSPAASFCRGLLSQPGPSSLMPVLGYDPPQLYLTQLREAFGDLALFFYDQHGGEVIGVLWKPTSFQPQPFKASSTKGRMVMSRGGELVMVPNVEAILEDFAVLGEGLVQTVEARSERWTV

SEQ ID NO: 58737 - protein, 1008 aa, Homo sapiens
  Payload ID: 11479
  Gene Symbol: NOL6
  Gene Name: nucleolar protein 6 (RNA-associated)
  ENSP ID: ENSP00000368784
MGPAPAGEQLRGATGEPEVMEPALEGTGKEGKKASSRKRTLAEPPAKGLLQPVKLSRAELYKEPTNEELNRLRETEILFHSSLLRLQVEELLKEVRLSEKKKDRIDAFLREVNQRVVRVPSVPETELTDQAWLPAGVRVPLHQVPYAVKGCFRFLPPAQVTVVGSYLLGTCIRPDINVDVALTMPREILQDKDGLNQRYFRKRALYLAHLAHHLAQDPLFGSVCFSYTNGCHLKPSLLLRPRGKDERLVTVRLHPCPPPDFFRPCRLLPTKNNVRSAWYRGQSPAGDGSPEPPTPRYNTWVLQDTVLESHLQLLSTILSSAQGLKDGVALLKVWLRQRELDKGQGGFTGFLVSMLVVFLVSTRKIHTTMSGYQVLRSVLQFLATTDLTVNGISLCLSSDPSLPALADFHQAFSVVFLDSSGHLNLCADVTASTYHQVQHEARLSMMLLDSRADDGFHLLLMTPKPMIRAFDHVLHLRPLSRLQAACHRLKLWPELQDNGGDYVSAALGPLTTLLEQGLGARLNLLAHSRPPVPEWDISQDPPKHKDSGTLTLGLLLRPEGLTSVLELGPEADQPEAAKFRQFWGSRSELRRFQDGAIREAVVWEAASMSQKRLIPHQVVTHLLALHADIPETCVHYVGGPLDALIQGLKETSSTGEEALVAAVRCYDDLSRLLWGLEGLPLTVSAVQGAHPVLRYTEVFPPTPVRPAFSFYETLRERSSLLPRLDKPCPAYVEPMTVVCHLEGSGQWPQDAEAVQRVRAAFQLRLAELLTQQHGLQCRATATHTDVLKDGFVFRIRVAYQREPQILKEVQSPEGMISLRDTAASLRLERDTRQLPLLTSALHGLQQQHPAFSGVARLAKRWVRAQLLGEGFADESLDLVAAALFLHPEPFTPPSSPQVGFLRFLFLVSTFDWKNNPLFVNLNNELTVEEQVEIRSGFLAARAQLPVMVIVTPQDRKNSVWTQDGPSAQILQQLVVLAAEALPMLEKQLMDPRGPGDIRMGPSENVALL

SEQ ID NO: 58738 - protein, 83 aa, Homo sapiens
  Payload ID: 11480
  Gene Symbol: NOL7
  Gene Name: nucleolar protein 7, 27kDa
  ENSP ID: ENSP00000404836
  MOD_RES (1)..(1): Any amino acid
XPEELTFASAQAEAREEERRVRETVRRDKTLLKEKRKRREELFIEQKKRKLLPDTILEKLTTASQTNIKKSPGKVKEGMTILI

SEQ ID NO: 58739 - protein, 257 aa, Homo sapiens
  Payload ID: 11480
  Gene Symbol: NOL7
  Gene Name: nucleolar protein 7, 27kDa
  Uniprot ID: Q9UMY1
  ENSP ID: ENSP00000405674
MVQLRPRASRAPASAEAMVDEGQLASEEEEAEHGLLLGQPSSGAAAEPLEEDEEGDDEFDDEAPEELTFASAQAEAREEERRVRETVRRDKTLLKEKRKRREELFIEQKKRKLLPDTILEKLTTASQTNIKKSPGKVKEVNLQKKNEDCEKGNDSKKVKVQKVQSVSQNKSYLAVRLKDQDLRDSRQQAAQAFIHNSLYGPGTNRTTVNKFLSLANKRLPVKRAAVQFLNNAWGIQKKQNAKRFKRRWMVRKMKTKK

SEQ ID NO: 58740 - protein, 1099 aa, Homo sapiens
  Payload ID: 11481
  Gene Symbol: NOL8
  Gene Name: nucleolar protein 8
  Uniprot ID: Q76FK4
  ENSP ID: ENSP00000351723
MSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKRTCDSITPSKSSPVPVSDTQKLKNLPFKTSGLETAKKRNSISDDDTDSEDELRMMIAKEENLQRTTQPSINESESDPFEVVRDDFKSGVHKLHSLIGLGIKNRVSCHDSDDDIMRNDREYDSGDTDEIIAMKKNVAKVKNSTEFSQMEKSTKKTSFKNRENCELSDHCIKLQKRKSNVESALSHGLKSLNRKSPSHSSSSEDADSASELADSEGGEEYNAMMKNCLRVNLTLADLEQLAGSDLKVPNEDTKSDGPETTTQCKFDRGSKSPKTPTGLRRGRQCIRPAEIVASLLEGEENTCGKQKPKENNLKPKFQAFKGVGCLYEKESMKKSLKDSVASNNKDQNSMKHEDPSIISMEDGSPYVNGSLGEVTPCQHAKKANGPNYIQPQKRQTTFESQDRKAVSPSSSEKRSKNPISRPLEGKKSLSLSAKTHNIGFDKDSCHSTTKTEASQEERSDSSGLTSLKKSPKVSSKDTREIKTDFSLSISNSSDVSAKDKHAEDNEKRLAALEARQKAKEVQKKLVHNALANLDGHPEDKPTHIIFGSDSECETEETSTQEQSHPGEEWVKESMGKTSGKLFDSSDDDESDSEDDSNRFKIKPQFEGRAGQKLMDLQSHFGTDDRFRMDSRFLETDSEEEQEEVNEKKTAEEEELAEEKKKALNVVQSVLQINLSNSTNRGSVAAKKFKDIIHYDPTKQDHATYERKRDDKPKESKAKRKKKREEAEKLPEVSKEMYYNIAMDLKEIFQTTKYTSEKEEGTPWNEDCGKEKPEEIQDPAALTSDAEQPSGFTFSFFDSDTKDIKEETYRVETVKPGKIVWQEDPRLQDSSSEEEDVTEETDHRNSSPGEASLLEKETTRFFFFSKNDERLQGSDLFWRGVGSNMSRNSWEARTTNLRMDCRKKHKDAKRKMKPK

SEQ ID NO: 58741 - protein, 86 aa, Homo sapiens
  Payload ID: 11481
  Gene Symbol: NOL8
  Gene Name: nucleolar protein 8
  ENSP ID: ENSP00000354115
MKVNRETKRLYVGGLSQDISEADLQNQFSRFGEVSDVEIITRKDDQGNPQKVFAYINISVAEADLKKSIFHVIQRDSSDEENSSIV

SEQ ID NO: 58742 - protein, 146 aa, Homo sapiens
  Payload ID: 11481
  Gene Symbol: NOL8
  Gene Name: nucleolar protein 8
  ENSP ID: ENSP00000388335
MSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFH

SEQ ID NO: 58743 - protein, 257 aa, Homo sapiens
  Payload ID: 11481
  Gene Symbol: NOL8
  Gene Name: nucleolar protein 8
  ENSP ID: ENSP00000390143
MKVNRETKRLYVGGLSQDISEADLQNQFSRFGEVSDVEIITRKDDQGNPQKVFAYINISVAEADLKKCMSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKR

SEQ ID NO: 58744 - protein, 101 aa, Homo sapiens
  Payload ID: 11481
  Gene Symbol: NOL8
  Gene Name: nucleolar protein 8
  ENSP ID: ENSP00000390791
MKVNRETKRLYVGGLSQDISEADLQNQFSRFGEVSDVEIITRKDDQGNPQKVFAYINISVAEADLKKCMSVLNKTKWKGGTLQIQLAKESFLHRRIWIIKT

SEQ ID NO: 58745 - protein, 1167 aa, Homo sapiens
  Payload ID: 11481
  Gene Symbol: NOL8
  Gene Name: nucleolar protein 8
  Uniprot ID: Q76FK4
  ENSP ID: ENSP00000401177
MKVNRETKRLYVGGLSQDISEADLQNQFSRFGEVSDVEIITRKDDQGNPQKVFAYINISVAEADLKKCMSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKRTCDSITPSKSSPVPVSDTQKLKNLPFKTSGLETAKKRNSISDDDTDSEDELRMMIAKEENLQRTTQPSINESESDPFEVVRDDFKSGVHKLHSLIGLGIKNRVSCHDSDDDIMRNDREYDSGDTDEIIAMKKNVAKVKNSTEFSQMEKSTKKTSFKNRENCELSDHCIKLQKRKSNVESALSHGLKSLNRKSPSHSSSSEDADSASELADSEGGEEYNAMMKNCLRVNLTLADLEQLAGSDLKVPNEDTKSDGPETTTQCKFDRGSKSPKTPTGLRRGRQCIRPAEIVASLLEGEENTCGKQKPKENNLKPKFQAFKGVGCLYEKESMKKSLKDSVASNNKDQNSMKHEDPSIISMEDGSPYVNGSLGEVTPCQHAKKANGPNYIQPQKRQTTFESQDRKAVSPSSSEKRSKNPISRPLEGKKSLSLSAKTHNIGFDKDSCHSTTKTEASQEERSDSSGLTSLKKSPKVSSKDTREIKTDFSLSISNSSDVSAKDKHAEDNEKRLAALEARQKAKEVQKKLVHNALANLDGHPEDKPTHIIFGSDSECETEETSTQEQSHPGEEWVKESMGKTSGKLFDSSDDDESDSEDDSNRFKIKPQFEGRAGQKLMDLQSHFGTDDRFRMDSRFLETDSEEEQEEVNEKKTAEEEELAEEKKKALNVVQSVLQINLSNSTNRGSVAAKKFKDIIHYDPTKQDHATYERKRDDKPKESKAKRKKKREEAEKLPEVSKEMYYNIAMDLKEIFQTTKYTSEKEEGTPWNEDCGKEKPEEIQDPAALTSDAEQPSGFTFSFFDSDTKDIKEETYRVETVKPGKIVWQEDPRLQDSSSEEEDVTEETDHRNSSPGEASLLEKETTRFFFFSKNDERLQGSDLFWRGVGSNMSRNSWEARTTNLRMDCRKKHKDAKRKMKPK

SEQ ID NO: 58746 - protein, 413 aa, Homo sapiens
  Payload ID: 11481
  Gene Symbol: NOL8
  Gene Name: nucleolar protein 8
  ENSP ID: ENSP00000412471
MKVNRETKRLYVGGLSQDISEADLQNQFSRFGEVSDVEIITRKDDQGNPQKVFAYINISVAEADLKKCMSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKRTCDSITPSKSSPVPVSDTQKLKNLPFKTSGLETAKKRNSISDDDTDSEDELRMMIAKEENLQRTTQPSINESESDPFEVVRDDFKSGVHKLHSLIGLGIKNRVSCHDSDDDIMRNDREYDSGDTDEIIAMKKNVAKVKNSTEFSQMEKSTKKTSFK

SEQ ID NO: 58747 - protein, 969 aa, Homo sapiens
  Payload ID: 11481
  Gene Symbol: NOL8
  Gene Name: nucleolar protein 8
  ENSP ID: ENSP00000414112
MKVNRETKRLYVGGLSQDISEADLQNQFSRFGEVSDVEIITRKDDQGNPQKVFAYINISVAEADLKKCMSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKRTCDSITPSKSSPVPVSDTQKLKNLPFKTSGLETAKKRNSISDDDTDSEDELRMMIAKEENLQRTTQPSINESESDPFEVVRDDFKSGVHKLHSLIGLGIKNRVSCHDSDDDIMRNDREYDSGDTDEIIAMKKNVAKVKNSTEFSQMEKSTKKTSFKNRENCELSDHCIKLQKRKSNVESALSHGLKSLNRKSPSHSSSSEDADSASELADSEGGEEYNAMMKNCLRVNLTLADLEQLAGSDLKVPNEDTKSDGPETTTQCKFDRGSKSPKTPTGLRRGRQCIRPAEIVASLLEGEENTCGKQKPKENNLKPKFQAFKGVGCLYEKESMKKSLKDSVASNNKDQNSMKHEDPSIISMEDGSPYVNGSLGEVTPCQHAKKANGPNYIQPQKRQTTFESQDRKAVSPSSSEKRSKNPISRPLEGKKSLSLSAKTHNIGFDKDSCHSTTKTEASQEERSDSSGLTSLKKSPKVSSKDTREIKTDFSLSISNSSDVSAKDKHAEDNEKRLAALEARQKAKEVQKKLVHNALANLDGHPEDKPTHIIFGSDSECETEETSTQEQSHPGEEWVKESMGKTSGKLFDSSDDDESDSEDDSNRFKIKPQFEGRAGQKLMDLQSHFGTDDRFRMDSRFLETDSEEEQEEVNEKKTAEEEELAEEKKKALNVVQSVLQINLSNSTNRGSVAAKKFKDIIHYDPTKQDHATYERKRDDKPKESK

SEQ ID NO: 58748 - protein, 86 aa, Homo sapiens; identical to SEQ ID NO: 58741
  Payload ID: 11481
  Gene Symbol: NOL8
  Gene Name: nucleolar protein 8
  ENSP ID: ENSP00000415750

SEQ ID NO: 58749 - protein, 86 aa, Homo sapiens; identical to SEQ ID NO: 58741
  Payload ID: 11481
  Gene Symbol: NOL8
  Gene Name: nucleolar protein 8
  ENSP ID: ENSP00000437615

SEQ ID NO: 58750 - protein, 1085 aa, Homo sapiens
  Payload ID: 11481
  Gene Symbol: NOL8
  Gene Name: nucleolar protein 8
  ENSP ID: ENSP00000439751
MKVNRETKRLYVGGLSQDISEADLQNQFSRFGEVSDVEIITRKDDQGNPQKVFAYINISVAEADLKKCMSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKRTCDSITPSKSSPVPVSDTQKLKNLPFKTSGLETAKKRNSISDDDTDSEDELRMMIAKEENLQRTTQPSINESESDPFEVVRDDFKSGVHKLHSLIGLGIKNRVSCHDSDDDIMRNDREYDSGDTDEIIAMKKNVAKVKNSTEFSQMEKSTKKTSFKNRENCELSDHCIKLQKRKSNVESALSHGLKSLNRKSPSHSSSSEDADSASELADSEGGEEYNAMMKNCLRVNLTLADLEQLAGSDLKVPNEDTKSDGPETTTQCKFDRGSKSPKTPTGLRRGRQCIRPAEIVASLLEGEENTCGKQKPKENNLKPKFQAFKGVGCLYEKESMKKSLKDSVASNNKDQNSMKHEDPSIISMEDGSPYVNGSLGEVTPCQHAKKANGPNYIQPQKRQTTFESQDRKAVSPSSSEKRSKNPISRPLEGKKSLSLSAKTHNIGFDKDSCHSTTKTEASQEERSDSSGLTSLKKSPKVSSKDTREIKTDFSLSISNSSDVSAKDKHAEDNEKRLAALEARQKAKEVQKKLVHNALANLDGHPEDKPTHIIFGSDSECETEETSTQEQSHPGEEWVKESMGKTSGKLFDSSDDDESDSEDDSNRFKIKPQFEGRAGQKLMDLQSHFGTDDRFRMDSRFLETDSEEEQEEVNEKKTAEEEELAEEKKKALNVVQSVLQINLSNSTNRGSVAAKKFKDIIHYDPTKQDHATYERKRDDKPKESKAKRKKKREEAEKLPEVSKEMYYNIAMDLKEIFQTTKYTSEKEEGTPWNEDCGKEKPEEIQDPAALTSDAEQPSGFTFSFFDSDTKDIKEDRVSVTQAGVQWCNLGSLADNTNSVVL

SEQ ID NO: 58751 - protein, 130 aa, Homo sapiens
  Payload ID: 11481
  Gene Symbol: NOL8
  Gene Name: nucleolar protein 8
  ENSP ID: ENSP00000439829
MKVNRETKRLYVGGLSQDISEADLQNQFSRFGEVSDVEIITRKDDQGNPQKVFAYINISVAEADLKKCMSVLNKTKWKGGTLQIQLAKESFLHRMVIQRISQRTSSSVLTVNVKQRRHRLRSRAIQERNG

SEQ ID NO: 58752 - protein, 86 aa, Homo sapiens; identical to SEQ ID NO: 58741
  Payload ID: 11481
  Gene Symbol: NOL8
  Gene Name: nucleolar protein 8
  ENSP ID: ENSP00000440342

SEQ ID NO: 58753 - protein, 1099 aa, Homo sapiens; identical to SEQ ID NO: 58740
  Payload ID: 11481
  Gene Symbol: NOL8
  Gene Name: nucleolar protein 8
  Uniprot ID: Q76FK4
  ENSP ID: ENSP00000440709

SEQ ID NO: 58754 - protein, 1167 aa, Homo sapiens; identical to SEQ ID NO: 58745
  Payload ID: 11481
  Gene Symbol: NOL8
  Gene Name: nucleolar protein 8
  Uniprot ID: Q76FK4
  ENSP ID: ENSP00000441140

SEQ ID NO: 58755 - protein, 1129 aa, Homo sapiens
  Payload ID: 11481
  Gene Symbol: NOL8
  Gene Name: nucleolar protein 8
  Uniprot ID: Q76FK4
  ENSP ID: ENSP00000441300
MKVNRETKRLYVGGLSQDISEADLQNQFSRFGEVSDVEIITRKDDQGNPQKVFAYINISVAEADLKKCMSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKRTCDSITPSKSSPVPVSDTQKLKNLPFKTSGLETAKKRNSISDDDTDSEDELRMMIAKEENLQRTTQPSINESESDPFEVVRDDFKSGVHKLHSLIGLGIKNRVSCHDSDDDIMRNDREYDSGDTDEIIAMKKNVAKVKNSTEFSQMEKSTKKTSFKNRENCELSDHCIKLQKRKSNVESALSHGLKSLNRKSPSHSSSSEDADSASELADSEGGEEYNAMMKNCLRVNLTLADLEQLAGSDLKVPNEDTKSDGPETTTQCKFDRGSKSPKTPTGLRRGRQCIRPAEIVASLLEGEENTCGKQKPKENNLKPKFQAFKGVGCLYEKESMKKSLKDSVASNNKDQNSMKHEDPSIISMEDGSPYVNGSLGEVTPCQHAKKANGPNYIQPQKRQTTFESQDRKAVSPSSSEKRSKNPISRPLEGKKSLSLSAKTHNIGFDKDSCHSTTKTEASQEERSDSSGLTSLKKSPKVSSKDTREIKTDFSLSISNSSDVSAKDKHAEDNEKRLAALEARQKAKEVQKKLVHNALANLESMGKTSGKLFDSSDDDESDSEDDSNRFKIKPQFEGRAGQKLMDLQSHFGTDDRFRMDSRFLETDSEEEQEEVNEKKTAEEEELAEEKKKALNVVQSVLQINLSNSTNRGSVAAKKFKDIIHYDPTKQDHATYERKRDDKPKESKAKRKKKREEAEKLPEVSKEMYYNIAMDLKEIFQTTKYTSEKEEGTPWNEDCGKEKPEEIQDPAALTSDAEQPSGFTFSFFDSDTKDIKEETYRVETVKPGKIVWQEDPRLQDSSSEEEDVTEETDHRNSSPGEASLLEKETTRFFFFSKNDERLQGSDLFWRGVGSNMSRNSWEARTTNLRMDCRKKHKDAKRKMKPK

SEQ ID NO: 58756 - protein, 145 aa, Homo sapiens
  Payload ID: 11481
  Gene Symbol: NOL8
  Gene Name: nucleolar protein 8
  ENSP ID: ENSP00000442037
MKVNRETKRLYVGGLSQDISEADLQNQFSRFGEVSDVEIITRKDDQGNPQKVFAYINISVAEADLKKCMSVLNKTKWKGGTLQIQLAKESFLHRLAQEREAAKAKKEESTTGNANLLEKTGGVDFHMKAVPGTEVPGHKNWVVSK

SEQ ID NO: 58757 - protein, 52 aa, Homo sapiens
  Payload ID: 11481
  Gene Symbol: NOL8
  Gene Name: nucleolar protein 8
  ENSP ID: ENSP00000442596
MSVLNKTKWKGGTLQIQLAKESFLHRLAQEREAAKAKKEESTTGNANLLEKT

SEQ ID NO: 58758 - protein, 109 aa, Homo sapiens
  Payload ID: 11481
  Gene Symbol: NOL8
  Gene Name: nucleolar protein 8
  ENSP ID: ENSP00000442666
MSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKK

SEQ ID NO: 58759 - protein, 86 aa, Homo sapiens; identical to SEQ ID NO: 58741
  Payload ID: 11481
  Gene Symbol: NOL8
  Gene Name: nucleolar protein 8
  ENSP ID: ENSP00000444790

SEQ ID NO: 58760 - protein, 86 aa, Homo sapiens; identical to SEQ ID NO: 58741
  Payload ID: 11481
  Gene Symbol: NOL8
  Gene Name: nucleolar protein 8
  ENSP ID: ENSP00000446265

SEQ ID NO: 58761 - protein, 702 aa, Homo sapiens
  Payload ID: 11482
  Gene Symbol: NOL9
  Gene Name: nucleolar protein 9
  Uniprot ID: Q5SY16
  ENSP ID: ENSP00000366934
MADSGLLLKRGSCRSTWLRVRKARPQLILSRRPRRRLGSLRWCGRRRLRWRLLQAQASGVDWREGARQVSRAAAARRPNTATPSPIPSPTPASEPESEPELESASSCHRPLLIPPVRPVGPGRALLLLPVEQGFTFSGICRVTCLYGQVQVFGFTISQGQPAQDIFSVYTHSCLSIHALHYSQPEKSKKELKREARNLLKSHLNLDDRRWSMQNFSPQCSIVLLEHLKTATVNFITSYPGSSYIFVQESPTPQIKPEYLALRSVGIRREKKRKGLQLTESTLSALEELVNVSCEEVDGCPVILVCGSQDVGKSTFNRYLINHLLNSLPCVDYLECDLGQTEFTPPGCISLLNITEPVLGPPFTHLRTPQKMVYYGKPSCKNNYENYIDIVKYVFSAYKRESPLIVNTMGWVSDQGLLLLIDLIRLLSPSHVVQFRSDHSKYMPDLTPQYVDDMDGLYTKSKTKMRNRRFRLAAFADALEFADEEKESPVEFTGHKLIGVYTDFAFRITPRNRESHNKILRDLSILSYLSQLQPPMPKPLSPLHSLTPYQVPFNAVALRITHSDVAPTHILYAVNASWVGLCKIQDDVRGYTNGPILLAQTPICDCLGFGICRGIDMEKRLYHILTPVPPEELRTVNCLLVGAIAIPHCVLKCQRGIEGTVPYVTTDYNFKLPGASEKIGAREPEEAHKEKPYRRPKFCRKMK

SEQ ID NO: 58762 - protein, 293 aa, Homo sapiens
  Payload ID: 11483
  Gene Symbol: NIFK
  Gene Name: nucleolar protein interacting with the FHA domain of MKI67
  Uniprot ID: Q9BYG3
  ENSP ID: ENSP00000285814
MATFSGPAGPILSLNPQEDVEFQKEVAQVRKRITQRKKQEQLTPGVVYVRHLPNLLDETQIFSYFSQFGTVTRFRLSRSKRTGNSKGYAFVEFESEDVAKIVAETMNNYLFGERLLECHFMPPEKVHKELFKDWNIPFKQPSYPSVKRYNRNRTLTQKLRMEERFKKKERLLRKKLAKKGIDYDFPSLILQKTESISKTNRQTSTKGQVLRKKKKKVSGTLDTPEKTVDSQGPTPVCTPTFLERRKSQVAELNDDDKDDEIVFKQPISCVKEEIQETQTPTHSRKKRRRSSNQ

SEQ ID NO: 58763 - protein, 102 aa, Homo sapiens
  Payload ID: 11483
  Gene Symbol: NIFK
  Gene Name: nucleolar protein interacting with the FHA domain of MKI67
  ENSP ID: ENSP00000390174
LRKKLAKKGIDYDFPSLVLRKKKKKVSGTLDTPEKTVDSQGPTPVCTPTFLERRKSQVAELNDDDKDDEIVFKQPISCVKEEIQETQTPTHSRKKRRRSSNQ

SEQ ID NO: 58764 - protein, 166 aa, Homo sapiens
  Payload ID: 11483
  Gene Symbol: NIFK
  Gene Name: nucleolar protein interacting with the FHA domain of MKI67
  ENSP ID: ENSP00000398116
MATFSGPAGPILSLNPQEDVEFQKEVAQVRKRITQFGTVTRFRLSRSKRTGNSKGYAFVEFESEDVAKIVAETMNNYLFGERLLECHFMPPEKVHKELFKDWNIPFKQPSYPSVKRYNRNRTLTQKLRMEERFKKKERLLRKKLAKKGIDYDFPSLILQKTESISK

SEQ ID NO: 58765 - protein, 164 aa, Homo sapiens
  Payload ID: 11483
  Gene Symbol: NIFK
  Gene Name: nucleolar protein interacting with the FHA domain of MKI67
  ENSP ID: ENSP00000406227
MNNYLFGERLLECHFMPPEKVHKELFKDWNIPFKQPSYPSVKRYNRNRTLTQKLRMEERFKKKERLLRKKLAKKGIDYDFPSLILQKTESISKTNRQTSTKGQVLRKKKKKVSGTLDTPEKTVDSQGPTPVCTPTFLERRKSQVAELNDDDKDDEIVFKQPISC

SEQ ID NO: 58766 - protein, 860 aa, Homo sapiens
  Payload ID: 11484
  Gene Symbol: NOM1
  Gene Name: nucleolar protein with MIF4G domain 1
  Uniprot ID: Q5C9Z4
  ENSP ID: ENSP00000275820
MAASRSAGEAGPGGSQGRVVRMKRRGGRGPRRGPAGGGEKALKRLKLAVEEFVHATSEGEAPGGCEGRGAPVSFRPGGRKSRKELRKEKRHLRKARRLQRTAGPEQGPGLGGRSGAEEASGHRQDTEERARPAPSRDPSPPRKPRPSRVKAKATAATAKTRPSAAATAAARKRALLAANEEEDREIRKLERCLGLNKRKKKDGSSSVPLSFARDGLDYILGALESGKNSGLYDSSGEEEEDAGQTLPESDLESDSQDESEEEEEGDVEKEKKAQEAEAQSEDDDEDTEEEQGEEKEKGAQEKRRGKRVRFAEDEEKSENSSEDGDITDKSLCGSGEKYIPPHVRQAEETVDFKKKEELERLKKHVKGLLNRLSEPNMASISGQLEELYMAHSRKDMNDTLTSALMGACVTASAMPSRLMMEHVLLVSILHHTVGIEVGAHFLEAVVRKFDAIYKYGSEGKECDNLFTVIAHLYNFHVVQSLLIFDILKKLIGTFTEKDIELILLMLKNVGFSLRKDDALSLKELITEAQTKASGAGSEFQDQTRIRFMLETMLALKNNDMRKIPGYDPEPVEKLRKLQRALVRNAGSGSETQLRVSWDSVLSAEQTGRWWIVGSAWSGAPMIDNSHHTHLQKQLVGTVSSKILELARKQRMNTDIRRNIFCTIMTSEDFLDAFEKLLKLGLKDQQEREIIHVLMDCCLQEKTYNPFYAFLASKFCEYERRFQMTFQFSIWDKFRDLENLPATNFSNLVHLVAHLLKTKSLSLSILKVVEFSELDKPRVRFLRKVLSILLMETEVEDLSLIFTRVSDNPKLGVLREGLKLFISHFLLKNAQAHRSADEANVLREKADLATKCLQGKASLRM

SEQ ID NO: 58767 - protein, 710 aa, Homo sapiens
  Payload ID: 11485
  Gene Symbol: NCL
  Gene Name: nucleolin
  Uniprot ID: P19338
  ENSP ID: ENSP00000318195
MVKLAKAGKNQGDPKKMAPPPKEVEEDSEDEEMSEDEEDDSSGEEVVIPQKKGKKAAATSAKKVVVSPTKKVAVATPAKKAAVTPGKKAAATPAKKTVTPAKAVTTPGKKGATPGKALVATPGKKGAAIPAKGAKNGKNAKKEDSDEEEDDDSEEDEEDDEDEDEDEDEIEPAAMKAAAAAPASEDEDDEDDEDDEDDDDDEEDDSEEEAMETTPAKGKKAAKVVPVKAKNVAEDEDEEEDDEDEDDDDDEDDEDDDDEDDEEEEEEEEEEPVKEAPGKRKKEMAKQKAAPEAKKQKVEGTEPTTAFNLFVGNLNFNKSAPELKTGISDVFAKNDLAVVDVRIGMTRKFGYVDFESAEDLEKALELTGLKVFGNEIKLEKPKGKDSKKERDARTLLAKNLPYKVTQDELKEVFEDAAEIRLVSKDGKSKGIAYIEFKTEADAEKTFEEKQGTEIDGRSISLYYTGEKGQNQDYRGGKNSTWSGESKTLVLSNLSYSATEETLQEVFEKATFIKVPQNQNGKSKGYAFIEFASFEDAKEALNSCNKREIEGRAIRLELQGPRGSPNARSQPSKTLFVKGLSEDTTEETLKESFDGSVRARIVTDRETGSSKGFGFVDFNSEEDAKAAKEAMEDGEIDGNKVTLDWAKPKGEGGFGGRGGGRGGFGGRGGGRGGRGGFGGRGRGGFGGRGGFRGGRGGGGDHKPQGKKTKFE

SEQ ID NO: 58768 - protein, 296 aa, Homo sapiens
  Payload ID: 11485
  Gene Symbol: NCL
  Gene Name: nucleolin
  ENSP ID: ENSP00000349410
LPYKVTQDELKEVFEDAAEIRLVSKDGKSKGIAYIEFKTEADAEKTFEEKQGTEIDGRSISLYYTGEKGQNQDYRGGKNSTWSDDSRKTDQSSAYVRTTSRTLQHVLGESKTLVLSNLSYSATEETLQEVFEKATFIKVPQNQNGKSKGYAFIEFASFEDAKEALNSCNKREIEGRAIRLELQGPRGSPNARSQPSKTLFVKGLSEDTTEETLKESFDGSVRARIVTDRETGSSKGFGFVDFNSEEDAKAAKEAMEDGEIDGNKVTLDWAKPKGEGGFGGRGGGRGGFGGRGGGRG

SEQ ID NO: 58769 - protein, 166 aa, Homo sapiens [sequence omitted]

SEQ ID NO: 58770 - protein, 141 aa, Homo sapiens [sequence omitted]

SEQ ID NO: 58771 - protein, 170 aa, Homo sapiens [sequence omitted]

SEQ ID NO: 58772 - protein, 151 aa, Homo sapiens [sequence omitted]

SEQ ID NO: 58773 - protein, 294 aa, Homo sapiens
  Payload ID: 11486
  Gene Symbol: NPM1
  Gene Name: nucleophosmin (nucleolar phosphoprotein B23, numatrin)
  Uniprot ID: P06748
  ENSP ID: ENSP00000296930
MEDSMDMDMSPLRPQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLVAVEEDAESEDEEEEDVKLLSISGKRSAPGGGSKVPQKKVKLAADEDDDDDDEEDDDEDDDDDDFDDEEAEEKAPVKKSIRDTPAKNAQKSNQNGKDSKPSSTPRSKGQESFKKQEKTPKTPKGPSSVEDIKAKMQASIEKGGSLPKVEAKFINYVKNCFRMTDQEAIQDLWQWRKSL

SEQ ID NO: 58774 - protein, 265 aa, Homo sapiens
  Payload ID: 11486
  Gene Symbol: NPM1
  Gene Name: nucleophosmin (nucleolar phosphoprotein B23, numatrin)
  Uniprot ID: P06748
  ENSP ID: ENSP00000341168
MEDSMDMDMSPLRPQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLVAVEEDAESEDEEEEDVKLLSISGKRSAPGGGSKVPQKKVKLAADEDDDDDDEEDDDEDDDDDDFDDEEAEEKAPVKKGQESFKKQEKTPKTPKGPSSVEDIKAKMQASIEKGGSLPKVEAKFINYVKNCFRMTDQEAIQDLWQWRKSL

SEQ ID NO: 58775 - protein, 259 aa, Homo sapiens
  Payload ID: 11486
  Gene Symbol: NPM1
  Gene Name: nucleophosmin (nucleolar phosphoprotein B23, numatrin)
  Uniprot ID: P06748
  ENSP ID: ENSP00000377408
MEDSMDMDMSPLRPQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLVAVEEDAESEDEEEEDVKLLSISGKRSAPGGGSKVPQKKVKLAADEDDDDDDEEDDDEDDDDDDFDDEEAEEKAPVKKSIRDTPAKNAQKSNQNGKDSKPSSTPRSKGQESFKKQEKTPKTPKGPSSVEDIKAKMQASIEKAH

SEQ ID NO: 58776 - protein, 59 aa, Homo sapiens
  Payload ID: 11486
  Gene Symbol: NPM1
  Gene Name: nucleophosmin (nucleolar phosphoprotein B23, numatrin)
  ENSP ID: ENSP00000428647
MEDSMDMDMSPLRPQNYLFDYHFKVDNDENEHQLSLRTVSLGAGAKDELHIVEAEAMNY

SEQ ID NO: 58777 - protein, 294 aa, Homo sapiens; identical to SEQ ID NO: 58773
  Payload ID: 11486
  Gene Symbol: NPM1
  Gene Name: nucleophosmin (nucleolar phosphoprotein B23, numatrin)
  Uniprot ID: P06748
  ENSP ID: ENSP00000428755

SEQ ID NO: 58778 - protein, 111 aa, Homo sapiens
  Payload ID: 11486
  Gene Symbol: NPM1
  Gene Name: nucleophosmin (nucleolar phosphoprotein B23, numatrin)
  ENSP ID: ENSP00000429485
MNYEGSPIKVTLATLKMSVQPTVSLGGFEITPPVVLRLKCGSGPVHISGQHLVAVEEDAESEDEEEEDVKLLSISGKRSAPGGGSKVPQKKVKLAADEDDDDDDEEDDDED

SEQ ID NO: 58779 - protein, 214 aa, Homo sapiens
  Payload ID: 11487
  Gene Symbol: NPM2
  Gene Name: nucleophosmin/nucleoplasmin 2
  Uniprot ID: Q86SE8
  ENSP ID: ENSP00000289820
MNLSSASSTEEKAVTTVLWGCELSQERRTWTFRPQLEGKQSCRLLLHTICLGEKAKEEMHRVEILPPANQEDKKMQPVTIASLQASVLPMVSMVGVQLSPPVTFQLRAGSGPVFLSGQERYEASDLTWEEEEEEEGEEEEEEEEDDEDEDADISLEEQSPVKQVKRLVPQKQASVAKKKKLEKEEEEIRASVRDKSPVKKAKATARAKKPGFKK

SEQ ID NO: 58780 - protein, 136 aa, Homo sapiens
  Payload ID: 11487
  Gene Symbol: NPM2
  Gene Name: nucleophosmin/nucleoplasmin 2
  Uniprot ID: Q86SE8
  ENSP ID: ENSP00000370941
MNLSSASSTEEKAVTTVLWGCELSQERRTWTFRPQLEGKQSCRLLLHTICLGEKAKEEMHRVEILPPANQEDKKMQPVTIASLQASVLPMVSMVGVQLSPPVTFQLRAGSGPVFLSGQERYEKKAGKRRRGNKSQR

SEQ ID NO: 58781 - protein, 214 aa, Homo sapiens; identical to SEQ ID NO: 58779
  Payload ID: 11487
  Gene Symbol: NPM2
  Gene Name: nucleophosmin/nucleoplasmin 2
  Uniprot ID: Q86SE8
  ENSP ID: ENSP00000381032

SEQ ID NO: 58782 - protein, 214 aa, Homo sapiens; identical to SEQ ID NO: 58779
  Payload ID: 11487
  Gene Symbol: NPM2
  Gene Name: nucleophosmin/nucleoplasmin 2
  Uniprot ID: Q86SE8
  ENSP ID: ENSP00000427741

SEQ ID NO: 58783 - protein, 137 aa, Homo sapiens
  Payload ID: 11487
  Gene Symbol: NPM2
  Gene Name: nucleophosmin/nucleoplasmin 2
  ENSP ID: ENSP00000428016
MNLSSASSTEEKAVTTVLWGCELSQERRTWTFRPQLEGKQSCRLLLHTICLGEKAKEEMHRVEILPPANQEDKKMQPVTIASLQASVLPMVSMVGVQLSPPVTFQLRAGSGPVFLSGQERYEASDLTWEEEEEEEGE

SEQ ID NO: 58784 - protein, 214 aa, Homo sapiens; identical to SEQ ID NO: 58779
  Payload ID: 11487
  Gene Symbol: NPM2
  Gene Name: nucleophosmin/nucleoplasmin 2
  Uniprot ID: Q86SE8
  ENSP ID: ENSP00000429413

SEQ ID NO: 58785 - protein, 99 aa, Homo sapiens
  Payload ID: 11487
  Gene Symbol: NPM2
  Gene Name: nucleophosmin/nucleoplasmin 2
  ENSP ID: ENSP00000429984
MNLSSASSTEEKAVTTVLWGCELSQERRTWTFRPQLEGKQSCRLLLHTICLGEKAKEEMHRVEILPPANQEDKKMQPVTIASLQASVLPMVSMVGVQLS

SEQ ID NO: 58786 - protein, 136 aa, Homo sapiens; identical to SEQ ID NO: 58780
  Payload ID: 11487
  Gene Symbol: NPM2
  Gene Name: nucleophosmin/nucleoplasmin 2
  Uniprot ID: Q86SE8
  ENSP ID: ENSP00000481018

SEQ ID NO: 58787 - protein, 214 aa, Homo sapiens; identical to SEQ ID NO: 58779
  Payload ID: 11487
  Gene Symbol: NPM2
  Gene Name: nucleophosmin/nucleoplasmin 2
  Uniprot ID: Q86SE8
  ENSP ID: ENSP00000481077

SEQ ID NO: 58788 - protein, 178 aa, Homo sapiens
  Payload ID: 11488
  Gene Symbol: NPM3
  Gene Name: nucleophosmin/nucleoplasmin 3
  Uniprot ID: O75607
  ENSP ID: ENSP00000359128
MAAGTAAALAFLSQESRTRAGGVGGLRVPAPVTMDSFFFGCELSGHTRSFTFKVEEEDDAEHVLALTMLCLTEGAKDECNVVEVVARNHDHQEIAVPVANLKLSCQPMLSLDDFQLQPPVTFRLKSGSGPVRITGRHQIVTMSNDVSEEESEEEEEDSDEEEVELCPILPAKKQGGRP

SEQ ID NO: 58789 - protein, 925 aa, Homo sapiens
  Payload ID: 11489
  Gene Symbol: NUP107
  Gene Name: nucleoporin 107kDa
  Uniprot ID: P57740
  ENSP ID: ENSP00000229179
MDRSGFGEISSPVIREAEVTRTARKQSAQKRVLLQASQDENFGNTTPRNQVIPRTPSSFRQPFTPTSRSLLRQPDISCILGTGGKSPRLTQSSGFFGNLSMVTNLDDSNWAAAFSSQRSGLFTNTEPHSITEDVTISAVMLREDDPGEAASMSMFSDFLQSFLKHSSSTVFDLVEEYENICGSQVNILSKIVSRATPGLQKFSKTASMLWLLQQEMVTWRLLASLYRDRIQSALEEESVFAVTAVNASEKTVVEALFQRDSLVRQSQLVVDWLESIAKDEIGEFSDNIEFYAKSVYWENTLHTLKQRQLTSYVGSVRPLVTELDPDAPIRQKMPLDDLDREDEVRLLKYLFTLIRAGMTEEAQRLCKRCGQAWRAATLEGWKLYHDPNVNGGTELEPVEGNPYRRIWKISCWRMAEDELFNRYERAIYAALSGNLKQLLPVCDTWEDTVWAYFRVMVDSLVEQEIQTSVATLDETEELPREYLGANWTLEKVFEELQATDKKRVLEENQEHYHIVQKFLILGDIDGLMDEFSKWLSKSRNNLPGHLLRFMTHLILFFRTLGLQTKEEVSIEVLKTYIQLLIREKHTNLIAFYTCHLPQDLAVAQYALFLESVTEFEQRHHCLELAKEADLDVATITKTVVENIRKKDNGEFSHHDLAPALDTGTTEEDRLKIDVIDWLVFDPAQRAEALKQGNAIMRKFLASKKHEAAKEVFVKIPQDSIAEIYNQCEEQGMESPLPAEDDNAIREHLCIRAYLEAHETFNEWFKHMNSVPQKPALIPQPTFTEKVAHEHKEKKYEMDFGIWKGHLDALTADVKEKMYNVLLFVDGGWMVDVREDAKEDHERTHQMVLLRKLCLPMLCFLLHTILHSTGQYQECLQLADMVSSERHKLYLVFSKEELRKLLQKLRESSLMLLDQGLDPLGYEIQL

SEQ ID NO: 58790 - protein, 686 aa, Homo sapiens
  Payload ID: 11489
  Gene Symbol: NUP107
  Gene Name: nucleoporin 107kDa
  Uniprot ID: P57740
  ENSP ID: ENSP00000368185
MSMFSDFLQSFLKHSSSTVFDLVEEYENICGSQVNILSKIVSRATPGLQKFSKTASMLWLLQQEMVTWRLLASLYRDRIQSALEEESVFAVTAVNASEKTVVEALFQRDSLVRQSQLVVDWLESIAKDEIGEFSDNIEFYAKSVYWENTLHTLKQRQLTSYVGSVRPLVTELDPDAPIRQKMPLDDLDREDEVRLLKYLFTLIRAGMTEEAQRLCKRCGQAWRAATLEGWKLYHDPNVNGGTELEPVEGNPYRRIWKISCWRMAEDELFNRYERAIYAALSGNLKQLLPVCDTWEDTVWAYFRVMVDSLVEQEIQTSVATLDETEELPREYLGANWTLEKVFEELQATDKKRVLEENQEHYHIVQKFLILGDIDGLMDEFSKWLSKSRNNLPGHLLRFMTHLILFFRTLGLQTKEEVSIEVLKTYIQEDRLKIDVIDWLVFDPAQRAEALKQGNAIMRKFLASKKHEAAKEVFVKIPQDSIAEIYNQCEEQGMESPLPAEDDNAIREHLCIRAYLEAHETFNEWFKHMNSVPQKPALIPQPTFTEKVAHEHKEKKYEMDFGIWKGHLDALTADVKEKMYNVLLFVDGGWMVDVREDAKEDHERTHQMVLLRKLCLPMLCFLLHTILHSTGQYQECLQLADMVSSERHKLYLVFSKEELRKLLQKLRESSLMLLDQGLDPLGYEIQL

SEQ ID NO: 58791 - protein, 85 aa, Homo sapiens
  Payload ID: 11489
  Gene Symbol: NUP107
  Gene Name: nucleoporin 107kDa
  ENSP ID: ENSP00000440116
MVTNLDDSNWAAAFSSQRSGLFTNTEPHSITEDVTISAVMLREDDPGEAASMSMFSDFLQSFLKHSSSTVFDLVEEYENICGSQV

SEQ ID NO: 58792 - protein, 80 aa, Homo sapiens
  Payload ID: 11489
  Gene Symbol: NUP107
  Gene Name: nucleoporin 107kDa
  ENSP ID: ENSP00000441334
ERAIYAALSGNLKQLLPVCDTWEDTVWAYFRVMVDSLVEQEIQTSVATLDETEELPREYLGANWTLEKVFEELQATDKKV

SEQ ID NO: 58793 - protein, 896 aa, Homo sapiens
  Payload ID: 11489
  Gene Symbol: NUP107
  Gene Name: nucleoporin 107kDa
  Uniprot ID: P57740
  ENSP ID: ENSP00000441448
MKILVILHQETRLSLELLAHFDSLVLSTNLLFIVTPTSRSLLRQPDISCILGTGGKSPRLTQSSGFFGNLSMVTNLDDSNWAAAFSSQRSGLFTNTEPHSITEDVTISAVMLREDDPGEAASMSMFSDFLQSFLKHSSSTVFDLVEEYENICGSQVNILSKIVSRATPGLQKFSKTASMLWLLQQEMVTWRLLASLYRDRIQSALEEESVFAVTAVNASEKTVVEALFQRDSLVRQSQLVVDWLESIAKDEIGEFSDNIEFYAKSVYWENTLHTLKQRQLTSYVGSVRPLVTELDPDAPIRQKMPLDDLDREDEVRLLKYLFTLIRAGMTEEAQRLCKRCGQAWRAATLEGWKLYHDPNVNGGTELEPVEGNPYRRIWKISCWRMAEDELFNRYERAIYAALSGNLKQLLPVCDTWEDTVWAYFRVMVDSLVEQEIQTSVATLDETEELPREYLGANWTLEKVFEELQATDKKRVLEENQEHYHIVQKFLILGDIDGLMDEFSKWLSKSRNNLPGHLLRFMTHLILFFRTLGLQTKEEVSIEVLKTYIQLLIREKHTNLIAFYTCHLPQDLAVAQYALFLESVTEFEQRHHCLELAKEADLDVATITKTVVENIRKKDNGEFSHHDLAPALDTGTTEEDRLKIDVIDWLVFDPAQRAEALKQGNAIMRKFLASKKHEAAKEVFVKIPQDSIAEIYNQCEEQGMESPLPAEDDNAIREHLCIRAYLEAHETFNEWFKHMNSVPQKPALIPQPTFTEKVAHEHKEKKYEMDFGIWKGHLDALTADVKEKMYNVLLFVDGGWMVDVREDAKEDHERTHQMVLLRKLCLPMLCFLLHTILHSTGQYQECLQLADMVSSERHKLYLVFSKEELRKLLQKLRESSLMLLDQGLDPLGYEIQL

SEQ ID NO: 58794 - protein, 103 aa, Homo sapiens
  Payload ID: 11489
  Gene Symbol: NUP107
  Gene Name: nucleoporin 107kDa
  ENSP ID: ENSP00000445567
MDRSGFGEISSPVIREAEVTRTARKQSAQKRVLLQASQDENFGNTTPRNQVIPRTPSSFRQPFTPTSRSLLRQPDISCILGTGGKSPRLTQSSGFFGNLSMHP

SEQ ID NO: 58795 - protein, 1156 aa, Homo sapiens
  Payload ID: 11490
  Gene Symbol: NUP133
  Gene Name: nucleoporin 133kDa
  Uniprot ID: Q8WUM0
  ENSP ID: ENSP00000261396
MFPAAPSPRTPGTGSRRGPLAGLGPGSTPRTASRKGLPLGSAVSSPVLFSPVGRRSSLSSRGTPTRMFPHHSITESVNYDVKTFGSSLPVKVMEALTLAEVDDQLTINIDEGGWACLVCKEKLIIWKIALSPITKLSVCKELQLPPSDFHWSADLVALSYSSPSGEAHSTQAVAVMVATREGSIRYWPSLAGEDTYTEAFVDSGGDKTYSFLTAVQGGSFILSSSGSQLIRLIPESSGKIHQHILPQGQGMLSGIGRKVSSLFGILSPSSDLTLSSVLWDRERSSFYSLTSSNISKWELDDSSEKHAYSWDINRALKENITDAIWGSESNYEAIKEGVNIRYLDLKQNCDGLVILAAAWHSADNPCLIYYSLITIEDNGCQMSDAVTVEVTQYNPPFQSEDLILCQLTVPNFSNQTAYLYNESAVYVCSTGTGKFSLPQEKIVFNAQGDSVLGAGACGGVPIIFSRNSGLVSITSRENVSILAEDLEGSLASSVAGPNSESMIFETTTKNETIAQEDKIKLLKAAFLQYCRKDLGHAQMVVDELFSSHSDLDSDSELDRAVTQISVDLMDDYPASDPRWAESVPEEAPGFSNTSLIILHQLEDKMKAHSFLMDFIHQVGLFGRLGSFPVRGTPMATRLLLCEHAEKLSAAIVLKNHHSRLSDLVNTAILIALNKREYEIPSNLTPADVFFREVSQVDTICECLLEHEEQVLRDAPMDSIEWAEVVINVNNILKDMLQAASHYRQNRNSLYRREESLEKEPEYVPWTATSGPGGIRTVIIRQHEIVLKVAYPQADSNLRNIVTEQLVALIDCFLDGYVSQLKSVDKSSNRERYDNLEMEYLQKRSDLLSPLLSLGQYLWAASLAEKYCDFDILVQMCEQTDNQSRLQRYMTQFADQNFSDFLFRWYLEKGKRGKLLSQPISQHGQLANFLQAHEHLSWLHEINSQELEKAHATLLGLANMETRYFAKKKTLLGLSKLAALASDFSEDMLQEKIEEMAEQERFLLHQETLPEQLLAEKQLNLSAMPVLTAPQLIGLYICEENRRANEYDFKKALDLLEYIDEEEDININDLKLEILCKALQRDNWSSSDGKDDPIEVSKDSIFVKILQKLLKDGIQLSEYLPEVKDLLQADQLGSLKSNPYFEFVLKANYEYYVQGQI

SEQ ID NO: 58796 - protein, 1475 aa, Homo sapiens
  Payload ID: 11491
  Gene Symbol: NUP153
  Gene Name: nucleoporin 153kDa
  Uniprot ID: P49790
  ENSP ID: ENSP00000262077
MASGAGGVGGGGGGKIRTRRCHQGPIKPYQQGRQQHQGILSRVTESVKNIVPGWLQRYFNKNEDVCSCSTDTSEVPRWPENKEDHLVYADEESSNITDGRITPEPAVSNTEEPSTTSTASNYPDVLTRPSLHRSHLNFSMLESPALHCQPSTSSAFPIGSSGFSLVKEIKDSTSQHDDDNISTTSGFSSRASDKDITVSKNTSLPPLWSPEAERSHSLSQHTATSSKKPAFNLSAFGTLSPSLGNSSILKTSQLGDSPFYPGKTTYGGAAAAVRQSKLRNTPYQAPVRRQMKAKQLSAQSYGVTSSTARRILQSLEKMSSPLADAKRIPSIVSSPLNSPLDRSGIDITDFQAKREKVDSQYPPVQRLMTPKPVSIATNRSVYFKPSLTPSGEFRKTNQRIDNKCSTGYEKNMTPGQNREQRESGFSYPNFSLPAANGLSSGVGGGGGKMRRERTRFVASKPLEEEEMEVPVLPKISLPITSSSLPTFNFSSPEITTSSPSPINSSQALTNKVQMTSPSSTGSPMFKFSSPIVKSTEANVLPPSSIGFTFSVPVAKTAELSGSSSTLEPIISSSAHHVTTVNSTNCKKTPPEDCEGPFRPAEILKEGSVLDILKSPGFASPKIDSVAAQPTATSPVVYTRPAISSFSSSGIGFGESLKAGSSWQCDTCLLQNKVTDNKCIACQAAKLSPRDTAKQTGIETPNKSGKTTLSASGTGFGDKFKPVIGTWDCDTCLVQNKPEAIKCVACETPKPGTCVKRALTLTVVSESAETMTASSSSCTVTTGTLGFGDKFKRPIGSWECSVCCVSNNAEDNKCVSCMSEKPGSSVPASSSSTVPVSLPSGGSLGLEKFKKPEGSWDCELCLVQNKADSTKCLACESAKPGTKSGFKGFDTSSSSSNSAASSSFKFGVSSSSSGPSQTLTSTGNFKFGDQGGFKIGVSSDSGSINPMSEGFKFSKPIGDFKFGVSSESKPEEVKKDSKNDNFKFGLSSGLSNPVSLTPFQFGVSNLGQEEKKEELPKSSSAGFSFGTGVINSTPAPANTIVTSENKSSFNLGTIETKSASVAPFTCKTSEAKKEEMPATKGGFSFGNVEPASLPSASVFVLGRTEEKQQEPVTSTSLVFGKKADNEEPKCQPVFSFGNSEQTKDENSSKSTFSFSMTKPSEKESEQPAKATFAFGAQTSTTADQGAAKPVFSFLNNSSSSSSTPATSAGGGIFGSSTSSSNPPVATFVFGQSSNPVSSSAFGNTAESSTSQSLLFSQDSKLATTSSTGTAVTPFVFGPGASSNNTTTSGFGFGATTTSSSAGSSFVFGTGPSAPSASPAFGANQTPTFGQSQGASQPNPPGFGSISSSTALFPTGSQPAPPTFGTVSSSSQPPVFGQQPSQSAFGSGTTPNSSSAFQFGSSTTNFNFTNNSPSGVFTFGANSSTPAASAQPSGSGGFPFNQSPAAFTVGSNGKNVFSSSGTSFSGRKIKTAVRRRK

SEQ ID NO: 58797 - protein, 1506 aa, Homo sapiens
  Payload ID: 11491
  Gene Symbol: NUP153
  Gene Name: nucleoporin 153kDa
  Uniprot ID: P49790
  ENSP ID: ENSP00000444029
MASGAGGVGGGGGGKIRTRRCHQGPIKPYQQGRQQHQGILSRVTESVKNIVPGWLQRYFNKNEDVCSCSTDTSEVPRWPENKEDHLVYADEESSNITDGRITPEPAVSNTEEPSTTSTASNYPDVLTRPSLHRSHLNFSMLESPALHCQPSTSSAFPIGSSGFSLVKEIKDSTSQHDDDNISTTSGFSSRASDKDITVSKNTSLPPLWSPEAERSHSLSQHTATSSKKPAFNLSAFGTLSPSLGNSSILKTSQLGDSPFYPGKTTYGGAAAAVRQSKLRNTPYQAPVRRQMKAKQLSAQSYGVTSSTARRILQSLEKMSSPLADAKRIPSIVSSPLNSPLDRSGIDITDFQAKREKVDSQYPPVQRLMTPKPVSIATNRSVYFKPSLTPSGEFRKTNQRIDNKCSTGYEKNMTPGQNREQRESGFSYPNFSLPAANGLSSGVGGGGGKMRRERTRFVASKPLEEERQGLTVLPKLISSSCAQAIIPSWPLKVLRLQEMEVPVLPKISLPITSSSLPTFNFSSPEITTSSPSPINSSQALTNKVQMTSPSSTGSPMFKFSSPIVKSTEANVLPPSSIGFTFSVPVAKTAELSGSSSTLEPIISSSAHHVTTVNSTNCKKTPPEDCEGPFRPAEILKEGSVLDILKSPGFASPKIDSVAAQPTATSPVVYTRPAISSFSSSGIGFGESLKAGSSWQCDTCLLQNKVTDNKCIACQAAKLSPRDTAKQTGIETPNKSGKTTLSASGTGFGDKFKPVIGTWDCDTCLVQNKPEAIKCVACETPKPGTCVKRALTLTVVSESAETMTASSSSCTVTTGTLGFGDKFKRPIGSWECSVCCVSNNAEDNKCVSCMSEKPGSSVPASSSSTVPVSLPSGGSLGLEKFKKPEGSWDCELCLVQNKADSTKCLACESAKPGTKSGFKGFDTSSSSSNSAASSSFKFGVSSSSSGPSQTLTSTGNFKFGDQGGFKIGVSSDSGSINPMSEGFKFSKPIGDFKFGVSSESKPEEVKKDSKNDNFKFGLSSGLSNPVSLTPFQFGVSNLGQEEKKEELPKSSSAGFSFGTGVINSTPAPANTIVTSENKSSFNLGTIETKSASVAPFTCKTSEAKKEEMPATKGGFSFGNVEPASLPSASVFVLGRTEEKQQEPVTSTSLVFGKKADNEEPKCQPVFSFGNSEQTKDENSSKSTFSFSMTKPSEKESEQPAKATFAFGAQTSTTADQGAAKPVFSFLNNSSSSSSTPATSAGGGIFGSSTSSSNPPVATFVFGQSSNPVSSSAFGNTAESSTSQSLLFSQDSKLATTSSTGTAVTPFVFGPGASSNNTTTSGFGFGATTTSSSAGSSFVFGTGPSAPSASPAFGANQTPTFGQSQGASQPNPPGFGSISSSTALFPTGSQPAPPTFGTVSSSSQPPVFGQQPSQSAFGSGTTPNSSSAFQFGSSTTNFNFTNNSPSGVFTFGANSSTPAASAQPSGSGGFPFNQSPAAFTVGSNGKNVFSSSGTSFSGRKIKTAVRRRK

SEQ ID NO: 58798 - protein, 1433 aa, Homo sapiens
  Payload ID: 11491
  Gene Symbol: NUP153
  Gene Name: nucleoporin 153kDa
  Uniprot ID: P49790
  ENSP ID: ENSP00000478627
MASGAGGVGGGGGGKIRTRRCHQGPIKPYQQGRQQHQGILSRVTESVKNIVPGWLQRYFNKNEDVCSCSTDTSEVPRWPENKEDHLVYADEESSNITDGRITPEPAVSNTEEPSTTSTASNYPDVLTRPSLHRSHLNFSMLESPALHCQPSTSSAFPIGSSGFSLVKEIKDSTSQHDDDNISTTSGFSSRASDKDITVSKNTSLPPLWSPEAERSHSLSQHTATSSKKPAFNLSAFGTLSPSLGNSSILKTSQLGDSPFYPGKTTYGGAAAAVRQSKLRNTPYQAPVRRQMKAKQLSAQSYGVTSSTARRILQSLEKMSSPLADAKRIPSIVSSPLNSPLDRSGIDITDFQAKREKVDSQYPPVQRLMTPKPVSIATNRSVYFKPSLTPSGEFRKTNQRIDNKCSTGYEKNMTPGQNREQRESGFSYPNFSLPAANGLSSGVGGGGGKMRRERTRFVASKPLEEEEMEVPVLPKISLPITSSSLPTFNFSSPEITTSSPSPINSSQALTNKVQMTSPSSTGSPMFKFSSPIVKSTEANVLPPSSIGFTFSVPVAKTAELSGSSSTLEPIISSSGFASPKIDSVAAQPTATSPVVYTRPAISSFSSSGIGFGESLKAGSSWQCDTCLLQNKVTDNKCIACQAAKLSPRDTAKQTGIETPNKSGKTTLSASGTGFGDKFKPVIGTWDCDTCLVQNKPEAIKCVACETPKPGTCVKRALTLTVVSESAETMTASSSSCTVTTGTLGFGDKFKRPIGSWECSVCCVSNNAEDNKCVSCMSEKPGSSVPASSSSTVPVSLPSGGSLGLEKFKKPEGSWDCELCLVQNKADSTKCLACESAKPGTKSGFKGFDTSSSSSNSAASSSFKFGVSSSSSGPSQTLTSTGNFKFGDQGGFKIGVSSDSGSINPMSEGFKFSKPIGDFKFGVSSESKPEEVKKDSKNDNFKFGLSSGLSNPVSLTPFQFGVSNLGQEEKKEELPKSSSAGFSFGTGVINSTPAPANTIVTSENKSSFNLGTIETKSASVAPFTCKTSEAKKEEMPATKGGFSFGNVEPASLPSASVFVLGRTEEKQQEPVTSTSLVFGKKADNEEPKCQPVFSFGNSEQTKDENSSKSTFSFSMTKPSEKESEQPAKATFAFGAQTSTTADQGAAKPVFSFLNNSSSSSSTPATSAGGGIFGSSTSSSNPPVATFVFGQSSNPVSSSAFGNTAESSTSQSLLFSQDSKLATTSSTGTAVTPFVFGPGASSNNTTTSGFGFGATTTSSSAGSSFVFGTGPSAPSASPAFGANQTPTFGQSQGASQPNPPGFGSISSSTALFPTGSQPAPPTFGTVSSSSQPPVFGQQPSQSAFGSGTTPNSSSAFQFGSSTTNFNFTNNSPSGVFTFGANSSTPAASAQPSGSGGFPFNQSPAAFTVGSNGKNVFSSSGTSFSGRKIKTAVRRRK

SEQ ID NO: 58799 - protein, 1391 aa, Homo sapiens
  Payload ID: 11492
  Gene Symbol: NUP155
  Gene Name: nucleoporin 155kDa
  Uniprot ID: O75694
  ENSP ID: ENSP00000231498
MPSSLLGAAMPASTSAAALQEALENAGRLIDRQLQEDRMYPDLSELLMVSAPNNPTVSGMSDMDYPLQGPGLLSVPNLPEISSIRRVPLPPELVEQFGHMQCNCMMGVFPPISRAWLTIDSDIFMWNYEDGGDLAYFDGLSETILAVGLVKPKAGIFQPHVRHLLVLATPVDIVILGLSYANLQTGSGVLNDSLSGGMQLLPDPLYSLPTDNTYLLTITSTDNGRIFLAGKDGCLYEVAYQAEAGWFSQRCRKINHSKSSLSFLVPSLLQFTFSEDDPILQIAIDNSRNILYTRSEKGVIQVYDLGQDGQGMSRVASVSQNAIVSAAGNIARTIDRSVFKPIVQIAVIENSESLDCQLLAVTHAGVRLYFSTCPFRQPLARPNTLTLVHVRLPPGFSASSTVEKPSKVHRALYSKGILLMAASENEDNDILWCVNHDTFPFQKPMMETQMTAGVDGHSWALSAIDELKVDKIITPLNKDHIPITDSPVVVQQHMLPPKKFVLLSAQGSLMFHKLRPVDQLRHLLVSNVGGDGEEIERFFKLHQEDQACATCLILACSTAACDREVSAWATRAFFRYGGEAQMRFPTTLPPPSNVGPILGSPVYSSSPVPSGSPYPNPSFLGTPSHGIQPPAMSTPVCALGNPATQATNMSCVTGPEIVYSGKHNGICIYFSRIMGNIWDASLVVERIFKSGNREITAIESSVPCQLLESVLQELKGLQEFLDRNSQFAGGPLGNPNTTAKVQQRLIGFMRPENGNPQQMQQELQRKFHEAQLSEKISLQAIQQLVRKSYQALALWKLLCEHQFTIIVAELQKELQEQLKITTFKDLVIRDKELTGALIASLINCYIRDNAAVDGISLHLQDICPLLYSTDDAICSKANELLQRSRQVQNKTEKERMLRESLKEYQKISNQVDLSNVCAQYRQVRFYEGVVELSLTAAEKKDPQGLGLHFYKHGEPEEDIVGLQAFQERLNSYKCITDTLQELVNQSKAAPQSPSVPKKPGPPVLSSDPNMLSNEEAGHHFEQMLKLSQRSKDELFSIALYNWLIQVDLADKLLQVASPFLEPHLVRMAKVDQNRVRYMDLLWRYYEKNRSFSNAARVLSRLADMHSTEISLQQRLEYIARAILSAKSSTAISSIAADGEFLHELEEKMEVARIQLQIQETLQRQYSHHSSVQDAVSQLDSELMDITKLYGEFADPFKLAECKLAIIHCAGYSDPILVQTLWQDIIEKELSDSVTLSSSDRMHALSLKIVLLGKIYAGTPRFFPLDFIVQFLEQQVCTLNWDVGFVIQTMNEIGVPLPRLLEVYDQLFKSRDPFWNRMKKPLHLLDCIHVLLIRYVENPSQVLNCERRRFTNLCLDAVCGYLVELQSMSSSVAVQAITGNFKSLQAKLERLH

SEQ ID NO: 58800 - protein, 1332 aa, Homo sapiens
  Payload ID: 11492
  Gene Symbol: NUP155
  Gene Name: nucleoporin 155kDa
  Uniprot ID: O75694
  ENSP ID: ENSP00000371265
MSDMDYPLQGPGLLSVPNLPEISSIRRVPLPPELVEQFGHMQCNCMMGVFPPISRAWLTIDSDIFMWNYEDGGDLAYFDGLSETILAVGLVKPKAGIFQPHVRHLLVLATPVDIVILGLSYANLQTGSGVLNDSLSGGMQLLPDPLYSLPTDNTYLLTITSTDNGRIFLAGKDGCLYEVAYQAEAGWFSQRCRKINHSKSSLSFLVPSLLQFTFSEDDPILQIAIDNSRNILYTRSEKGVIQVYDLGQDGQGMSRVASVSQNAIVSAAGNIARTIDRSVFKPIVQIAVIENSESLDCQLLAVTHAGVRLYFSTCPFRQPLARPNTLTLVHVRLPPGFSASSTVEKPSKVHRALYSKGILLMAASENEDNDILWCVNHDTFPFQKPMMETQMTAGVDGHSWALSAIDELKVDKIITPLNKDHIPITDSPVVVQQHMLPPKKFVLLSAQGSLMFHKLRPVDQLRHLLVSNVGGDGEEIERFFKLHQEDQACATCLILACSTAACDREVSAWATRAFFRYGGEAQMRFPTTLPPPSNVGPILGSPVYSSSPVPSGSPYPNPSFLGTPSHGIQPPAMSTPVCALGNPATQATNMSCVTGPEIVYSGKHNGICIYFSRIMGNIWDASLVVERIFKSGNREITAIESSVPCQLLESVLQELKGLQEFLDRNSQFAGGPLGNPNTTAKVQQRLIGFMRPENGNPQQMQQELQRKFHEAQLSEKISLQAIQQLVRKSYQALALWKLLCEHQFTIIVAELQKELQEQLKITTFKDLVIRDKELTGALIASLINCYIRDNAAVDGISLHLQDICPLLYSTDDAICSKANELLQRSRQVQNKTEKERMLRESLKEYQKISNQVDLSNVCAQYRQVRFYEGVVELSLTAAEKKDPQGLGLHFYKHGEPEEDIVGLQAFQERLNSYKCITDTLQELVNQSKAAPQSPSVPKKPGPPVLSSDPNMLSNEEAGHHFEQMLKLSQRSKDELFSIALYNWLIQVDLADKLLQVASPFLEPHLVRMAKVDQNRVRYMDLLWRYYEKNRSFSNAARVLSRLADMHSTEISLQQRLEYIARAILSAKSSTAISSIAADGEFLHELEEKMEVARIQLQIQETLQRQYSHHSSVQDAVSQLDSELMDITKLYGEFADPFKLAECKLAIIHCAGYSDPILVQTLWQDIIEKELSDSVTLSSSDRMHALSLKIVLLGKIYAGTPRFFPLDFIVQFLEQQVCTLNWDVGFVIQTMNEIGVPLPRLLEVYDQLFKSRDPFWNRMKKPLHLLDCIHVLLIRYVENPSQVLNCERRRFTNLCLDAVCGYLVELQSMSSSVAVQAITGNFKSLQAKLERLH

SEQ ID NO: 58801 - protein, 1327 aa, Homo sapiens
  Payload ID: 11492
  Gene Symbol: NUP155
  Gene Name: nucleoporin 155kDa
  ENSP ID: ENSP00000422019
MPSSLLGAAMPASTSAAALQEALENAGRLIDRQLQEDRMYPDLSELLMVSAPNNPTVSGMSDMDYPLQGPGLLSVPNLPEISSIRRVPLPPELVEQFGHMQCNCMMGVFPPISRAWLTIDSDIFMWNYEDGGDLAYFDGLSETILAVGLVKPKAGIFQPHVRHLLVLATPVDIVILGLSYANLQTGSGVLNDSLSGGMQLLPDPLYSLPTDNTYLLTITSTDNGRIFLAGKDGCLYEVAYQAEAGWFSQRCRKINHSKSSLSFLVPSLLQFTFSEDDPILQIAIDNSRNILYTRSEKGVIQVYDLGQDGQGMSRVASVSQNAIVSAAGNIARTIDRSVFKPIVQIAVIENSESLDCQLLAVTHAGVRLYFSTCPFRQPLARPNTLTLVHVRLPPGFSASSTVEKPSKVHRALYSKGILLMAASENEDNDILWCVNHDTFPFQKPMMETQMTAGVDGHSWALSAIDELKVDKIITPLNKDHIPITDSPVVVQQHMLPPKKFVLLSAQGSLMFHKLRPVDQLRHLLVSNVGGDGEEIERFFKLHQEDQACATCLILACSTAACDREVSAWATRAFFRYGGEAQMRFPTTLPPPSNVGPILGSPVYSSSPVPSGSPYPNPSFLGTPSHGIQPPAMSTPVCALGNPATQATNMSCVTGPEIVYSGKHNGICIYFSRIMGNIWDASLVVERIFKSGNREITAIESSVPCQLLESVLQELKGLQEFLDRNSQFAGGPLGNPNTTAKVQQRLIGFMRPENGNPQQMQQELQRKFHEAQLSEKISLQAIQQLVRKSYQALALWKLLCEHQFTIIVAELQKANELLQRSRQVQNKTEKERMLRESLKEYQKISNQVDLSNVCAQYRQVRFYEGVVELSLTAAEKKDPQGLGLHFYKHGEPEEDIVGLQAFQERLNSYKCITDTLQELVNQSKAAPQSPSVPKKPGPPVLSSDPNMLSNEEAGHHFEQMLKLSQRSKDELFSIALYNWLIQVDLADKLLQVASPFLEPHLVRMAKVDQNRVRYMDLLWRYYEKNRSFSNAARVLSRLADMHSTEISLQQRLEYIARAILSAKSSTAISSIAADGEFLHELEEKMEVARIQLQIQETLQRQYSHHSSVQDAVSQLDSELMDITKLYGEFADPFKLAECKLAIIHCAGYSDPILVQTLWQDIIEKELSDSVTLSSSDRMHALSLKIVLLGKIYAGTPRFFPLDFIVQFLEQQVCTLNWDVGFVIQTMNEIGVPLPRLLEVYDQLFKSRDPFWNRMKKPLHLLDCIHVLLIRYVENPSQVLNCERRRFTNLCLDAVCGYLVELQSMSSSVAVQAITGNFKSLQAKLERLH

SEQ ID NO: 58802 - protein, 54 aa, Homo sapiens
  Payload ID: 11492
  Gene Symbol: NUP155
  Gene Name: nucleoporin 155kDa
  ENSP ID: ENSP00000423484
MPSSLLGAAMPASTSAAALQEALENAGRLIDRQLQEDRMYPDLSELLMVSAPSE

SEQ ID NO: 58803 - protein, 1436 aa, Homo sapiens
  Payload ID: 11493
  Gene Symbol: NUP160
  Gene Name: nucleoporin 160kDa
  Uniprot ID: Q12769
  ENSP ID: ENSP00000367721
MLHLSAAPPAPPPEVTATARPCLCSVGRRGDGGKMAAAGALERSFVELSGAERERPRHFREFTVCSIGTANAVAGAVKYSESAGGFYYVESGKLFSVTRNRFIHWKTSGDTLELMEESLDINLLNNAIRLKFQNCSVLPGGVYVSETQNRVIILMLTNQTVHRLLLPHPSRMYRSELVVDSQMQSIFTDIGKVDFTDPCNYQLIPAVPGISPNSTASTAWLSSDGEALFALPCASGGIFVLKLPPYDIPGMVSVVELKQSSVMQRLLTGWMPTAIRGDQSPSDRPLSLAVHCVEHDAFIFALCQDHKLRMWSYKEQMCLMVADMLEYVPVKKDLRLTAGTGHKLRLAYSPTMGLYLGIYMHAPKRGQFCIFQLVSTESNRYSLDHISSLFTSQETLIDFALTSTDIWALWHDAENQTVVKYINFEHNVAGQWNPVFMQPLPEEEIVIRDDQDPREMYLQSLFTPGQFTNEALCKALQIFCRGTERNLDLSWSELKKEVTLAVENELQGSVTEYEFSQEEFRNLQQEFWCKFYACCLQYQEALSHPLALHLNPHTNMVCLLKKGYLSFLIPSSLVDHLYLLPYENLLTEDETTISDDVDIARDVICLIKCLRLIEESVTVDMSVIMEMSCYNLQSPEKAAEQILEDMITIDVENVMEDICSKLQEIRNPIHAIGLLIREMDYETEVEMEKGFNPAQPLNIRMNLTQLYGSNTAGYIVCRGVHKIASTRFLICRDLLILQQLLMRLGDAVIWGTGQLFQAQQDLLHRTAPLLLSYYLIKWGSECLATDVPLDTLESNLQHLSVLELTDSGALMANRFVSSPQTIVELFFQEVARKHIISHLFSQPKAPLSQTGLNWPEMITAITSYLLQLLWPSNPGCLFLECLMGNCQYVQLQDYIQLLHPWCQVNVGSCRFMLGRCYLVTGEGQKALECFCQAASEVGKEEFLDRLIRSEDGEIVSTPRLQYYDKVLRLLDVIGLPELVIQLATSAITEAGDDWKSQATLRTCIFKHHLDLGHNSQAYEALTQIPDSSRQLDCLRQLVVVLCERSQLQDLVEFPYVNLHNEVVGIIESRARAVDLMTHNYYELLYAFHIYRHNYRKAGTVMFEYGMRLGREVRTLRGLEKQGNCYLAALNCLRLIRPEYAWIVQPVSGAVYDRPGASPKRNHDGECTAAPTNRQIEILELEDLEKECSLARIRLTLAQHDPSAVAVAGSSSAEEMVTLLVQAGLFDTAISLCQTFKLPLTPVFEGLAFKCIKLQFGGEAAQAEAWAWLAANQLSSVITTKESSATDEAWRLLSTYLERYKVQNNLYHHCVINKLLSHGVPLPNWLINSYKKVDAAELLRLYLNYDLLEEAVDLVSEYVDAVLGKGHQYFGIEFPLSATAPMVWLPYSSIDQLLQALGENSANSHNIALSQKILDKLEDYQQKVDKATRDLLYRRTL

SEQ ID NO: 58804 - protein, 224 aa, Homo sapiens
  Payload ID: 11493
  Gene Symbol: NUP160
  Gene Name: nucleoporin 160kDa
  Uniprot ID: Q12769
  ENSP ID: ENSP00000431495
MLHLSAAPPAPPPEVTATARPCLCSVGRRGDGGKMAAAGALERSFVELSGAERERPRHFREFTVCSIGTANAVAGAVKYSESAGGFYYVESGKLFSVTRNRFIHWKTSGDTLELMEESLDINLLNNAIRLKFQNCSVLPGGVYVSETQNRVIILMLTNQTVHRLLLPHPSRMYRSVSWLSAISFISQITLGVTNVVLERCLLELKEIWILVIPHQAYFDSYRLK

SEQ ID NO: 58805 - protein, 1123 aa, Homo sapiens
  Payload ID: 11493
  Gene Symbol: NUP160
  Gene Name: nucleoporin 160kDa
  ENSP ID: ENSP00000432367
  MOD_RES (1)..(1): Any amino acid
XGDGGKMAAAGALERSFVELSGAERERPRHFREFTVCSIGTANAVAGAVKYSESAGGFYYVESGKLFSVTRNRFIHWKTSGDTLELMEESLDINLLNNAIRLKFQNCSVLPGGVYVSETQNRVIILMLTNQTVHRLLLPHPSRMYRSELVVDSQMQSIFTDIGKVDFTDPCNYQLIPAVPGISPNSTASTAWLSSDGEALFALPCASGGIFVLKLPPYDIPGMVSVVELKQSSVMQRLLTGWMPTAIRGDQSPSDRPLSLAVHCVEHDAFIFALCQDHKLRMWSYKEQMCLMVADMLEYVPVKKDLRLTAGTGHKLRLAYSPTMGLYLGIYMHAPKRGQFCIFQLVSTESNRYSLDHISSLFTSQETLIDFALTSTDIWALWHDAENQTVVKYINFEHNVAGQWNPVFMQPLPEEEIVIRDDQDPREMYLQSLFTPGQFTNEALCKALQIFCRGTERNLDLSWSELKKEVTLAVENELQGSVTEYEFSQEEFRNLQQEFWCKFYACCLQYQEALSHPLALHLNPHTNMVCLLKKGYLSFLIPSSLVDHLYLLPYENLLTEDETTISDDVDIARDVICLIKCLRLIEESVTVDMSVIMEMSCYNLQSPEKAAEQILEDMITIDVENVMEDICSKLQEIRNPIHAIGLLIREMDYETEVEMEKGFNPAQPLNIRMNLTQLYGSNTAGYIVCRGVHKIASTRFLICRDLLILQQLLMRLGDAVIWGTGQLFQAQQDLLHRTAPLLLSYYLIKWGSECLATDVPLDTLESNLQHLSVLELTDSGALMANRFVSSPQTIVELFFQEVARKHIISHLFSQPKAPLSQTGLNWPEMITAITSYLLQLLWPSNPGCLFLECLMGNCQYVQLQDYIQLLHPWCQVNVGSCRFMLGRCYLVTGEGQKALECFCQAASEVGKEEFLDRLIRSEDGEIVSTPRLQYYDKVLRLLDVIGLPELVIQLATSAITEAGDDWKSQATLRTCIFKHHLDLGHNSQAYEALTQIPDSSRQLDCLRQLVVVLCERSQLQDLVEFPYVNLHNEVVGIIESRARAVDLMTHNYYELLYAFHIYRHNYRKAGTVMFEYGMRLGREVRTLRGLEKQGNCYLAALNCLRLIRPEYAWIVQPVSGAVV

SEQ ID NO: 58806 - protein, 1314 aa, Homo sapiens
  Payload ID: 11493
  Gene Symbol: NUP160
  Gene Name: nucleoporin 160kDa
  ENSP ID: ENSP00000433590
  MOD_RES (1)..(1): Any amino acid
XAAGALERSFVELSGAERERPRHFREFTVCSIGTANAVAGAVKYSESAGGFYYVESGKLFSVTRNRFIHWKTSGDTLELMEESLDINLLNNAIRLKFQNCSVLPGGVYVSETQNRVIILMLTNQTVHRLLLPHPSRMYRSELVVDSQMQSIFTDIGKVDFTDPCNYQLIPAVPGISPNSTASTAWLSSDGEALFALPCASGGIFVLKLPPYDIPGMVSVVELKQSSVMQRLLTGWMPTAIRGDQSPSDRPLSLAVHCVEHDAFIFALCQDHKLRMWSYKEQMCLMVADMLEYVPVKKDLRLTAGTGHKLRLAYSPTMGLYLGIYMHAPKRGQFCIFQLVSTESNRYSLDHISSLFTSQETLIDFALTSTDIWALWHDAENQTVVKYINFEHNVAGQWNPVFMQPLPEEEIVIRDDQDPREMYLQSLFTPGQFTNEALCKALQIFCRGTERNLDLSWSELKKEVTLAVENELQGSVTEYEFSQEEFRNLQQEFWCKFYACCLQYQEALSHPLALHLNPHTNMVCLLKKGYLSFLIPSSLVDHLYLLPYENLLTEDETTISDDVDIARDVICLIKCLRLIEESVTVDMSVIMEMSCYNLQSPEKAAEQILEDMITIDVENVMEDICSKLQEIRNPIHAIGLLIREMDYETEVEMEKGFNPAQPLNIRMNLTQLYGSNTAGYIVCRGVHKIASTRFLICRDLLILQQLLMRLGDAVIWGTGQLFQAQQDLLHRTAPLLLSYYLIKWGSECLATDVPLDTLESNLQHLSVLELTDSGALMANRFVSSPQTIVELFFQEVARKHIISHLFSQPKAPLSQTGLNWPEMITAITSYLLQLLWPSNPGCLFLECLMGNCQYVQLQDYIQLLHPWCQVNVGSCRFMLGRCYLVTGEGQKALECFCQAASEVGKEEFLDRLIRSEDGEIVSTPRLQYYDKVLRLLDVIGLPELVIQLATSAITEAGDDWKSQATLRTCIFKHHLDLGHNSQAYEALTQIPDSSRQLDCLRQLVVVLCERSQLQDLVEFPYVNLHNEVVGIIESRARAVDLMTHNYYELLYAFHIYRHNYRKAGTVMFEYGMRLGREVRTLRGLEKQGNCYLAALNCLRLIRPEYAWIVQPVSGAVYDRPGASPKRNHDGECTAAPTNRQIEILELEDLEKECSLARIRLTLAQHDPSAVAVAGSSSAEEMVTLLVQAGLFDTAISLCQTFKLPLTPVFEGLAFKCIKLQFGGEAAQAEAWAWLAANQLSSVITTKESSATDEAWRLLSTYLERYKVQNNLYHHCVINKLLSHGVPLPNWLINSYKDYQQKVDKATRDLLYRRTL

SEQ ID NO: 58807 - protein, 102 aa, Homo sapiens
  Payload ID: 11493
  Gene Symbol: NUP160
  Gene Name: nucleoporin 160kDa
  ENSP ID: ENSP00000433964
DGGKMAAAGALERSFVELSGAERERPRHFREFTVCSIGTANAVAGAVKYSESAGGFYYVESGKLFSVTRNRFIHWYGVSRGTETEFSNATIAYRLDANSYQG

SEQ ID NO: 58808 - protein, 1749 aa, Homo sapiens
  Payload ID: 11494
  Gene Symbol: NUP188
  Gene Name: nucleoporin 188kDa
  Uniprot ID: Q5SRE5
  ENSP ID: ENSP00000361658
MAAAAGGPCVRSSRELWTILLGRSALRELSQIEAELNKHWRRLLEGLSYYKPPSPSSAEKVKANKDVASPLKELGLRISKFLGLDEEQSVQLLQCYLQEDYRGTRDSVKTVLQDERQSQALILKIADYYYEERTCILRCVLHLLTYFQDERHPYRVEYADCVDKLEKELVSKYRQQFEELYKTEAPTWETHGNLMTERQVSRWFVQCLREQSMLLEIIFLYYAYFEMAPSDLLVLTKMFKEQGFGSRQTNRHLVDETMDPFVDRIGYFSALILVEGMDIESLHKCALDDRRELHQFAQDGLICQDMDCLMLTFGDIPHHAPVLLAWALLRHTLNPEETSSVVRKIGGTAIQLNVFQYLTRLLQSLASGGNDCTTSTACMCVYGLLSFVLTSLELHTLGNQQDIIDTACEVLADPSLPELFWGTEPTSGLGIILDSVCGMFPHLLSPLLQLLRALVSGKSTAKKVYSFLDKMSFYNELYKHKPHDVISHEDGTLWRRQTPKLLYPLGGQTNLRIPQGTVGQVMLDDRAYLVRWEYSYSSWTLFTCEIEMLLHVVSTADVIQHCQRVKPIIDLVHKVISTDLSIADCLLPITSRIYMLLQRLTTVISPPVDVIASCVNCLTVLAARNPAKVWTDLRHTGFLPFVAHPVSSLSQMISAEGMNAGGYGNLLMNSEQPQGEYGVTIAFLRLITTLVKGQLGSTQSQGLVPCVMFVLKEMLPSYHKWRYNSHGVREQIGCLILELIHAILNLCHETDLHSSHTPSLQFLCICSLAYTEAGQTVINIMGIGVDTIDMVMAAQPRSDGAEGQGQGQLLIKTVKLAFSVTNNVIRLKPPSNVVSPLEQALSQHGAHGNNLIAVLAKYIYHKHDPALPRLAIQLLKRLATVAPMSVYACLGNDAAAIRDAFLTRLQSKIEDMRIKVMILEFLTVAVETQPGLIELFLNLEVKDGSDGSKEFSLGMWSCLHAVLELIDSQQQDRYWCPPLLHRAAIAFLHALWQDRRDSAMLVLRTKPKFWENLTSPLFGTLSPPSETSEPSILETCALIMKIICLEIYYVVKGSLDQSLKDTLKKFSIEKRFAYWSGYVKSLAVHVAETEGSSCTSLLEYQMLVSAWRMLLIIATTHADIMHLTDSVVRRQLFLDVLDGTKALLLVPASVNCLRLGSMKCTLLLILLRQWKRELGSVDEILGPLTEILEGVLQADQQLMEKTKAKVFSAFITVLQMKEMKVSDIPQYSQLVLNVCETLQEEVIALFDQTRHSLALGSATEDKDSMETDDCSRSRHRDQRDGVCVLGLHLAKELCEVDEDGDSWLQVTRRLPILPTLLTTLEVSLRMKQNLHFTEATLHLLLTLARTQQGATAVAGAGITQSICLPLLSVYQLSTNGTAQTPSASRKSLDAPSWPGVYRLSMSLMEQLLKTLRYNFLPEALDFVGVHQERTLQCLNAVRTVQSLACLEEADHTVGFILQLSNFMKEWHFHLPQLMRDIQVNLGYLCQACTSLLHSRKMLQHYLQNKNGDGLPSAVAQRVQRPPSAASAAPSSSKQPAADTEASEQQALHTVQYGLLKILSKTLAALRHFTPDVCQILLDQSLDLAEYNFLFALSFTTPTFDSEVAPSFGTLLATVNVALNMLGELDKKKEPLTQAVGLSTQAEGTRTLKSLLMFTMENCFYLLISQAMRYLRDPAVHPRDKQRMKQELSSELSTLLSSLSRYFRRGAPSSPATGVLPSPQGKSTSLSKASPESQEPLIQLVQAFVRHMQR

SEQ ID NO: 58809 - protein, 2012 aa, Homo sapiens
  Payload ID: 11495
  Gene Symbol: NUP205
  Gene Name: nucleoporin 205kDa
  Uniprot ID: Q92621
  ENSP ID: ENSP00000285968
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKETSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGLLRISRN

SEQ ID NO: 58810 - protein, 273 aa, Homo sapiens
  Payload ID: 11495
  Gene Symbol: NUP205
  Gene Name: nucleoporin 205kDa
  ENSP ID: ENSP00000475318
  MOD_RES (1)..(1): Any amino acid
XHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPAFYIL

SEQ ID NO: 58811 - protein, 71 aa, Homo sapiens
  Payload ID: 11495
  Gene Symbol: NUP205
  Gene Name: nucleoporin 205kDa
  ENSP ID: ENSP00000475539
  MOD_RES (1)..(1): Any amino acid
XELKKPVSTTNLQDPGVLGCPRTCLHAILNILEKGTEGRTGPVAVRESPQLAELCYQRQSFTMLSRLVSNS

SEQ ID NO: 58812 - protein, 184 aa, Homo sapiens
  Payload ID: 11495
  Gene Symbol: NUP205
  Gene Name: nucleoporin 205kDa
  ENSP ID: ENSP00000475665
  MOD_RES (1)..(1): Any amino acid
XSQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQLCACSDTSGPTMRYLRTSQDFLFSQLQYLPFSNKEYEISMLNQMSWLMKTASIELRVTSLN

SEQ ID NO: 58813 - protein, 42 aa, Homo sapiens
  Payload ID: 11495
  Gene Symbol: NUP205
  Gene Name: nucleoporin 205kDa
  ENSP ID: ENSP00000475877
  MOD_RES (1)..(1): Any amino acid
XQSVMPAGVDKISTAQKYVLARRRLVKVINNRAKLLSLCSWG

SEQ ID NO: 58814 - protein, 1887 aa, Homo sapiens
  Payload ID: 11496
  Gene Symbol: NUP210
  Gene Name: nucleoporin 210kDa
  Uniprot ID: Q8TEM1
  ENSP ID: ENSP00000254508
MAARGRGLLLLTLSVLLAAGPSAAAAKLNIPKVLLPFTRATRVNFTLEASEGCYRWLSTRPEVASIEPLGLDEQQCSQKAVVQARLTQPARLTSIIFAEDITTGQVLRCDAIVDLIHDIQIVSTTRELYLEDSPLELKIQALDSEGNTFSTLAGLVFEWTIVKDSEADRFSDSHNALRILTFLESTYIPPSYISEMEKAAKQGDTILVSGMKTGSSKLKARIQEAVYKNVRPAEVRLLILENILLNPAYDVYLMVGTSIHYKVQKIRQGKITELSMPSDQYELQLQNSIPGPEGDPARPVAVLAQDTSMVTALQLGQSSLVLGHRSIRMQGASRLPNSTIYVVEPGYLGFTVHPGDRWVLETGRLYEITIEVFDKFSNKVYVSDNIRIETVLPAEFFEVLSSSQNGSYHRIRALKRGQTAIDAALTSVVDQDGGVHILQVPVWNQQEVEIHIPITLYPSILTFPWQPKTGAYQYTIRAHGGSGNFSWSSSSHLVATVTVKGVMTTGSDIGFSVIQAHDVQNPLHFGEMKVYVIEPHSMEFAPCQVEARVGQALELPLRISGLMPGGASEVVTLSDCSHFDLAVEVENQGVFQPLPGRLPPGSEHCSGIRVKAEAQGSTTLLVSYRHGHVHLSAKITIAAYLPLKAVDPSSVALVTLGSSKEMLFEGGPRPWILEPSKFFQNVTAEDTDSIGLALFAPHSSRNYQQHWILVTCQALGEQVIALSVGNKPSLTNPFPAVEPAVVKFVCAPPSRLTLAPVYTSPQLDMSCPLLQQNKQVVPVSSHRNPRLDLAAYDQEGRRFDNFSSLSIQWESTRPVLASIEPELPMQLVSQDDESGQKKLHGLQAILVHEASGTTAITATATGYQESHLSSARTKQPHDPLVPLSASIELILVEDVRVSPEEVTIYNHPGIQAELRIREGSGYFFLNTSTADVVKVAYQEARGVAMVHPLLPGSSTIMIHDLCLVFPAPAKAVVYVSDIQELYIRVVDKVEIGKTVKAYVRVLDLHKKPFLAKYFPFMDLKLRAASPIITLVALDEALDNYTITFLIRGVAIGQTSLTASVTNKAGQRINSAPQQIEVFPPFRLMPRKVTLLIGATMQVTSEGGPQPQSNILFSISNESVALVSAAGLVQGLAIGNGTVSGLVQAVDAETGKVVIISQDLVQVEVLLLRAVRIRAPIMRMRTGTQMPIYVTGITNHQNPFSFGNAVPGLTFHWSVTKRDVLDLRGRHHEASIRLPSQYNFAMNVLGRVKGRTGLRVVVKAVDPTSGQLYGLARELSDEIQVQVFEKLQLLNPEIEAEQILMSPNSYIKLQTNRDGAASLSYRVLDGPEKVPVVHVDEKGFLASGSMIGTSTIEVIAQEPFGANQTIIVAVKVSPVSYLRVSMSPVLHTQNKEALVAVPLGMTVTFTVHFHDNSGDVFHAHSSVLNFATNRDDFVQIGKGPTNNTCVVRTVSVGLTLLRVWDAEHPGLSDFMPLPVLQAISPELSGAMVVGDVLCLATVLTSLEGLSGTWSSSANSILHIDPKTGVAVARAVGSVTVYYEVAGHLRTYKEVVVSVPQRIMARHLHPIQTSFQEATASKVIVAVGDRSSNLRGECTPTQREVIQALHPETLISCQSQFKPAVFDFPSQDVFTVEPQFDTALGQYFCSITMHRLTDKQRKHLSMKKTALVVSASLSSSHFSTEQVGAEVPFSPGLFADQAEILLSNHYTSSEIRVFGAPEVLENLEVKSGSPAVLAFAKEKSFGWPSFITYTVGVLDPAAGSQGPLSTTLTFSSPVTNQAIAIPVTVAFVVDRRGPGPYGASLFQHFLDSYQVMFFTLFALLAGTAVMIIAYHTVCTPRDLAVPAALTPRASPGHSPHYFAASSPTSPNALPPARKASPPSGLWSPAYASH

SEQ ID NO: 58815 - protein, 1736 aa, Homo sapiens
  Payload ID: 11497
  Gene Symbol: NUP210L
  Gene Name: nucleoporin 210kDa-like
  Uniprot ID: Q5VU65
  ENSP ID: ENSP00000271854
MTGCPASSRRRGFGLFFFLRLHRLLLLFLVLRGTLANKLNVPQVLLPFGREPGRVPFLLEAQRGCYTWHSTHHDAVTVEPLYENGTLCSQKAVLIAESTQPIRLSSIILAREIVTDHELRCDVKVDVINSIEIVSRARELYVDDSPLELMVRALDAEGNTFSSLAGMMFEWSIAQDNESAREELSSKIRILKYSEAEYAPPIYIAEMEKEEKQGDVILVSGIRTGAAVVKVRIHEPFYKKVAAALIRLLVLENIFLIPSHDIYLLVGTYIKYQVAKMVQGRVTEVKFPLEHYILELQDHRVALNGSHSEKVAILDDKTAMVTASQLGQTNLVFVHKNVHMRSVSGLPNCTIYVVEPGFLGFTVQPGNRWSLEVGQVYVITVDVFDKSSTKVYISDNLRITYDFPKEYFEEQLTTVNGSYHIVKALKDGVVVINASLTSIIYQNKDIQPIKFLIKHQQEVKIYFPIMLTPKFLAFPHHPMGMLYRYKVQVEGGSGNFTWTSSNETVVIVTTKGVVTAGQVRGNSTVLARDVQNPFRYGEIKIHVLKLNKMELLPFHADVEIGQIIEIPIAMYHINKETKEAMAFTDCSHLSLDLNMDKQGVFTLLKEGIQRPGPMHCSSTHIAAKSLGHTLVTVSVNECDKYLESSATFAAYEPLKALNPVEVALVTWQSVKEMVFEGGPRPWILEPSRFFLELNAEKTEKIGIAQVWLPSKRKQNQYIYRIQCLDLGEQVLTFRIGNHPGVLNPSPAVEVLQVRFICAHPASMSVTPVYKVPAGAQPCPLPQHNKWLIPVSRLRDTVLELAVFDQHRRKFDNFSSLMLEWKSSNETLAHFEDYKSVEMVAKDDGSGQTRLHGHQILKVHQIKGTVLIGVNFVGYSEKKSPKEISNLPRSVDVELLLVDDVTVVPENATIYNHPDVKETFSLVEGSGYFLVNSSEQGVVTITYMEAESSVELVPLHPGFFTLEVYDLCLAFLGPATAHLRVSDIQELELDLIDKVEIDKTVLVTVRVLGSSKRPFQNKYFRNMELKLQLASAIVTLTPMEQQDEYSENYILRATTIGQTTLVAIAKDKMGRKYTSTPRHIEVFPPFRLLPEKMTLIPMNMMQVMSEGGPQPQSIVHFSISNQTVAVVNRRGQVTGKIVGTAVVHGTIQTVNEDTGKVIVFSQDEVQIEVVQLRAVRILAAATRLITATKMPVYVMGVTSTQTPFSFSNANPGLTFHWSMSKRDVLDLVPRHSEVFLQLPVEHNFAMVVHTKAAGRTSIKVTVHCMNSSSGQFEGNLLELSDEVQILVFEKLQLFYPECQPEQILMPINSQLKLHTNREGAAFVSSRVLKCFPNSSVIEEDGEGLLKAGSIAGTAVLEVTSIEPFGVNQTTITGVQVAPVTYLRVSSQPKLYTAQGRTLSAFPLGMSLTFTVQFYNSIGEKFHTHNTQLYLALNRDDLLHIGPGNKNYTYMAQAVNRGLTLVGLWDRRHPGMADYIPVAVEHAIEPDTKLTFVGDIICFSTHLVSQHGEPGIWMISANNILQTDIVTGVGVARSPGTAMIFHDIPGVVKTYREVVVNASSRLMLSYDLKTYLTNTLNSTVFKLFITTGRNGVNLKGFCTPNQALAITKVLLPATLMLCHVQFSNTLLDIPASKVFQVHSDFSMEKDHCEDSAILKRFTGSYQILLLTLFAVLASTASIFLAYNAFLNKIQTVPVVYVPTLGTPQPGFFNSTSSPPHFMSLQPPLAQSRLQHWLWSIRH

SEQ ID NO: 58816 - protein, 669 aa, Homo sapiens
  Payload ID: 11497
  Gene Symbol: NUP210L
  Gene Name: nucleoporin 210kDa-like
  ENSP ID: ENSP00000357541
MGRKYTSTPRHIEVFPPFRLLPEKMTLIPMNMMQVMSEGGPQPQSIVHFSISNQTVAVVNRRGQVTGKIVGTAVVHGTIQTVNEDTGKVIVFSQDEVQIEVVQLRAVRILAAATRLITATKMPVYVMGVTSTQTPFSFSNANPGLTFHWSMSKRDVLDLVPRHSEVFLQLPVEHNFAMVVHTKAAGRTSIKVTVHCMNSSSGQFEGNLLELSDEVQILVFEKLQLFYPECQPEQILMPINSQLKLHTNREGAAFVSSRVLKCFPNSSVIEEDGEGLLKAGSIAGTAVLEVTSIEPFGVNQTTITGVQVAPVTYLRVSSQPKLYTAQGRTLSAFPLGMSLTFTVQFYNSIGEKFHTHNTQLYLALNRDDLLHIGPGNKNYTYMAQAVNRGLTLVGLWDRRHPGMADYIPVAVEHAIEPDTKLTFVGDIICFSTHLVSQHGEPGIWMISANNILQTDIVTGVGVARSPGTAMIFHDIPGVVKTYREVVVNASSRLMLSYDLKTYLTNTLNSTVFKLFITTGRNGVNLKGFCTPNQALAITKVLLPATLMLCHVQFSNTLLDIPASKVFQVHSDFSMEKDHCEDSAILKRFTGSYQILLLTLFAVLASTASIFLAYNAFLNKIQTVPVVYVPTLGTPQPGFFNSTSSPPHFMSLQPPLAQSRLQHWLWSIRH

SEQ ID NO: 58817 - protein, 1888 aa, Homo sapiens
  Payload ID: 11497
  Gene Symbol: NUP210L
  Gene Name: nucleoporin 210kDa-like
  Uniprot ID: Q5VU65
  ENSP ID: ENSP00000357547
MTGCPASSRRRGFGLFFFLRLHRLLLLFLVLRGTLANKLNVPQVLLPFGREPGRVPFLLEAQRGCYTWHSTHHDAVTVEPLYENGTLCSQKAVLIAESTQPIRLSSIILAREIVTDHELRCDVKVDVINSIEIVSRARELYVDDSPLELMVRALDAEGNTFSSLAGMMFEWSIAQDNESAREELSSKIRILKYSEAEYAPPIYIAEMEKEEKQGDVILVSGIRTGAAVVKVRIHEPFYKKVAAALIRLLVLENIFLIPSHDIYLLVGTYIKYQVAKMVQGRVTEVKFPLEHYILELQDHRVALNGSHSEKVAILDDKTAMVTASQLGQTNLVFVHKNVHMRSVSGLPNCTIYVVEPGFLGFTVQPGNRWSLEVGQVYVITVDVFDKSSTKVYISDNLRITYDFPKEYFEEQLTTVNGSYHIVKALKDGVVVINASLTSIIYQNKDIQPIKFLIKHQQEVKIYFPIMLTPKFLAFPHHPMGMLYRYKVQVEGGSGNFTWTSSNETVVIVTTKGVVTAGQVRGNSTVLARDVQNPFRYGEIKIHVLKLNKMELLPFHADVEIGQIIEIPIAMYHINKETKEAMAFTDCSHLSLDLNMDKQGVFTLLKEGIQRPGPMHCSSTHIAAKSLGHTLVTVSVNECDKYLESSATFAAYEPLKALNPVEVALVTWQSVKEMVFEGGPRPWILEPSRFFLELNAEKTEKIGIAQVWLPSKRKQNQYIYRIQCLDLGEQVLTFRIGNHPGVLNPSPAVEVLQVRFICAHPASMSVTPVYKVPAGAQPCPLPQHNKWLIPVSRLRDTVLELAVFDQHRRKFDNFSSLMLEWKSSNETLAHFEDYKSVEMVAKDDGSGQTRLHGHQILKVHQIKGTVLIGVNFVGYSEKKSPKEISNLPRSVDVELLLVDDVTVVPENATIYNHPDVKETFSLVEGSGYFLVNSSEQGVVTITYMEAESSVELVPLHPGFFTLEVYDLCLAFLGPATAHLRVSDIQELELDLIDKVEIDKTVLVTVRVLGSSKRPFQNKYFRNMELKLQLASAIVTLTPMEQQDEYSENYILRATTIGQTTLVAIAKDKMGRKYTSTPRHIEVFPPFRLLPEKMTLIPMNMMQVMSEGGPQPQSIVHFSISNQTVAVVNRRGQVTGKIVGTAVVHGTIQTVNEDTGKVIVFSQDEVQIEVVQLRAVRILAAATRLITATKMPVYVMGVTSTQTPFSFSNANPGLTFHWSMSKRDVLDLVPRHSEVFLQLPVEHNFAMVVHTKAAGRTSIKVTVHCMNSSSGQFEGNLLELSDEVQILVFEKLQLFYPECQPEQILMPINSQLKLHTNREGAAFVSSRVLKCFPNSSVIEEDGEGLLKAGSIAGTAVLEVTSIEPFGVNQTTITGVQVAPVTYLRVSSQPKLYTAQGRTLSAFPLGMSLTFTVQFYNSIGEKFHTHNTQLYLALNRDDLLHIGPGNKNYTYMAQAVNRGLTLVGLWDRRHPGMADYIPVAVEHAIEPDTKLTFVGDIICFSTHLVSQHGEPGIWMISANNILQTDIVTGVGVARSPGTAMIFHDIPGVVKTYREVVVNASSRLMLSYDLKTYLTNTLNSTVFKLFITTGRNGVNLKGFCTPNQALAITKVLLPATLMLCHVQFSNTLLDIPASKVFQVHSDFSMEKGVYVCIIKVRPQSEELLQALSVADTSVYGWATLVSERSKNGMQRILIPFIPAFYINQSELVLSHKQDIGEIRVLGVDRVLRKLEVISSSPVLVVAGHSHSPLTPGLAIYSVRVVNFTSFQQMASPVFINISCVLTSQSEAVVVRAMKDKLGADHCEDSAILKRFTGSYQILLLTLFAVLASTASIFLAYNAFLNKIQTVPVVYVPTLGTPQPGFFNSTSSPPHFMSLQPPLAQSRLQHWLWSIRH

SEQ ID NO: 58818 - protein, 2090 aa, Homo sapiens
  Payload ID: 11498
  Gene Symbol: NUP214
  Gene Name: nucleoporin 214kDa
  Uniprot ID: P35658
  ENSP ID: ENSP00000352400
MGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKPSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 58819 - protein, 2080 aa, Homo sapiens
  Payload ID: 11498
  Gene Symbol: NUP214
  Gene Name: nucleoporin 214kDa
  Uniprot ID: P35658
  ENSP ID: ENSP00000396576
MGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKPSFPPSTSAVKVNLSENSSQSAPPMSPFSSASKPAASGPLSHPTPLSAPPSSVPLKSSVLPSPSAGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 58820 - protein, 1519 aa, Homo sapiens
  Payload ID: 11498
  Gene Symbol: NUP214
  Gene Name: nucleoporin 214kDa
  ENSP ID: ENSP00000405014
MKPSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 58821 - protein, 967 aa, Homo sapiens
  Payload ID: 11498
  Gene Symbol: NUP214
  Gene Name: nucleoporin 214kDa
  ENSP ID: ENSP00000416934
  MOD_RES (1)..(1): Any amino acid
XKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGSLAMSLSPTLKGRLLLMRPKAGGGREQAAPGRKSNESRSLGHLCMERALTSPLKVWEQQQHHILRHARESECPHFRITVPTDFWFWDPE

SEQ ID NO: 58822 - protein, 145 aa, Homo sapiens
  Payload ID: 11498
  Gene Symbol: NUP214
  Gene Name: nucleoporin 214kDa
  ENSP ID: ENSP00000433606
  MOD_RES (1)..(1): Any amino acid
XGVPAFGSAPAFTSPLGSTGGKVFGEGTAAASAGGFGFGSSSNTTSFGTLASQNAPTFGSLSQQTSGFGTQSSGFSGFGSGTGGLSRVLVAGEAEGVSAGLSIPGTNRILSFFPEKCWSRLFRPTLPSKHIHPERNNRNQNSQGA

SEQ ID NO: 58823 - protein, 78 aa, Homo sapiens
  Payload ID: 11498
  Gene Symbol: NUP214
  Gene Name: nucleoporin 214kDa
  ENSP ID: ENSP00000433654
GEGTAAASAGGFGFGSSSNTTSFGTLASQNAPTFGSLSQQTSGFGTQSSGFSGFGSGTGGFSFGSNNSSVQGFGGWRS

SEQ ID NO: 58824 - protein, 187 aa, Homo sapiens
  Payload ID: 11498
  Gene Symbol: NUP214
  Gene Name: nucleoporin 214kDa
  ENSP ID: ENSP00000434223
  MOD_RES (1)..(1): Any amino acid
XARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPASLAPTPAASPVAPSAASFSFGSSGFKPTLESTPVPSVSAPNIAMKPSFPPSTSAVKVNLSEKFTAAATSTPVSSSQSAPPMSP

SEQ ID NO: 58825 - protein, 495 aa, Homo sapiens
  Payload ID: 11498
  Gene Symbol: NUP214
  Gene Name: nucleoporin 214kDa
  ENSP ID: ENSP00000435364
MKSSLLLRGVHFCFHLPGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAP

SEQ ID NO: 58826 - protein, 113 aa, Homo sapiens
  Payload ID: 11498
  Gene Symbol: NUP214
  Gene Name: nucleoporin 214kDa
  ENSP ID: ENSP00000435583
LQCLAALLLLGDPLGLEGCQHSVQPQPLQALWARREAKCSERALQLPAQEDSGLGAAATPHPSARSRVRMPPLSDHCPNRLLVLGPRVADSLVLDQAQEGSALGQITRKYPPF

SEQ ID NO: 58827 - protein, 52 aa, Homo sapiens
  Payload ID: 11498
  Gene Symbol: NUP214
  Gene Name: nucleoporin 214kDa
  ENSP ID: ENSP00000435874
MKFPIHHLALSCDNLTLSACMMSSEYGSIIAFFDVRTFSNEAKQQKRPFAYH

SEQ ID NO: 58828 - protein, 916 aa, Homo sapiens
  Payload ID: 11498
  Gene Symbol: NUP214
  Gene Name: nucleoporin 214kDa
  ENSP ID: ENSP00000436793
MKSSLLLRGVHFCFHLPGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 58829 - protein, 140 aa, Homo sapiens
  Payload ID: 11498
  Gene Symbol: NUP214
  Gene Name: nucleoporin 214kDa
  ENSP ID: ENSP00000437139
CKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGGL

SEQ ID NO: 58830 - protein, 326 aa, Homo sapiens
  Payload ID: 11499
  Gene Symbol: NUP35
  Gene Name: nucleoporin 35kDa
  Uniprot ID: Q8NFH5
  ENSP ID: ENSP00000295119
MAAFAVEPQGPALGSEPMMLGSPTSPKPGVNAQFLPGFLMGDLPAPVTPQPRSISGPSVGVMEMRSPLLAGGSPPQPVVPAHKDKSGAPPVRSIYDDISSPGLGSTPLTSRRQPNISVMQSPLVGVTSTPGTGQSMFSPASIGQPRKTTLSPAQLDPFYTQGDSLTSEDHLDDSWVTVFGFPQASASYILLQFAQYGNILKHVMSNTGNWMHIRYQSKLQARKALSKDGRIFGESIMIGVKPCIDKSVMESSDRCALSSPSLAFTPPIKTLGTPTQPGSTPRISTMRPLATAYKASTSDYQVISDRQTPKKDESLVSKAMEYMFGW

SEQ ID NO: 58831 - protein, 152 aa, Homo sapiens
  Payload ID: 11499
  Gene Symbol: NUP35
  Gene Name: nucleoporin 35kDa
  ENSP ID: ENSP00000364066
MAAFAVEPQGPALGSEPMMLGSPTSPKPGVNAQFLPGFLMGDLPAPVTPQPRSISGPSVGVMEMRSPLLAGGSPPQPVVPAHKDKSGAPPVRSIYDDISSPGLGSTPLTSRRQPNISVMQSPLVGVTSTPGTGFLKHLLPTYYYNLHSMGIS

SEQ ID NO: 58832 - protein, 309 aa, Homo sapiens
  Payload ID: 11499
  Gene Symbol: NUP35
  Gene Name: nucleoporin 35kDa
  Uniprot ID: Q8NFH5
  ENSP ID: ENSP00000387305
MMLGSPTSPKPGVNAQFLPGFLMGDLPAPVTPQPRSISGPSVGVMEMRSPLLAGGSPPQPVVPAHKDKSGAPPVRSIYDDISSPGLGSTPLTSRRQPNISVMQSPLVGVTSTPGTGQSMFSPASIGQPRKTTLSPAQLDPFYTQGDSLTSEDHLDDSWVTVFGFPQASASYILLQFAQYGNILKHVMSNTGNWMHIRYQSKLQARKALSKDGRIFGESIMIGVKPCIDKSVMESSDRCALSSPSLAFTPPIKTLGTPTQPGSTPRISTMRPLATAYKASTSDYQVISDRQTPKKDESLVSKAMEYMFGW

SEQ ID NO: 58833 - protein, 53 aa, Homo sapiens
  Payload ID: 11499
  Gene Symbol: NUP35
  Gene Name: nucleoporin 35kDa
  ENSP ID: ENSP00000393130
MMLGSPTSPKPGVNAQFLPGFLMGDLPAPVTPQPRSISGPSVGVMEMRSPLLA

SEQ ID NO: 58834 - protein, 76 aa, Homo sapiens
  Payload ID: 11499
  Gene Symbol: NUP35
  Gene Name: nucleoporin 35kDa
  ENSP ID: ENSP00000403819
MMLGSPTSPKPGVNAQFLPGFLMGDLPAPVTPQPRSISGPSVGVMEMRSPLLAGGSPPQPVVPAHKDKSGAPPVRS

SEQ ID NO: 58835 - protein, 136 aa, Homo sapiens
  Payload ID: 11499
  Gene Symbol: NUP35
  Gene Name: nucleoporin 35kDa
  ENSP ID: ENSP00000412311
MAAFAVEPQGPALGSEPMMLGSPTSPKPGVNAQFLPGFLMGDLPAPVTPQPRSISGPSVGVMEMRSPLLAGGSPPQPVVPAHKDKSGAPPVRSIYDDISSPGLGSTPLTSRRQGPQQGPDQLPRLECSGTVITLQP

SEQ ID NO: 58836 - protein, 115 aa, Homo sapiens
  Payload ID: 11499
  Gene Symbol: NUP35
  Gene Name: nucleoporin 35kDa
  ENSP ID: ENSP00000412554
MMLGSPTSPKPGVNAQFLPGFLMGDLPAPVTPQPRSISGPSVGVMEMRSPLLAGGSPPQPVVPAHKDKSGAPPVRSIYDDISSPGLGSTPLTSRRQPNISVMQSPLVGVTSTPGT

SEQ ID NO: 58837 - protein, 326 aa, Homo sapiens
  Payload ID: 11500
  Gene Symbol: NUP37
  Gene Name: nucleoporin 37kDa
  Uniprot ID: Q8NFH4
  ENSP ID: ENSP00000251074
MKQDASRNAAYTVDCEDYVHVVEFNPFENGDSGNLIAYGGNNYVVIGTCTFQEEEADVEGIQYKTLRTFHHGVRVDGIAWSPETRLDSLPPVIKFCTSAADMKIRLFTSDLQDKNEYKVLEGHTDFINGLVFDPKEGQEIASVSDDHTCRIWNLEGVQTAHFVLHSPGMSVCWHPEETFKLMVAEKNGTIRFYDLLAQQAILSLESEQVPLMSAHWCLKNTFKVGAVAGNDWLIWDITRSSYPQNKRPVHMDRACLFRWSTISENLFATTGYPGKMASQFQIHHLGHPQPILMGSVAVGSGLSWHRTLPLCVIGGDHKLLFWVTEV

SEQ ID NO: 58838 - protein, 31 aa, Homo sapiens
  Payload ID: 11500
  Gene Symbol: NUP37
  Gene Name: nucleoporin 37kDa
  ENSP ID: ENSP00000447284
IWNLEGVQTAHFVLHSPGMSVCWHPEETFKI

SEQ ID NO: 58839 - protein, 326 aa, Homo sapiens; identical to SEQ ID NO: 58837
  Payload ID: 11500
  Gene Symbol: NUP37
  Gene Name: nucleoporin 37kDa
  Uniprot ID: Q8NFH4
  ENSP ID: ENSP00000448054

SEQ ID NO: 58840 - protein, 208 aa, Homo sapiens
  Payload ID: 11500
  Gene Symbol: NUP37
  Gene Name: nucleoporin 37kDa
  ENSP ID: ENSP00000448086
MKQDASRNAAYTVDCEDYVHVVEFNPFENGDSGNLIAYGGNNYVVIGTCTFQEEEADVEGIQYKTLRTFHHGVRVDGIAWSPETRLDSLPPVIKFCTSAADMKIRLFTSDLQDKNEYKVLEGHTDFINGLVFDPKEGQEIASVSDDHTCSYPQNKRPVHMDRACLFRWSTISENLFATTGYPGKMASQFQIHHLGHPQPILMGSVAVG

SEQ ID NO: 58841 - protein, 51 aa, Homo sapiens
  Payload ID: 11500
  Gene Symbol: NUP37
  Gene Name: nucleoporin 37kDa
  ENSP ID: ENSP00000449982
MKQDASRNAAYTVDCEDYVHVVEFNPFENGDSGNLIAYGGNNYVVIGTCTF

SEQ ID NO: 58842 - protein, 380 aa, Homo sapiens
  Payload ID: 11501
  Gene Symbol: NUP43
  Gene Name: nucleoporin 43kDa
  Uniprot ID: Q8NFH3
  ENSP ID: ENSP00000342262
MEEIYAKFVSQKISKTRWRPLPPGSLQTAETFATGSWDNEENYISLWSIGDFGNLDSDGGFEGDHQLLCDIRHHGDVMDLQFFDQERIVAASSTGCVTVFLHHPNNQTLSVNQQWTTAHYHTGPGSPSYSSAPCTGVVCNNPEIVTVGEDGRINLFRADHKEAVRTIDNADSSTLHAVTFLRTPEILTVNSIGQLKIWDFRQQGNEPSQILSLTGDRVPLHCVDRHPNQQHVVATGGQDGMLSIWDVRQGTMPVSLLKAHEAEMWEVHFHPSNPEHLFTCSEDGSLWHWDASTDVPEKSSLFHQGGRSSTFLSHSISNQANVHQSVISSWLSTDPAKDRIEITSLLPSRSLSVNTLDVLGPCLVCGTDAEAIYVTRHLFS

SEQ ID NO: 58843 - protein, 187 aa, Homo sapiens
  Payload ID: 11501
  Gene Symbol: NUP43
  Gene Name: nucleoporin 43kDa
  ENSP ID: ENSP00000356372
MEEIYAKFVSQKISKTRWRPLPPGSLQTAETFATGSWDNEENYISLWSIGDFGNLDSDGGFEGDHQLLCDIRHHGDVMDLQFFDQERIVAASSTGCVTVFLHHPNNQTLSVNQQWTTAHYHTGPGSPSYSSAPCTGVVCNNPEIVTVGEDGRINLFRADHKEAVRTIGLVTECHSTVLIDIPTNSML

SEQ ID NO: 58844 - protein, 284 aa, Homo sapiens
  Payload ID: 11501
  Gene Symbol: NUP43
  Gene Name: nucleoporin 43kDa
  Uniprot ID: Q8NFH3
  ENSP ID: ENSP00000356374
MEEIYAKFVSQKISKTRWRPLPPGSLQTAETFATGSWDNEENYISLWSIGDFGNLDSDGGFEGDHQLLCDIRHHGDVMDLQFFDQERIVAASSTGCVTVFLHHPNNQTLSVNQQWTTAHYHTGPGSPSYSSAPCTGVVCNNPEIVTVGEDGRINLFRADHKEAVRTIVWEVHFHPSNPEHLFTCSEDGSLWHWDASTDVPEKSSLFHQGGRSSTFLSHSISNQANVHQSVISSWLSTDPAKDRIEITSLLPSRSLSVNTLDVLGPCLVCGTDAEAIYVTRHLFS

SEQ ID NO: 58845 - protein, 117 aa, Homo sapiens
  Payload ID: 11501
  Gene Symbol: NUP43
  Gene Name: nucleoporin 43kDa
  ENSP ID: ENSP00000385078
MEEIYAKFVSQKISKTRWRPLPPGSLQTAETFATGSWDNEENYISLWSIGDFGNLDSDGGFEGDHQLLCDIRHHGDVMDLQFFDQERIVAASSTGCVTVFLHHPNNQTMQIVVHSML

SEQ ID NO: 58846 - protein, 178 aa, Homo sapiens
  Payload ID: 11501
  Gene Symbol: NUP43
  Gene Name: nucleoporin 43kDa
  ENSP ID: ENSP00000438031
MEEIYAKFVSQKISKTRWRPLPPGSLQTAETFATGSWDNETKLSVLQENYISLWSIGDFGNLDSDGGFEGDHQLLCDIRHHGDVMDLQFFDQERIVAASSTGCVTVFLHHPNNQTLSVNQQWTTAHYHTGPGSPSYSSAPCTGVVCNNPEIVTVGEDGRINLFRADHKEAVRTIDNAD

SEQ ID NO: 58847 - protein, 468 aa, Homo sapiens
  Payload ID: 11502
  Gene Symbol: NUP50
  Gene Name: nucleoporin 50kDa
  Uniprot ID: Q9UKX7
  ENSP ID: ENSP00000345895
MAKRNAEKELTDRNWDQEDEAEEVGTFSMASEEVLKNRAIKKAKRRNVGFESDTGGAFKGFKGLVVPSGGGRFSGFGSGAGGKPLEGLSNGNNITSAPPFASAKAAADPKVAFGSLAANGPTTLVDKVSNPKTNGDSQQPSSSGLASSKACVGNAYHKQLAALNCSVRDWIVKHVNTNPLCDLTPIFKDYEKYLANIEQQHGNSGRNSESESNKVAAETQSPSLFGSTKLQQESTFLFHGNKTEDTPDKKMEVASEKKTDPSSLGATSASFNFGKKVDSSVLGSLSSVPLTGFSFSPGNSSLFGKDTTQSKPVSSPFPTKPLEGQAEGDSGECKGGDEEENDEPPKVVVTEVKEEDAFYSKKCKLFYKKDNEFKEKGIGTLHLKPTANQKTQLLVRADTNLGNILLNVLIPPNMPCTRTGKNNVLIVCVPNPPIDEKNATMPVTMLIRVKTSEDADELHKILLEKKDA

SEQ ID NO: 58848 - protein, 440 aa, Homo sapiens
  Payload ID: 11502
  Gene Symbol: NUP50
  Gene Name: nucleoporin 50kDa
  Uniprot ID: Q9UKX7
  ENSP ID: ENSP00000379403
MASEEVLKNRAIKKAKRRNVGFESDTGGAFKGFKGLVVPSGGGRFSGFGSGAGGKPLEGLSNGNNITSAPPFASAKAAADPKVAFGSLAANGPTTLVDKVSNPKTNGDSQQPSSSGLASSKACVGNAYHKQLAALNCSVRDWIVKHVNTNPLCDLTPIFKDYEKYLANIEQQHGNSGRNSESESNKVAAETQSPSLFGSTKLQQESTFLFHGNKTEDTPDKKMEVASEKKTDPSSLGATSASFNFGKKVDSSVLGSLSSVPLTGFSFSPGNSSLFGKDTTQSKPVSSPFPTKPLEGQAEGDSGECKGGDEEENDEPPKVVVTEVKEEDAFYSKKCKLFYKKDNEFKEKGIGTLHLKPTANQKTQLLVRADTNLGNILLNVLIPPNMPCTRTGKNNVLIVCVPNPPIDEKNATMPVTMLIRVKTSEDADELHKILLEKKDA

SEQ ID NO: 58849 - protein, 440 aa, Homo sapiens; identical to SEQ ID NO: 58848
  Payload ID: 11502
  Gene Symbol: NUP50
  Gene Name: nucleoporin 50kDa
  Uniprot ID: Q9UKX7
  ENSP ID: ENSP00000385555

SEQ ID NO: 58850 - protein, 30 aa, Homo sapiens
  Payload ID: 11502
  Gene Symbol: NUP50
  Gene Name: nucleoporin 50kDa
  ENSP ID: ENSP00000388426
MAKRNAEKELTDRNWDQEDEAEEGKRRAIN

SEQ ID NO: 58851 - protein, 30 aa, Homo sapiens; identical to SEQ ID NO: 58850
  Payload ID: 11502
  Gene Symbol: NUP50
  Gene Name: nucleoporin 50kDa
  ENSP ID: ENSP00000391987

SEQ ID NO: 58852 - protein, 8 aa, Homo sapiens
  Payload ID: 11502
  Gene Symbol: NUP50
  Gene Name: nucleoporin 50kDa
  ENSP ID: ENSP00000394450
MASEEVLK

SEQ ID NO: 58853 - protein, 76 aa, Homo sapiens
  Payload ID: 11502
  Gene Symbol: NUP50
  Gene Name: nucleoporin 50kDa
  ENSP ID: ENSP00000397960
MAKRNAEKELTDRNWDQEDEAEEVGTFSMASEEVLKNRAIKKAKRRNVGFEVLLLQMALPPWLIKFQIPKLMGTVS

SEQ ID NO: 58854 - protein, 10 aa, Homo sapiens
  Payload ID: 11502
  Gene Symbol: NUP50
  Gene Name: nucleoporin 50kDa
  ENSP ID: ENSP00000398297
MAKRNAEKEL

SEQ ID NO: 58855 - protein, 4 aa, Homo sapiens
  Payload ID: 11502
  Gene Symbol: NUP50
  Gene Name: nucleoporin 50kDa
  ENSP ID: ENSP00000400465
MAKR

SEQ ID NO: 58856 - protein, 45 aa, Homo sapiens
  Payload ID: 11502
  Gene Symbol: NUP50
  Gene Name: nucleoporin 50kDa
  ENSP ID: ENSP00000415062
MAKRNAEKELTDRNWDQEDEAEEVGTFSMASEEVLKNRAIKKAKR

SEQ ID NO: 58857 - protein, 178 aa, Homo sapiens
  Payload ID: 11502
  Gene Symbol: NUP50
  Gene Name: nucleoporin 50kDa
  ENSP ID: ENSP00000416264
MAKRNAEKELTDRNWDQEDEAEEVGTFSMASEEVLKNRAIKKAKRRNVGFESDTGGAFKGFKGLVVPSGGGRFSGFGSGAGGKPLEGLSNGNNITSAPPFASAKAAADPKVAFGGDEEENDEPPKVVVTEVKEEDAFYSKKCKLFYKKDNEFKEKGIGTLHLKPTANQKTQLLVRADT

SEQ ID NO: 58858 - protein, 507 aa, Homo sapiens
  Payload ID: 11503
  Gene Symbol: NUP54
  Gene Name: nucleoporin 54kDa
  Uniprot ID: Q7Z3B4
  ENSP ID: ENSP00000264883
MAFNFGAPSGTSGTAAATAAPAGGFGGFGTTSTTAGSAFSFSAPTNTGTTGLFGGTQNKGFGFGTGFGTTTGTSTGLGTGLGTGLGFGGFNTQQQQQTTLGGLFSQPTQAPTQSNQLINTASALSAPTLLGDERDAILAKWNQLQAFWGTGKGYFNNNIPPVEFTQENPFCRFKAVGYSCMPSNKDEDGLVVLVFNKKETEIRSQQQQLVESLHKVLGGNQTLTVNVEGTKTLPDDQTEVVIYVVERSPNGTSRRVPATTLYAHFEQANIKTQLQQLGVTLSMTRTELSPAQIKQLLQNPPAGVDPIIWEQAKVDNPDSEKLIPVPMVGFKELLRRLKVQDQMTKQHQTRLDIISEDISELQKNQTTSVAKIAQYKRKLMDLSHRTLQVLIKQEIQRKSGYAIQADEEQLRVQLDTIQGELNAPTQFKGRLNELMSQIRMQNHFGAVRSEERYYIDADLLREIKQHLKQQQEGLSHLISIIKDDLEDIKLVEHGLNETIHIRGGVFS

SEQ ID NO: 58859 - protein, 459 aa, Homo sapiens
  Payload ID: 11503
  Gene Symbol: NUP54
  Gene Name: nucleoporin 54kDa
  Uniprot ID: Q7Z3B4
  ENSP ID: ENSP00000421304
MAFNFGAPSGTSGTAAATAAPAGGFGGFGTTSTTAGSAFSFSAPTNTGTTALGGLFSQPTQAPTQSNQLINTASALSAPTLLGDERDAILAKWNQLQAFWGTGKGYFNNNIPPVEFTQENPFCRFKAVGYSCMPSNKDEDGLVVLVFNKKETEIRSQQQQLVESLHKVLGGNQTLTVNVEGTKTLPDDQTEVVIYVVERSPNGTSRRVPATTLYAHFEQANIKTQLQQLGVTLSMTRTELSPAQIKQLLQNPPAGVDPIIWEQAKVDNPDSEKLIPVPMVGFKELLRRLKVQDQMTKQHQTRLDIISEDISELQKNQTTSVAKIAQYKRKLMDLSHRTLQVLIKQEIQRKSGYAIQADEEQLRVQLDTIQGELNAPTQFKGRLNELMSQIRMQNHFGAVRSEERYYIDADLLREIKQHLKQQQEGLSHLISIIKDDLEDIKLVEHGLNETIHIRGGVFS

SEQ ID NO: 58860 - protein, 158 aa, Homo sapiens [sequence omitted]

SEQ ID NO: 58861 - protein, 102 aa, Homo sapiens
  Payload ID: 11503
  Gene Symbol: NUP54
  Gene Name: nucleoporin 54kDa
  ENSP ID: ENSP00000424172
MAFNFGAPSGTSGTAAATAAPAGGFGGFGTTSTTAGSAFSFSAPTNTGTTGLFGGTQNKGFGFGTGFGTTTGTSTGLGTGLGTGLGFGGFNTQQQQQTSSRL

SEQ ID NO: 58862 - protein, 84 aa, Homo sapiens
  Payload ID: 11503
  Gene Symbol: NUP54
  Gene Name: nucleoporin 54kDa
  ENSP ID: ENSP00000424389
MAFNFGAPSGTSGTAAATAAPAGFGGLETANSTASGFNFGGFGLTANPAVNFNIGNFGVSTTSATPFNFGNSLASADLLLLKHF

SEQ ID NO: 58863 - protein, 102 aa, Homo sapiens; identical to SEQ ID NO: 58861
  Payload ID: 11503
  Gene Symbol: NUP54
  Gene Name: nucleoporin 54kDa
  ENSP ID: ENSP00000425243

SEQ ID NO: 58864 - protein, 138 aa, Homo sapiens
  Payload ID: 11503
  Gene Symbol: NUP54
  Gene Name: nucleoporin 54kDa
  ENSP ID: ENSP00000426609
MAFNFGAPSGTSGTAAATAAPAGFGGLETANSTASGFNFGGFGLTANPAVNFNIGNFGVSTTSATPFNFGNSLASAETHSCCLEVGLEDLGQHLQLQVLHSAFLPQLTQALLDSLVVLRTKVLDLVLVLAQQRELVLV

SEQ ID NO: 58865 - protein, 587 aa, Homo sapiens
  Payload ID: 11504
  Gene Symbol: NUP58
  Gene Name: nucleoporin 58kDa
  Uniprot ID: Q9BVL2
  ENSP ID: ENSP00000371137
MSTGFSFGSGTLGSTTVAAGGTSTGGVFSFGTGASSNPSVGLNFGNLGSTSTPATTSAPSSGFGTGLFGSKPATGFTLGGTNTGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGPQPSLGVSFGTPFGSGIGTGLQSSGLGSSNLGGFGTSSGFGCSTTGASTFGFGTTNKPSGSLSAGFGSSSTSGFNFSNPGITASAGLTFGVSNPASAGFGTGGQLLQLKKPPAGNKRGKR

SEQ ID NO: 58866 - protein, 599 aa, Homo sapiens
  Payload ID: 11504
  Gene Symbol: NUP58
  Gene Name: nucleoporin 58kDa
  Uniprot ID: Q9BVL2
  ENSP ID: ENSP00000371155
MSTGFSFGSGTLGSTTVAAGGTSTGGVFSFGTGASSNPSVGLNFGNLGSTSTPATTSAPSSGFGTGLFGSKPATGFTLGGTNTGIATTITTGLTLGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGPQPSLGVSFGTPFGSGIGTGLQSSGLGSSNLGGFGTSSGFGCSTTGASTFGFGTTNKPSGSLSAGFGSSSTSGFNFSNPGITASAGLTFGVSNPASAGFGTGGQLLQLKKPPAGNKRGKR

SEQ ID NO: 58867 - protein, 510 aa, Homo sapiens
  Payload ID: 11504
  Gene Symbol: NUP58
  Gene Name: nucleoporin 58kDa
  ENSP ID: ENSP00000371166
MSTGFSFGSGTLGSTTVAAGGTSTGGVFSFGTGASSNPSVGLNFGNLGSTSTPATTSAPSSGFGTGLFGSKPATGFTLGGTNTGIATTITTGLTLGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGDKWCNVAELKNRTQLSLFVNKLELSCYCVID

SEQ ID NO: 58868 - protein, 463 aa, Homo sapiens
  Payload ID: 11504
  Gene Symbol: NUP58
  Gene Name: nucleoporin 58kDa
  ENSP ID: ENSP00000408147
LNFGNLGSTSTPATTSAPSSGFGTGLFGSKPATGFTLGGTNTGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGDKWCNVAELKNRTQLSLFVNKLELSCYCVIDLLYNEQ

SEQ ID NO: 58869 - protein, 36 aa, Homo sapiens
  Payload ID: 11504
  Gene Symbol: NUP58
  Gene Name: nucleoporin 58kDa
  ENSP ID: ENSP00000418244
MSTGFSFGSGTLGSTTVAAGGTSTGGVFSFGTGASR

SEQ ID NO: 58870 - protein, 62 aa, Homo sapiens
  Payload ID: 11504
  Gene Symbol: NUP58
  Gene Name: nucleoporin 58kDa
  ENSP ID: ENSP00000418341
MSTGFSFGSGTLGSTTVAAGGTSTGGVFSFGTGASSSTTLLRLLSFVEQIFIGQIPMCKALF

SEQ ID NO: 58871 - protein, 485 aa, Homo sapiens
  Payload ID: 11504
  Gene Symbol: NUP58
  Gene Name: nucleoporin 58kDa
  Uniprot ID: Q9BVL2
  ENSP ID: ENSP00000418555
MSTGFSFGSGTLGSTTVAAGGTSTGGVFSFGTGASSNPSVGLNFGNLGSTSTPATTSAPSSGFGTGLFGSKPATGFTLGGTNTGIATTITTGLTLGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGLNAFKL

SEQ ID NO: 58872 - protein, 128 aa, Homo sapiens
  Payload ID: 11504
  Gene Symbol: NUP58
  Gene Name: nucleoporin 58kDa
  ENSP ID: ENSP00000418904
MSTGFSFGSGTLGSTTVAAGGTSTGGVFSFGTGASSNPSVGLNFGNLGSTSTPATTSAPSSGFGTGLFGSKPATGFTLGGTNTGIATTITTGLTLENNTSVYQQSFGLDQLQTQERQPLHLQLQQASV

SEQ ID NO: 58873 - protein, 522 aa, Homo sapiens
  Payload ID: 11505
  Gene Symbol: NUP62
  Gene Name: nucleoporin 62kDa
  Uniprot ID: P37198
  ENSP ID: ENSP00000305503
MSGFNFGGTGAPTGGFTFGTAKTATTTPATGFSFSTSGTGGFNFGAPFQPATSTPSTGLFSLATQTPATQTTGFTFGTATLASGGTGFSLGIGASKLNLSNTAATPAMANPSGFGLGSSNLTNAISSTVTSSQGTAPTGFVFGPSTTSVAPATTSGGFSFTGGSTAQPSGFNIGSAGNSAQPTAPATLPFTPATPAATTAGATQPAAPTPTATITSTGPSLFASIATAPTSSATTGLSLCTPVTTAGAPTAGTQGFSLKAPGAASGTSTTTSTAATATATTTSSSSTTGFALNLKPLAPAGIPSNTAAAVTAPPGPGAAAGAAASSAMTYAQLESLINKWSLELEDQERHFLQQATQVNAWDRTLIENGEKITSLHREVEKVKLDQKRLDQELDFILSQQKELEDLLSPLEELVKEQSGTIYLQHADEEREKTYKLAENIDAQLKRMAQDLKDIIEHLNTSGAPADTSDPLQQICKILNAHMDSLQWIDQNSALLQRKVEEVTKVCEGRRKEQERSFRITFD

SEQ ID NO: 58874 - protein, 522 aa, Homo sapiens; identical to SEQ ID NO: 58873
  Payload ID: 11505
  Gene Symbol: NUP62
  Gene Name: nucleoporin 62kDa
  Uniprot ID: P37198
  ENSP ID: ENSP00000407331

SEQ ID NO: 58875 - protein, 23 aa, Homo sapiens
  Payload ID: 11505
  Gene Symbol: NUP62
  Gene Name: nucleoporin 62kDa
  ENSP ID: ENSP00000468839
MSGFNFGGTGAPTGGFTFGTAKT

SEQ ID NO: 58876 - protein, 75 aa, Homo sapiens
  Payload ID: 11505
  Gene Symbol: NUP62
  Gene Name: nucleoporin 62kDa
  ENSP ID: ENSP00000468842
MSGFNFGGTGAPTGGFTFGTAKTATTTPATGFSFSTSGTGGFNFGAPFQPATSTPSTGLFSLATQTPATQTTGFT

SEQ ID NO: 58877 - protein, 23 aa, Homo sapiens
  Payload ID: 11505
  Gene Symbol: NUP62
  Gene Name: nucleoporin 62kDa
  ENSP ID: ENSP00000468884
MSGFNFGGTGAPTGGFTFGTAKT

SEQ ID NO: 58878 - protein, 134 aa, Homo sapiens
  Payload ID: 11505
  Gene Symbol: NUP62
  Gene Name: nucleoporin 62kDa
  ENSP ID: ENSP00000468930
MSGFNFGGTGAPTGGFTFGTAKTATTTPATGFSFSTSGTGGFNFGAPFQPATSTPSTGLFSLATQTPATQTTGFTFGTATLASGGTGFSLGIGASKLNLSNTAATPAMANPSGFGLGSSNLTNAISSTVTSSQG

SEQ ID NO: 58879 - protein, 446 aa, Homo sapiens
  Payload ID: 11505
  Gene Symbol: NUP62
  Gene Name: nucleoporin 62kDa
  ENSP ID: ENSP00000469283
MSGFNFGGTGAPTGGFTFGTAKTATTTPATGFSFSTSGTGGFNFGAPFQPATSTPSTGLFSLATQTPATQTTGFTFGTATLASGGTGFSLGIGASKLNLSNTAATPAMANPSGFGLGSSNLTNAISSTVTSSQGTAPTGFVFGPSTTSVAPATTSGGFSFTGGSTAQPSGFNIGSAGNSAQPTAPATLPFTPATPAATTAGATQPAAPTPTATITSTGPSLFASIATAPTSSATTGLSLCTPVTTAGAPTAGTQGFSLKAPGAASGTSTTTSTAATATATQVNAWDRTLIENGEKITSLHREVEKVKLDQKRLDQELDFILSQQKELEDLLSPLEELVKEQSGTIYLQHADEEREKTYKLAENIDAQLKRMAQDLKDIIEHLNTSGAPADTSDPLQQICKILNAHMDSLQWIDQNSALLQRKVEEVTKVCEGRRKEQERSFRITFD

SEQ ID NO: 58880 - protein, 36 aa, Homo sapiens
  Payload ID: 11505
  Gene Symbol: NUP62
  Gene Name: nucleoporin 62kDa
  ENSP ID: ENSP00000470157
MSGFNFGGTGAPTGGFTFGTAKTATTTPATGFSFST

SEQ ID NO: 58881 - protein, 99 aa, Homo sapiens
  Payload ID: 11505
  Gene Symbol: NUP62
  Gene Name: nucleoporin 62kDa
  ENSP ID: ENSP00000470624
MSGFNFGGTGAPTGGFTFGTAKTATTTPATGFSFSTSGTGGFNFGAPFQPATSTPSTGLFSLATQTPATQTTGFTFGTATLASGGTGFSLGIGASKLNL

SEQ ID NO: 58882 - protein, 18 aa, Homo sapiens
  Payload ID: 11505
  Gene Symbol: NUP62
  Gene Name: nucleoporin 62kDa
  ENSP ID: ENSP00000471133
MSGFNFGGTGAPTGGFTF

SEQ ID NO: 58883 - protein, 522 aa, Homo sapiens; identical to SEQ ID NO: 58873
  Payload ID: 11505
  Gene Symbol: NUP62
  Gene Name: nucleoporin 62kDa
  Uniprot ID: P37198
  ENSP ID: ENSP00000471191

SEQ ID NO: 58884 - protein, 100 aa, Homo sapiens
  Payload ID: 11505
  Gene Symbol: NUP62
  Gene Name: nucleoporin 62kDa
  ENSP ID: ENSP00000472081
MSGFNFGGTGAPTGGFTFGTAKTATTTPATGFSFSTSGTGGFNFGAPFQPATSTPSTGLFSLATQTPATQTTGFTFGTATLASGGTGFSLGIGASKLNLS

SEQ ID NO: 58885 - protein, 137 aa, Homo sapiens
  Payload ID: 11505
  Gene Symbol: NUP62
  Gene Name: nucleoporin 62kDa
  ENSP ID: ENSP00000472918
MSGFNFGGTGAPTGGFTFGTAKTATTTPATGFSFSTSGTGGFNFGAPFQPATSTPSTGLFSLATQTPATQTTGFTFGTATLASGGTGFSLGIGASKLNLSNTAATPAMANPSGFGLGSSNLTNAISSTVTSSQGTAP

SEQ ID NO: 58886 - protein, 522 aa, Homo sapiens; identical to SEQ ID NO: 58873
  Payload ID: 11505
  Gene Symbol: NUP62
  Gene Name: nucleoporin 62kDa
  Uniprot ID: P37198
  ENSP ID: ENSP00000473192

SEQ ID NO: 58887 - protein, 184 aa, Homo sapiens
  Payload ID: 11506
  Gene Symbol: NUP62CL
  Gene Name: nucleoporin 62kDa C-terminal like
  Uniprot ID: Q9H1M0
  ENSP ID: ENSP00000361544
MQFTSISNSLTSTAAIGLSFTTSTTTTATFTTNTTTTITSGFTVNQNQLLSRGFENLVPYTSTVSVVATPVMTYGHLEGLINEWNLELEDQEKYFLLQATQVNAWDHTLIENGEMIRILHGEVNKVKLDQKRLEQELDFILSQQQELEFLLTYLEESTRDQSGLHYLQDADEEHVEISTRSAEF

SEQ ID NO: 58888 - protein, 136 aa, Homo sapiens
  Payload ID: 11506
  Gene Symbol: NUP62CL
  Gene Name: nucleoporin 62kDa C-terminal like
  ENSP ID: ENSP00000405906
MQFTSISNSLTSTAAIGLSFTTSTTTTATFTTNTTTTITSGFTVNQNQLLSRGFENLVPYTSTVSVVATPVMTYGHLEGLINEWNLELEDQEKYFLLQATQVNAWDHTLIENGEMIRILHGEVNKVKLDQKRLEQE

SEQ ID NO: 58889 - protein, 198 aa, Homo sapiens
  Payload ID: 11506
  Gene Symbol: NUP62CL
  Gene Name: nucleoporin 62kDa C-terminal like
  ENSP ID: ENSP00000408612
  MOD_RES (1)..(1): Any amino acid
XPVMTYGHLEGLINEWNLELEDQEKYFLLQATQVNAWDHTLIENGEMIRILHGEVNKVKLDQKRLEQELDFILSQQQELEFLLTYLEESTRDQSGLHYLQDADEEHVEIYRLAESIDAQLKQMAQDLKDVVNHLNTFESSSDTTDPLHQICRILNAHMDSLQWIDRNSGMLRRKVEVVTRVFEDYRHEEHAHNVNTAF

SEQ ID NO: 58890 - protein, 72 aa, Homo sapiens
  Payload ID: 11506
  Gene Symbol: NUP62CL
  Gene Name: nucleoporin 62kDa C-terminal like
  Uniprot ID: Q9H1M0
  ENSP ID: ENSP00000433269
MQFTSISNSLTSTAAIGLSFTTSTTTTATFTTNTTTTITSGFTVNQNQLLSRGFENLVPYTSTVRFVFYMEK

SEQ ID NO: 58891 - protein, 656 aa, Homo sapiens
  Payload ID: 11507
  Gene Symbol: NUP85
  Gene Name: nucleoporin 85kDa
  Uniprot ID: Q9BW27
  ENSP ID: ENSP00000245544
MEELDGEPTVTLIPGVNSKKNQMYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 58892 - protein, 259 aa, Homo sapiens
  Payload ID: 11507
  Gene Symbol: NUP85
  Gene Name: nucleoporin 85kDa
  ENSP ID: ENSP00000445855
MREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 58893 - protein, 169 aa, Homo sapiens
  Payload ID: 11507
  Gene Symbol: NUP85
  Gene Name: nucleoporin 85kDa
  ENSP ID: ENSP00000461919
MEELDGEPTVTLIPGVNSKKNQMYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPGDHLGAAGPAG

SEQ ID NO: 58894 - protein, 98 aa, Homo sapiens
  Payload ID: 11507
  Gene Symbol: NUP85
  Gene Name: nucleoporin 85kDa
  ENSP ID: ENSP00000462364
  MOD_RES (1)..(1): Any amino acid
XSLMTSRIAPRSFWMTLLTDALPLLEQKQVKVIFSAEQTYELMRCLEDLTSRRPVHGESDTEQLQDDDIETTKVEMLRLSLARNLARAIIREGSLEGS

SEQ ID NO: 58895 - protein, 120 aa, Homo sapiens
  Payload ID: 11507
  Gene Symbol: NUP85
  Gene Name: nucleoporin 85kDa
  ENSP ID: ENSP00000462487
MYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAM

SEQ ID NO: 58896 - protein, 611 aa, Homo sapiens
  Payload ID: 11507
  Gene Symbol: NUP85
  Gene Name: nucleoporin 85kDa
  ENSP ID: ENSP00000462749
MEELDGEPTVTLIPGVNSKKNQMYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 58897 - protein, 100 aa, Homo sapiens
  Payload ID: 11507
  Gene Symbol: NUP85
  Gene Name: nucleoporin 85kDa
  ENSP ID: ENSP00000462920
  MOD_RES (1)..(1): Any amino acid
XLFIEVAPAGPLLLHLLDWVRLHVCEVDSLSADVLGSENPSKHDSFWNLIMLGDEAALLEQKELLSNWYHFLVTRLLYSNPTVKPIDLHYYAQPGPVSGR

SEQ ID NO: 58898 - protein, 19 aa, Homo sapiens
  Payload ID: 11507
  Gene Symbol: NUP85
  Gene Name: nucleoporin 85kDa
  ENSP ID: ENSP00000463377
LLAAFEFDIHQVIKECSFL

SEQ ID NO: 58899 - protein, 544 aa, Homo sapiens
  Payload ID: 11507
  Gene Symbol: NUP85
  Gene Name: nucleoporin 85kDa
  ENSP ID: ENSP00000463382
MEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 58900 - protein, 114 aa, Homo sapiens
  Payload ID: 11507
  Gene Symbol: NUP85
  Gene Name: nucleoporin 85kDa
  ENSP ID: ENSP00000463437
AMMLSDRLTFLGKYREFHRMYGEKRFADAASLLLSLMTSRIAPRSFWMTLLTDALPLLEQKQVIFSAEQTYELMRCLEDLTSRRPVHGESDTEQLQYGPLVLLSFTSIICWKLL

SEQ ID NO: 58901 - protein, 272 aa, Homo sapiens
  Payload ID: 11507
  Gene Symbol: NUP85
  Gene Name: nucleoporin 85kDa
  ENSP ID: ENSP00000463496
VTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFA

SEQ ID NO: 58902 - protein, 302 aa, Homo sapiens
  Payload ID: 11507
  Gene Symbol: NUP85
  Gene Name: nucleoporin 85kDa
  ENSP ID: ENSP00000463542
  MOD_RES (1)..(1): Any amino acid
XHEECERYLQDSTFATSPHLESLLKSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLED

SEQ ID NO: 58903 - protein, 191 aa, Homo sapiens
  Payload ID: 11507
  Gene Symbol: NUP85
  Gene Name: nucleoporin 85kDa
  ENSP ID: ENSP00000463715
LDWVRLHVCEVDSLSADVLGSENPSKHDSFWNLGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKEC

SEQ ID NO: 58904 - protein, 18 aa, Homo sapiens
  Payload ID: 11507
  Gene Symbol: NUP85
  Gene Name: nucleoporin 85kDa
  ENSP ID: ENSP00000464433
LTDALPLLEQKQQNRLMS

SEQ ID NO: 58905 - protein, 46 aa, Homo sapiens
  Payload ID: 11507
  Gene Symbol: NUP85
  Gene Name: nucleoporin 85kDa
  ENSP ID: ENSP00000464544
  MOD_RES (1)..(1): Any amino acid
XEKRFADAASLLLSLMTSRIAPRSFWMTLLTDALPLLEQKQNRLMS

SEQ ID NO: 58906 - protein, 696 aa, Homo sapiens
  Payload ID: 11508
  Gene Symbol: NUP88
  Gene Name: nucleoporin 88kDa
  ENSP ID: ENSP00000225696
  MOD_RES (1)..(1): Any amino acid
XGLGGELFLWDGEDSSFLVVRLRGPSGGGEEPALSQYQRLLCINPPLFEIYQVLLSPTQHHVALIGIKGLMVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTSEKSWDSRIDLIPSLYVFECVELELALKLASGEDDPFDSDFSCPVKLHRDPKCPSRYHCTHEAGVHSVGLTWIHKLHKFLGSDEEDKDSLQELSTEQKCFVEHILCTKPLPCRQPAPIRGFWIVPDILGPTMICITSTYECLIWPLLSTVHPASPPLLCTREDVEVAESPLRVLAETPDSFEKHIRSILQRSVANPAFLNCFTQLRKIKVETLFLRASEKDIAPPPEECLQLLSRATQVFREQYILKQDLAKEEIQRRVKLLCDQKKKQLEDLSYCREERKSLREMAERLADKYEEAKEKQEDIMNRMKKLLHSFHSELPVLSDSERDMKKELQLIPDQLRHLGNAIKQVTMKKDYQQQKMEKVLSLPKPTIILSAYQRKCIQSILKEEGEHIREMVKQINDIRNHVNF

SEQ ID NO: 58907 - protein, 741 aa, Homo sapiens
  Payload ID: 11508
  Gene Symbol: NUP88
  Gene Name: nucleoporin 88kDa
  Uniprot ID: Q99567
  ENSP ID: ENSP00000458954
MAAAEGPVGDGELWQTWLPNHVVFLRLREGLKNQSPTEAEKPASSSLPSSPPPQLLTRNVVFGLGGELFLWDGEDSSFLVVRLRGPSGGGEEPALSQYQRLLCINPPLFEIYQVLLSPTQHHVALIGIKGLMVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTSEKSWDSRIDLIPSLYVFECVELELALKLASGEDDPFDSDFSCPVKLHRDPKCPSRYHCTHEAGVHSVGLTWIHKLHKFLGSDEEDKDSLQELSTEQKCFVEHILCTKPLPCRQPAPIRGFWIVPDILGPTMICITSTYECLIWPLLSTVHPASPPLLCTREDVEVAESPLRVLAETPDSFEKHIRSILQRSVANPAFLKASEKDIAPPPEECLQLLSRATQVFREQYILKQDLAKEEIQRRVKLLCDQKKKQLEDLSYCREERKSLREMAERLADKYEEAKEKQEDIMNRMKKLLHSFHSELPVLSDSERDMKKELQLIPDQLRHLGNAIKQVTMKKDYQQQKMEKVLSLPKPTIILSAYQRKCIQSILKEEGEHIREMVKQINDIRNHVNF

SEQ ID NO: 58908 - protein, 153 aa, Homo sapiens
  Payload ID: 11508
  Gene Symbol: NUP88
  Gene Name: nucleoporin 88kDa
  ENSP ID: ENSP00000459370
MVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLL

SEQ ID NO: 58909 - protein, 128 aa, Homo sapiens
  Payload ID: 11508
  Gene Symbol: NUP88
  Gene Name: nucleoporin 88kDa
  ENSP ID: ENSP00000459979
MAAAEGPVGDGELWQTWLPNHVVFLRLREGLKNQSPTEAEKPASSSLPSSPPPQLLTRNVVFGLGGELFLWDGEDSSFLVVRLRGPSGGGEEPALSQYQAGVQWRHLGSPQPPPSSFKRFFCLSPPRE

SEQ ID NO: 58910 - protein, 110 aa, Homo sapiens
  Payload ID: 11508
  Gene Symbol: NUP88
  Gene Name: nucleoporin 88kDa
  ENSP ID: ENSP00000461334
  MOD_RES (1)..(1): Any amino acid
XIRSILQRSVANPAFLKASEKDIAPPPEECLQLLSRATQVFREQYILKQDLAKEEIQRRVKLLCDQKKKQLEDLSYCREERKSLREMAERLADKYEEAKEKQEDIMNSSL

SEQ ID NO: 58911 - protein, 819 aa, Homo sapiens
  Payload ID: 11509
  Gene Symbol: NUP93
  Gene Name: nucleoporin 93kDa
  Uniprot ID: Q8N1F7
  ENSP ID: ENSP00000310668
MDTEGFGELLQQAEQLAAETEGISELPHVERNLQEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEIRHNLSEVLLATMNILFTQFKRLKGTSPSSSSRPQRVIEDRDSQLRSQARTLITFAGMIPYRTSGDTNARLVQMEVLMN

SEQ ID NO: 58912 - protein, 696 aa, Homo sapiens
  Payload ID: 11509
  Gene Symbol: NUP93
  Gene Name: nucleoporin 93kDa
  Uniprot ID: Q8N1F7
  ENSP ID: ENSP00000440235
MAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEIRHNLSEVLLATMNILFTQFKRLKGTSPSSSSRPQRVIEDRDSQLRSQARTLITFAGMIPYRTSGDTNARLVQMEVLMN

SEQ ID NO: 58913 - protein, 178 aa, Homo sapiens
  Payload ID: 11509
  Gene Symbol: NUP93
  Gene Name: nucleoporin 93kDa
  ENSP ID: ENSP00000454285
MDTEGFGELLQQAEQLAAETEGISELPHVERNLQEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVEWEQVKQRILHTLLASGEDALDFTQESEPSYISDVGPPGRSSL

SEQ ID NO: 58914 - protein, 125 aa, Homo sapiens
  Payload ID: 11509
  Gene Symbol: NUP93
  Gene Name: nucleoporin 93kDa
  ENSP ID: ENSP00000454587
MAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSV

SEQ ID NO: 58915 - protein, 40 aa, Homo sapiens
  Payload ID: 11509
  Gene Symbol: NUP93
  Gene Name: nucleoporin 93kDa
  ENSP ID: ENSP00000454844
MAEEYHRESMLVEWEQVKQRILHTLLASGEDALDFTQESE

SEQ ID NO: 58916 - protein, 132 aa, Homo sapiens
  Payload ID: 11509
  Gene Symbol: NUP93
  Gene Name: nucleoporin 93kDa
  ENSP ID: ENSP00000454935
  MOD_RES (1)..(1): Any amino acid
XEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVEWEQVKQRILHTLLASGEDALDFTQESEVA

SEQ ID NO: 58917 - protein, 16 aa, Homo sapiens
  Payload ID: 11509
  Gene Symbol: NUP93
  Gene Name: nucleoporin 93kDa
  ENSP ID: ENSP00000455181
MAEEYHRESMLVEWEQ

SEQ ID NO: 58918 - protein, 156 aa, Homo sapiens
  Payload ID: 11509
  Gene Symbol: NUP93
  Gene Name: nucleoporin 93kDa
  ENSP ID: ENSP00000455210
MAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLH

SEQ ID NO: 58919 - protein, 229 aa, Homo sapiens
  Payload ID: 11509
  Gene Symbol: NUP93
  Gene Name: nucleoporin 93kDa
  ENSP ID: ENSP00000455230
MDTEGFELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLT

SEQ ID NO: 58920 - protein, 140 aa, Homo sapiens
  Payload ID: 11509
  Gene Symbol: NUP93
  Gene Name: nucleoporin 93kDa
  ENSP ID: ENSP00000456196
  MOD_RES (1)..(1): Any amino acid
XELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEVSSFFLSCGIPFSPLPPKAFSFPVPNSFKNSSYSNYPD

SEQ ID NO: 58921 - protein, 151 aa, Homo sapiens
  Payload ID: 11509
  Gene Symbol: NUP93
  Gene Name: nucleoporin 93kDa
  ENSP ID: ENSP00000456264
MDTEGFGELLQQAEQLAAETEGISELPHVERNLQEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVEWEQVKQRILHTLLAS

SEQ ID NO: 58922 - protein, 136 aa, Homo sapiens
  Payload ID: 11509
  Gene Symbol: NUP93
  Gene Name: nucleoporin 93kDa
  ENSP ID: ENSP00000457902
MDTEGFGELLQQAEQLAAETEGISELPHVERNLQEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVE

SEQ ID NO: 58923 - protein, 84 aa, Homo sapiens
  Payload ID: 11509
  Gene Symbol: NUP93
  Gene Name: nucleoporin 93kDa
  ENSP ID: ENSP00000457907
LDLITFFDEYHSGHIDRAFDIIERLKLVPLNQESVEERVAAFRNFSDEQLRSQARTLITFAGMIPYRTSGDTNARLVQMEVLMN

SEQ ID NO: 58924 - protein, 696 aa, Homo sapiens; identical to SEQ ID NO: 58912
  Payload ID: 11509
  Gene Symbol: NUP93
  Gene Name: nucleoporin 93kDa
  Uniprot ID: Q8N1F7
  ENSP ID: ENSP00000458039

SEQ ID NO: 58925 - protein, 117 aa, Homo sapiens
  Payload ID: 11509
  Gene Symbol: NUP93
  Gene Name: nucleoporin 93kDa
  ENSP ID: ENSP00000458078
SDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDVSFRKGV

SEQ ID NO: 58926 - protein, 880 aa, Homo sapiens
  Payload ID: 11509
  Gene Symbol: NUP93
  Gene Name: nucleoporin 93kDa
  ENSP ID: ENSP00000458101
MDTEGFGELLQQAEQLAAETEGISELPHVERNLQEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEIRHNLSEVLLATMNILFTQFKRLKGTSPSSSSRPQRVIEDRDSGLALLPRLECNDTISAHCNLYLLGSSHPPTSPSQVAGTTATPKSSPHSDYLCWNDTIPNVWGHQCEAGADGGPHELSAMLCGSLGRHTVSTSGTWAH

SEQ ID NO: 58927 - protein, 1800 aa, Homo sapiens
  Payload ID: 11510
  Gene Symbol: NUP98
  Gene Name: nucleoporin 98kDa
  Uniprot ID: P52948
  ENSP ID: ENSP00000316032
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSWSVPPPLTSVFTMPSPAPEVPLKTVGTRRQLGLVPREKSVTYGKGKLLMDMALFMGRSFRVGWGPNWTLANSGEQLNGSHELENHQIADSMEFGFLPNPVAVKPLTESPFKVHLEKLSLRQRKPDEDMKLYQTPLELKLKHSTVHVDELCPLIVPNLGVAVIHDYADWVKEASGDLPEAQIVKHWSLTWTLCEALWGHLKELDSQLNEPREYIQILERRRAFSRWLSCTATPQIEEEVSLTQKNSPVEAVFSYLTGKRISEACSLAQQSGDHRLALLLSQFVGSQSVRELLTMQLVDWHQLQADSFIQDERLRIFALLAGKPVWQLSEKKQINVCSQLDWKRSLAIHLWYLLPPTASISRALSMYEEAFQNTSDSDRYACSPLPSYLEGSGCVIAEEQNSQTPLRDVCFHLLKLYSDRHYDLNQLLEPRSITADPLDYRLSWHLWEVLRALNYTHLSAQCEGVLQASYAGQLESEGLWEWAIFVLLHIDNSGIREKAVRELLTRHCQLLETPESWAKETFLTQKLRVPAKWIHEAKAVRAHMESDKHLEALCLFKAEHWNRCHKLIIRHLASDAIINENYDYLKGFLEDLAPPERSSLIQDWETSGLVYLDYIRVIEMLRHIQQVDCSGNDLEQLHIKVTSLCSRIEQIQCYSAKDRLAQSDMAKRVANLLRVVLSLHHPPDRTSDSTPDPQRVPLRLLAPHIGRLPMPEDYAMDELRSLTQSYLRELAVGSL

SEQ ID NO: 58928 - protein, 1726 aa, Homo sapiens
  Payload ID: 11510
  Gene Symbol: NUP98
  Gene Name: nucleoporin 98kDa
  Uniprot ID: P52948
  ENSP ID: ENSP00000347404
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSWSVPPPLTSVFTMPSPAPEVPLKTVGTRRQLGLVPREKSVTYGKGKLLMDMALFMGRSFRVGWGPNWTLANSGEQLNGSHELENHQIADSMEFGFLPNPVAVKPLTESPFKVHLEKLSLRQRKPDEDMKLYQTPLELKLKHSTVHVDELCPLIVPNLGVAVIHDYADWVKEASGDLPEAQIVKHWSLTWTLCEALWGHLKELDSQLNEPREYIQILERRRAFSRWLSCTATPQIEEEVSLTQKNSPVEAVFSYLTGKRISEACSLAQQSGDHRLALLLSQFVGSQSVRELLTMQLVDWHQLQADSFIQDERLRIFALLAGKPVWQLSEKKQINVCSQLDWKRSLAIHLWYLLPPTASISRALSMYEEAFQNTSDSDRYACSPLPSYLEGSGCVIAEEQNSQTPLRDVCFHLLKLYSDSIREKAVRELLTRHCQLLETPESWAKETFLTQKLRVPAKWIHEAKAVRAHMESDKHLEALCLFKAEHWNRCHKLIIRHLASDAIINENYDYLKGFLEDLAPPERSSLIQDWETSGLVYLDYIRVIEMLRHIQQVDCSGNDLEQLHIKVTSLCSRIEQIQCYSAKDRLAQSDMAKRVANLLRVVLSLHHPPDRTSDSTPDPQRVPLRLLAPHIGRLPMPEDYAMDELRSLTQSYLRELAVGSL

SEQ ID NO: 58929 - protein, 1817 aa, Homo sapiens
  Payload ID: 11510
  Gene Symbol: NUP98
  Gene Name: nucleoporin 98kDa
  Uniprot ID: P52948
  ENSP ID: ENSP00000352091
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGNKPTLTLGTNTNTSNFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSWSVPPPLTSVFTMPSPAPEVPLKTVGTRRQLGLVPREKSVTYGKGKLLMDMALFMGRSFRVGWGPNWTLANSGEQLNGSHELENHQIADSMEFGFLPNPVAVKPLTESPFKVHLEKLSLRQRKPDEDMKLYQTPLELKLKHSTVHVDELCPLIVPNLGVAVIHDYADWVKEASGDLPEAQIVKHWSLTWTLCEALWGHLKELDSQLNEPREYIQILERRRAFSRWLSCTATPQIEEEVSLTQKNSPVEAVFSYLTGKRISEACSLAQQSGDHRLALLLSQFVGSQSVRELLTMQLVDWHQLQADSFIQDERLRIFALLAGKPVWQLSEKKQINVCSQLDWKRSLAIHLWYLLPPTASISRALSMYEEAFQNTSDSDRYACSPLPSYLEGSGCVIAEEQNSQTPLRDVCFHLLKLYSDRHYDLNQLLEPRSITADPLDYRLSWHLWEVLRALNYTHLSAQCEGVLQASYAGQLESEGLWEWAIFVLLHIDNSGIREKAVRELLTRHCQLLETPESWAKETFLTQKLRVPAKWIHEAKAVRAHMESDKHLEALCLFKAEHWNRCHKLIIRHLASDAIINENYDYLKGFLEDLAPPERSSLIQDWETSGLVYLDYIRVIEMLRHIQQVDCSGNDLEQLHIKVTSLCSRIEQIQCYSAKDRLAQSDMAKRVANLLRVVLSLHHPPDRTSDSTPDPQRVPLRLLAPHIGRLPMPEDYAMDELRSLTQSYLRELAVGSL

SEQ ID NO: 58930 - protein, 920 aa, Homo sapiens
  Payload ID: 11510
  Gene Symbol: NUP98
  Gene Name: nucleoporin 98kDa
  Uniprot ID: P52948
  ENSP ID: ENSP00000380199
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQVEKKGQ

SEQ ID NO: 58931 - protein, 937 aa, Homo sapiens
  Payload ID: 11510
  Gene Symbol: NUP98
  Gene Name: nucleoporin 98kDa
  Uniprot ID: P52948
  ENSP ID: ENSP00000380202
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGNKPTLTLGTNTNTSNFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQVEKKGQ

SEQ ID NO: 58932 - protein, 136 aa, Homo sapiens
  Payload ID: 11510
  Gene Symbol: NUP98
  Gene Name: nucleoporin 98kDa
  ENSP ID: ENSP00000380208
  MOD_RES (1)..(1): Any amino acid
XLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGNKPTLTLGTNTNTSNFGTYKKQVWLS

SEQ ID NO: 58933 - protein, 753 aa, Homo sapiens
  Payload ID: 11510
  Gene Symbol: NUP98
  Gene Name: nucleoporin 98kDa
  ENSP ID: ENSP00000413146
  MOD_RES (1)..(1): Any amino acid
XLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSCLTESPFKVHLEKLSLRQRKPDEDMKLYQTPLELKLKHSTVHVDELCPLIVPNLGVAVIHDYADWVKEASGDLPEAQIVKHWSLTWTLCEALWGHLKELDSQLNEPREYIQILERRRAFSRWLSCTATPQIEEEVSLTQKNSPVEAVFSYLTGKRISEACSLAQQSGDHRLALLLSQFVGSQSVRELLTMQLVDWHQLQADSFIQDERLRIFALLAGKPVWQLSEKKQINVCSQLDWKRSLAIHLWYLLPPTASISRALSMYEEAFQNTSDSDRYACSPLPSYLEGSGCVIAEEQNSQTPLRDVCFHLLKLYSDRHYDLNQLLEPRSITADPLDYRLSWHLWEVLRALNYTHLSAQCEGVLQASYAGQLESEGLWEWAIFVLLHIDNSGIREKAVRELLTRHCQLLETPESWAKETFLTQKLRVPAKWIHEAKAVRAHMESDKHLEALCLFKAEHWNRCHKLIIRHLASDAIINENYDYLKGFLEDLAPPERSSLIQDWETSGLVYLDYIRVIEMLRHIQQVDCSGNDLEQLHIKVTSLCSRIEQIQCYSAKDRLAQSDMAKRVANLLRVVLSLHHPPDRTSDSTPDPQRVPLRLLAPHIGRLPMPEDYAMDELRSLTQSYLRELAVGSL

SEQ ID NO: 58934 - protein, 179 aa, Homo sapiens
  Payload ID: 11510
  Gene Symbol: NUP98
  Gene Name: nucleoporin 98kDa
  ENSP ID: ENSP00000432142
  MOD_RES (1)..(1): Any amino acid
XTNTGFGAVGSTLFGNNKLTTFGSSTTSAPSFGTTSGGLFGFGTNTSGNSIFGSKPAPGTLGTGLGAGFGTALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPK

SEQ ID NO: 58935 - protein, 93 aa, Homo sapiens
  Payload ID: 11510
  Gene Symbol: NUP98
  Gene Name: nucleoporin 98kDa
  ENSP ID: ENSP00000432275
  MOD_RES (1)..(1): Any amino acid
XDYLKGFLEDLAPPERSSLIQDWETSGLVYLDYIRVIEMLRHIQQVDCSGNDLEQLHIKVTSLCSRIEQIQCYSAKDRLAQSGTVHTILASWA

SEQ ID NO: 58936 - protein, 75 aa, Homo sapiens
  Payload ID: 11510
  Gene Symbol: NUP98
  Gene Name: nucleoporin 98kDa
  ENSP ID: ENSP00000433226
  MOD_RES (1)..(1): Any amino acid
XYGKGKLLMDMALFMGRSFRVGWGPNWTLANSGEQLNGSHELENHQIADSMEFGFLPNPVAVKPCEALEPDMDTM

SEQ ID NO: 58937 - protein, 232 aa, Homo sapiens
  Payload ID: 11510
  Gene Symbol: NUP98
  Gene Name: nucleoporin 98kDa
  ENSP ID: ENSP00000433515
  MOD_RES (1)..(1): Any amino acid
XVRELLTMQLVDWHQLQADSFIQDERLRIFALLAGKPVWQLSEKKQINVCSQLDWKRSLAIHLWYLLPPTASISRALSMYEEAFQNTSDSDRYACSPLPSYLEGSGCVIAEEQNSQTPLRDVCFHLLKLYSDRHYDLNQLLEPRSITADPLDYRLSWHLWEVLRALNYTHLSAQCEAYVRRLFESCLPGTASCWRPLNLGLKRLSLPRSSVYLPNGSTRPKLCEHTWNLTST

SEQ ID NO: 58938 - protein, 124 aa, Homo sapiens
  Payload ID: 11510
  Gene Symbol: NUP98
  Gene Name: nucleoporin 98kDa
  ENSP ID: ENSP00000434698
MFNKSFGTPFGGGTGGFGTTSTFGQNTGFGTTSGGAFGTSAFGSSNNTGGLFGNSQTKPGGLFGTSSFSQPATSTSTGFGFDFGTSTSSGGLFGTTNTTSNPFGSTSGSLFGPSSFTAAPTGTT

SEQ ID NO: 58939 - protein, 235 aa, Homo sapiens
  Payload ID: 11510
  Gene Symbol: NUP98
  Gene Name: nucleoporin 98kDa
  ENSP ID: ENSP00000436226
  MOD_RES (1)..(1): Any amino acid
XGSSTTSAPSFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGE

SEQ ID NO: 58940 - protein, 423 aa, Homo sapiens
  Payload ID: 11511
  Gene Symbol: NUPL2
  Gene Name: nucleoporin like 2
  Uniprot ID: O15504
  ENSP ID: ENSP00000258742
MAICQFFLQGRCRFGDRCWNEHPGARGAGGGRQQPQQQPSGNNRRGWNTTSQRYSNVIQPSSFSKSTPWGGSRDQEKPYFSSFDSGASTNRKEGFGLSENPFASLSPDEQKDEKKLLEGIVKDMEVWESSGQWMFSVYSPVKKKPNISGFTDISPEELRLEYHNFLTSNNLQSYLNSVQRLINQWRNRVNELKSLNISTKVALLSDVKDGVNQAAPAFGFGSSQAATFMSPGFPVNNSSSDNAQNFSFKTNSGFAAASSGSPAGFGSSPAFGAAASTSSGISTSAPAFGFGKPEVTSAASFSFKSPAASSFGSPGFSGLPASLATGPVRAPVAPAFGGGSSVAGFGSPGSHSHTAFSKPSSDTFGNSSISTSLSASSSIIATDNVLFTPRDKLTVEELEQFQSKKFTLGKIPLKPPPLELLNV

SEQ ID NO: 58941 - protein, 155 aa, Homo sapiens
  Payload ID: 11511
  Gene Symbol: NUPL2
  Gene Name: nucleoporin like 2
  ENSP ID: ENSP00000387330
MAICQFFLQGRCRFGDRCWNEHPGARGAGGGRQQPQQQPSGNNRRGWNTTSQRYSNVIQPSSFSKSTPWGGSRDQEKPYFSSFDSGASTNRKEGFGLSENPFASLSPDEQKDEKKLLEGIVKDMEVWESSGQWMFSVYSPVKKKPNISVPKPFLG

SEQ ID NO: 58942 - protein, 435 aa, Homo sapiens
  Payload ID: 11511
  Gene Symbol: NUPL2
  Gene Name: nucleoporin like 2
  ENSP ID: ENSP00000401475
MAICQFFLQGRCRFGDRCWNEHPGARGAGGGRQQPQQQPSGNNRRGWNTTSQRYSNVIQPSSFSKSTPWGGSRDQEKPYFSSFDSGASTNRKEGFGLSENPFASLSPDEQKDEKKLLEGIVKDMEVWESSGQWMFSVYSPVKKKPNISGFTDISPEELRLEYHNFLTSNNLQSYLNSVQRLINQWRNRVNELKSLNISTKVALKCLWKIYTHLSPKIYGPDCGKFIIFLSDVKDGVNQAAPAFGFGSSQAATFMSPGFPVNNSSSDNAQNFSFKTNSGFAAASSGSPAGFGSSPAFGAAASTSSGISTSAPAFGFGKPEVTSAASFSFKSPAASSFGSPGFSGLPASLATGPVRAPVAPAFGGGSSVAGFGSPGSHSHTAFSKPSSDTFGNSSISTSLSASSSIIATDNVLFTPRDKLTVEELEQFQSKKFTLGK

SEQ ID NO: 58943 - protein, 44 aa, Homo sapiens
  Payload ID: 11511
  Gene Symbol: NUPL2
  Gene Name: nucleoporin like 2
  ENSP ID: ENSP00000406677
MAICQFFLQGRCRFGDRCWNEHPGARGAGGGRQQPQQQPSGKEL

SEQ ID NO: 58944 - protein, 224 aa, Homo sapiens
  Payload ID: 11511
  Gene Symbol: NUPL2
  Gene Name: nucleoporin like 2
  Uniprot ID: O15504
  ENSP ID: ENSP00000415511
MAICQFFLQGRCRFGDRCWNEHPGARGAGGGRQQPQQQPSGNNRRGWNTTSQRYSNVIQPSSFSKSTPWGGSRDQEKPYFSSFDSGASTNRKEGFGLSENPFASLSPDEQKDEKKLLEGIVKDMEVWESSGQWMFSVYSPVKKKPNISGFTDISPEELRLEYHNFLTSNNLQSYLNSVQRLINQWRNRVNELKSLNISTKVALKCLWKIYTHLSPKIYGPDCAL

SEQ ID NO: 58945 - protein, 83 aa, Homo sapiens [sequence omitted]

SEQ ID NO: 58946 - protein, 435 aa, Homo sapiens
  Payload ID: 11512
  Gene Symbol: NXN
  Gene Name: nucleoredoxin
  Uniprot ID: Q6DKJ4
  ENSP ID: ENSP00000337443
MSGFLEELLGEKLVTGGGEEVDVHSLGARGISLLGLYFGCSLSAPCAQLSASLAAFYGRLRGDAAAGPGPGAGAGAAAEPEPRRRLEIVFVSSDQDQRQWQDFVRDMPWLALPYKEKHRKLKLWNKYRISNIPSLIFLDATTGKVVCRNGLLVIRDDPEGLEFPWGPKPFREVIAGPLLRNNGQSLESSSLEGSHVGVYFSAHWCPPCRSLTRVLVESYRKIKEAGQNFEIIFVSADRSEESFKQYFSEMPWLAVPYTDEARRSRLNRLYGIQGIPTLIMLDPQGEVITRQGRVEVLNDEDCREFPWHPKPVLELSDSNAAQLNEGPCLVLFVDSEDDGESEAAKQLIQPIAEKIIAKYKAKEEEAPLLFFVAGEDDMTDSLRDYTNLPEAAPLLTILDMSARAKYVMDVEEITPAIVEAFVNDFLAEKLKPEPI

SEQ ID NO: 58947 - protein, 186 aa, Homo sapiens
  Payload ID: 11512
  Gene Symbol: NXN
  Gene Name: nucleoredoxin
  ENSP ID: ENSP00000446446
MPWLAVPYTDEARRSRLNRLYGIQGIPTLIMLDPQGEVITRQGRVEVLNDEDCREFPWHPKPVLELSDSNAAQLNEGPCLVLFVDSEDDGESEAAKQLIQPIAEKIIAKYKAKEEEAPLLFFVAGEDDMTDSLRDYTNLPEAAPLLTILDMSARAKYVMDVEEITPAIVEAFVNDFLAEKLKPEPI

SEQ ID NO: 58948 - protein, 327 aa, Homo sapiens
  Payload ID: 11512
  Gene Symbol: NXN
  Gene Name: nucleoredoxin
  Uniprot ID: Q6DKJ4
  ENSP ID: ENSP00000461038
MADVSLHRNPATLKLWNKYRISNIPSLIFLDATTGKVVCRNGLLVIRDDPEGLEFPWGPKPFREVIAGPLLRNNGQSLESSSLEGSHVGVYFSAHWCPPCRSLTRVLVESYRKIKEAGQNFEIIFVSADRSEESFKQYFSEMPWLAVPYTDEARRSRLNRLYGIQGIPTLIMLDPQGEVITRQGRVEVLNDEDCREFPWHPKPVLELSDSNAAQLNEGPCLVLFVDSEDDGESEAAKQLIQPIAEKIIAKYKAKEEEAPLLFFVAGEDDMTDSLRDYTNLPEAAPLLTILDMSARAKYVMDVEEITPAIVEAFVNDFLAEKLKPEPI

SEQ ID NO: 58949 - protein, 230 aa, Homo sapiens
  Payload ID: 11512
  Gene Symbol: NXN
  Gene Name: nucleoredoxin
  ENSP ID: ENSP00000461562
  MOD_RES (1)..(1): Any amino acid
XCRNGLLVIRDDPEGLEFPWGPKPFREVIAGPLLRNNGQSLESSSLEGSHVGVYFSAHWCPPCRSLTRVLVESYRKIKEAGQNFEIIFVSADRSEESFKQYFSEMPWLAVPYTDEARRSRLNRLYGIQDSEDDGESEAAKQLIQPIAEKIIAKYKAKEEEAPLLFFVAGEDDMTDSLRDYTNLPEAAPLLTILDMSARAKYVMDVEEITPAIVEAFVNDFLAEKLKPEPI

SEQ ID NO: 58950 - protein, 120 aa, Homo sapiens
  Payload ID: 11512
  Gene Symbol: NXN
  Gene Name: nucleoredoxin
  ENSP ID: ENSP00000485936
MSGFLEELLGEKLVTGGGEEVDVHSLGARGISLLGLYFGCSLSAPCAQLSASLAAFYGRLRGDAAAGPGPGAGAGAAAEPEPRRRLEIVFVSSDQDQRQWQDFVRDMPWLALPYKEKHRK

SEQ ID NO: 58951 - protein, 120 aa, Homo sapiens; identical to SEQ ID NO: 58950
  Payload ID: 11512
  Gene Symbol: NXN
  Gene Name: nucleoredoxin
  ENSP ID: ENSP00000486232

SEQ ID NO: 58952 - protein, 212 aa, Homo sapiens
  Payload ID: 11513
  Gene Symbol: NXNL1
  Gene Name: nucleoredoxin-like 1
  Uniprot ID: Q96CM4
  ENSP ID: ENSP00000305631
MASLFSGRILIRNNSDQDELDTEAEVSRRLENRLVLLFFGAGACPQCQAFVPILKDFFVRLTDEFYVLRAAQLALVYVSQDSTEEQQDLFLKDMPKKWLFLPFEDDLRRDLGRQFSVERLPAVVVLKPDGDVLTRDGADEIQRLGTACFANWQEAAEVLDRNFQLPEDLEDQEPRSLTECLRRHKYRVEKAARGGRDPGGGGGEEGGAGGLF

SEQ ID NO: 58953 - protein, 156 aa, Homo sapiens
  Payload ID: 11514
  Gene Symbol: NXNL2
  Gene Name: nucleoredoxin-like 2
  Uniprot ID: Q5VZ03
  ENSP ID: ENSP00000365014
MVDILGERHLVTCKGATVEAEAALQNKVVALYFAAARCAPSRDFTPLLCDFYTALVAEARRPAPFEVVFVSADGSSQEMLDFMRELHGAWLALPFHDPYRHELRKRYNVTAIPKLVIVKQNGEVITNKGRKQIRERGLACFQDWVEAADIFQNFSV

SEQ ID NO: 58954 - protein, 135 aa, Homo sapiens
  Payload ID: 11514
  Gene Symbol: NXNL2
  Gene Name: nucleoredoxin-like 2
  Uniprot ID: Q5VZ03
  ENSP ID: ENSP00000365015
MVDILGERHLVTCKGATVEAEAALQNKVVALYFAAARCAPSRDFTPLLCDFYTALVAEARRPAPFEVVFVSADGSSQEMLDFMRELHGAWLALPFHDPYRQRSLALLPRLECSGVILAHCNLCLLGSSDSLALAS

SEQ ID NO: 58955 - protein, 135 aa, Homo sapiens [sequence omitted]

SEQ ID NO: 58956 - protein, 228 aa, Homo sapiens
  Payload ID: 11515
  Gene Symbol: NTPCR
  Gene Name: nucleoside-triphosphatase, cancer-related
  ENSP ID: ENSP00000355586
MARHVFLTGPPGVGKTTLIHKASEVLKSSGVPVDGFYTEEVRQGGRRIGFDVVTLSGTRGPLSRVGLEPPPGKRECRVGQYVVDLTSFEQLALPVLRNADCSSGPGQRVCVIDEIGKMELFSQLFIQAVRQTLSTPGTIILGTIPVPKGKPLALVEEIRNRKDVKVFNSPYCVIEDQSKFSSCVSQSTLTEPGWRQKLLQSLLNSEWKKRAPVVPTSVSPPFYLRWIP

SEQ ID NO: 58957 - protein, 190 aa, Homo sapiens
  Payload ID: 11515
  Gene Symbol: NTPCR
  Gene Name: nucleoside-triphosphatase, cancer-related
  Uniprot ID: Q9BSD7
  ENSP ID: ENSP00000355587
MARHVFLTGPPGVGKTTLIHKASEVLKSSGVPVDGFYTEEVRQGGRRIGFDVVTLSGTRGPLSRVGLEPPPGKRECRVGQYVVDLTSFEQLALPVLRNADCSSGPGQRVCVIDEIGKMELFSQLFIQAVRQTLSTPGTIILGTIPVPKGKPLALVEEIRNRKDVKVFNVTKENRNHLLPDIVTCVQSSRK

SEQ ID NO: 58958 - protein, 391 aa, Homo sapiens
  Payload ID: 11516
  Gene Symbol: NAP1L1
  Gene Name: nucleosome assembly protein 1-like 1
  Uniprot ID: P55209
  ENSP ID: ENSP00000261182
MADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 58959 - protein, 391 aa, Homo sapiens; identical to SEQ ID NO: 58958
  Payload ID: 11516
  Gene Symbol: NAP1L1
  Gene Name: nucleosome assembly protein 1-like 1
  Uniprot ID: P55209
  ENSP ID: ENSP00000376947

SEQ ID NO: 58960 - protein, 323 aa, Homo sapiens
  Payload ID: 11516
  Gene Symbol: NAP1L1
  Gene Name: nucleosome assembly protein 1-like 1
  Uniprot ID: P55209
  ENSP ID: ENSP00000409795
MMQNPQILAALQERLDGLVETPTGYIESLPRVVKRRVNALKNLQVKCAQIEAKFYEEVHDLERKYAVLYQPLFDKEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 58961 - protein, 208 aa, Homo sapiens
  Payload ID: 11516
  Gene Symbol: NAP1L1
  Gene Name: nucleosome assembly protein 1-like 1
  ENSP ID: ENSP00000437507
MVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 58962 - protein, 349 aa, Homo sapiens
  Payload ID: 11516
  Gene Symbol: NAP1L1
  Gene Name: nucleosome assembly protein 1-like 1
  ENSP ID: ENSP00000444759
MMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 58963 - protein, 383 aa, Homo sapiens
  Payload ID: 11516
  Gene Symbol: NAP1L1
  Gene Name: nucleosome assembly protein 1-like 1
  ENSP ID: ENSP00000445008
MADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEGYQLFEEVKSCSKLFQRWLQ

SEQ ID NO: 58964 - protein, 177 aa, Homo sapiens
  Payload ID: 11516
  Gene Symbol: NAP1L1
  Gene Name: nucleosome assembly protein 1-like 1
  ENSP ID: ENSP00000446520
  MOD_RES (1)..(1): Any amino acid
XTPTGYIESLPRVVKRRVNALKNLQVKCAQIEAKFYEEVHDLERKYAVLYQPLFDKRFEIINAIYEPTEEECEWKPDEEDEISEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMSS

SEQ ID NO: 58965 - protein, 207 aa, Homo sapiens
  Payload ID: 11516
  Gene Symbol: NAP1L1
  Gene Name: nucleosome assembly protein 1-like 1
  ENSP ID: ENSP00000446756
MADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISVSTNFILEELKEKAKIEDEKKDEEKEDPKGIPEFWLTVFKNVDLLSDMVQEHDEPILKHLKDIK

SEQ ID NO: 58966 - protein, 209 aa, Homo sapiens
  Payload ID: 11516
  Gene Symbol: NAP1L1
  Gene Name: nucleosome assembly protein 1-like 1
  ENSP ID: ENSP00000446787
MMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGP

SEQ ID NO: 58967 - protein, 198 aa, Homo sapiens
  Payload ID: 11516
  Gene Symbol: NAP1L1
  Gene Name: nucleosome assembly protein 1-like 1
  ENSP ID: ENSP00000446804
TVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISELKEKAKIEDEKKDEEKEDPKGIPEFWLTVFKNVDLLSDMVQEHDEPILKHLKDIKVKFSDAGQPMSFVLEFHFEPNEYFTNEVLTKTYRMSS

SEQ ID NO: 58968 - protein, 379 aa, Homo sapiens
  Payload ID: 11516
  Gene Symbol: NAP1L1
  Gene Name: nucleosome assembly protein 1-like 1
  ENSP ID: ENSP00000447196
MADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISIPASCLGEFSTEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEVMFTK

SEQ ID NO: 58969 - protein, 368 aa, Homo sapiens
  Payload ID: 11516
  Gene Symbol: NAP1L1
  Gene Name: nucleosome assembly protein 1-like 1
  Uniprot ID: P55209
  ENSP ID: ENSP00000447793
MADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEVMFTK

SEQ ID NO: 58970 - protein, 237 aa, Homo sapiens
  Payload ID: 11516
  Gene Symbol: NAP1L1
  Gene Name: nucleosome assembly protein 1-like 1
  ENSP ID: ENSP00000448133
MADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKK

SEQ ID NO: 58971 - protein, 328 aa, Homo sapiens
  Payload ID: 11516
  Gene Symbol: NAP1L1
  Gene Name: nucleosome assembly protein 1-like 1
  ENSP ID: ENSP00000448167
MADIDNLPRVVKRRVNALKNLQVKCAQIEAKFYEEVHDLERKYAVLYQPLFDKRFEIINAIYEPTEEECEWKPDEEDEISEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 58972 - protein, 114 aa, Homo sapiens
  Payload ID: 11516
  Gene Symbol: NAP1L1
  Gene Name: nucleosome assembly protein 1-like 1
  ENSP ID: ENSP00000448661
MMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIEDE

SEQ ID NO: 58973 - protein, 264 aa, Homo sapiens
  Payload ID: 11516
  Gene Symbol: NAP1L1
  Gene Name: nucleosome assembly protein 1-like 1
  ENSP ID: ENSP00000448764
MADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKK

SEQ ID NO: 58974 - protein, 215 aa, Homo sapiens
  Payload ID: 11516
  Gene Symbol: NAP1L1
  Gene Name: nucleosome assembly protein 1-like 1
  ENSP ID: ENSP00000448836
MADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKAEDCCHFQVKTWRLLSDLPTMNNGRAVTHIQCCEELKEKAKIEDEKKDEEKEDPKGIPEFWLTVFKNVDLLSDMVQEHDEPILKHLKDIKVKFSDAGQP

SEQ ID NO: 58975 - protein, 161 aa, Homo sapiens
  Payload ID: 11516
  Gene Symbol: NAP1L1
  Gene Name: nucleosome assembly protein 1-like 1
  ENSP ID: ENSP00000449333
MADIDNKEQSELDQDLDDVEEVEEEETGEETKLKARQLTVQMMQNPQILAALQERLDGLVETPTGYIERVSFCQPGWSAVVVQSCSIQPRHPRLSLPRVVKRRVNALKNLQVKCAQIEAKFYEEVHDLERKYAVLYQPLFDKRFEIINAIYEPTEEECEWK

SEQ ID NO: 58976 - protein, 327 aa, Homo sapiens
  Payload ID: 11516
  Gene Symbol: NAP1L1
  Gene Name: nucleosome assembly protein 1-like 1
  ENSP ID: ENSP00000449649
MMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEVMFTK

SEQ ID NO: 58977 - protein, 385 aa, Homo sapiens
  Payload ID: 11516
  Gene Symbol: NAP1L1
  Gene Name: nucleosome assembly protein 1-like 1
  ENSP ID: ENSP00000450236
KEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 58978 - protein, 391 aa, Homo sapiens; identical to SEQ ID NO: 58958
  Payload ID: 11516
  Gene Symbol: NAP1L1
  Gene Name: nucleosome assembly protein 1-like 1
  Uniprot ID: P55209
  ENSP ID: ENSP00000477538

SEQ ID NO: 58979 - protein, 460 aa, Homo sapiens
  Payload ID: 11517
  Gene Symbol: NAP1L2
  Gene Name: nucleosome assembly protein 1-like 2
  Uniprot ID: Q9ULW6
  ENSP ID: ENSP00000362616
MAESENRKELSESSQEEAGNQIMVEGLGEHLERGEDAAAGLGDDGKCGEEAAAGLGEEGENGEDTAAGSGEDGKKGGDTDEDSEADRPKGLIGYVLDTDFVESLPVKVKYRVLALKKLQTRAANLESKFLREFHDIERKFAEMYQPLLEKRRQIINAIYEPTEEECEYKSDSEDCDDEEMCHEEMYGNEEGMVHEYVDEDDGYEDYYYDYAVEEEEEEEEEDDIEATGEENKEEEDPKGIPDFWLTVLKNVDTLTPLIKKYDEPILKLLTDIKVKLSDPGEPLSFTLEFHFKPNEYFKNELLTKTYVLKSKLAYYDPHPYRGTAIEYSTGCEIDWNEGKNVTLKTIKKKQKHRIWGTIRTVTEDFPKDSFFNFFSPHGITSNGRDGNDDFLLGHNLRTYIIPRSVLFFSGDALESQQEGVVREVNDAIYDKIIYDNWMAAIEEVKACCKNLEALVEDIDR

SEQ ID NO: 58980 - protein, 506 aa, Homo sapiens
  Payload ID: 11518
  Gene Symbol: NAP1L3
  Gene Name: nucleosome assembly protein 1-like 3
  Uniprot ID: Q99457
  ENSP ID: ENSP00000362171
MAEADFKMVSEPVAHGVAEEEMASSTSDSGEESDSSSSSSSTSDSSSSSSTSGSSSGSGSSSSSSGSTSSRSRLYRKKRVPEPSRRARRAPLGTNFVDRLPQAVRNRVQALRNIQDECDKVDTLFLKAIHDLERKYAELNKPLYDRRFQIINAEYEPTEEECEWNSEDEEFSSDEEVQDNTPSEMPPLEGEEEENPKENPEVKAEEKEVPKEIPEVKDEEKEVPKEIPEVKAEEKADSKDCMEATPEVKEDPKEVPQVKADDKEQPKATEAKARAAVRETHKRVPEERLQDSVDLKRARKGKPKREDPKGIPDYWLIVLKNVDKLGPMIQKYDEPILKFLSDVSLKFSKPGQPVSYTFEFHFLPNPYFRNEVLVKTYIIKAKPDHNDPFFSWGWEIEDCKGCKIDWRRGKDVTVTTTQSRTTATGEIEIQPRVVPNASFFNFFSPPEIPMIGKLEPREDAILDEDFEIGQILHDNVILKSIYYYTGEVNGTYYQFGKHYGNKKYRK

SEQ ID NO: 58981 - protein, 499 aa, Homo sapiens
  Payload ID: 11518
  Gene Symbol: NAP1L3
  Gene Name: nucleosome assembly protein 1-like 3
  ENSP ID: ENSP00000476891
MVSEPVAHGVAEEEMASSTSDSGEESDSSSSSSSTSDSSSSSSTSGSSSGSGSSSSSSGSTSSRSRLYRKKRVPEPSRRARRAPLGTNFVDRLPQAVRNRVQALRNIQDECDKVDTLFLKAIHDLERKYAELNKPLYDRRFQIINAEYEPTEEECEWNSEDEEFSSDEEVQDNTPSEMPPLEGEEEENPKENPEVKAEEKEVPKEIPEVKDEEKEVPKEIPEVKAEEKADSKDCMEATPEVKEDPKEVPQVKADDKEQPKATEAKARAAVRETHKRVPEERLQDSVDLKRARKGKPKREDPKGIPDYWLIVLKNVDKLGPMIQKYDEPILKFLSDVSLKFSKPGQPVSYTFEFHFLPNPYFRNEVLVKTYIIKAKPDHNDPFFSWGWEIEDCKGCKIDWRRGKDVTVTTTQSRTTATGEIEIQPRVVPNASFFNFFSPPEIPMIGKLEPREDAILDEDFEIGQILHDNVILKSIYYYTGEVNGTYYQFGKHYGNKKYRK

SEQ ID NO: 58982 - protein, 375 aa, Homo sapiens
  Payload ID: 11519
  Gene Symbol: NAP1L4
  Gene Name: nucleosome assembly protein 1-like 4
  Uniprot ID: Q99733
  ENSP ID: ENSP00000369915
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQEYDEPILKHLQDIKVKFSDPGQPMSFVLEFHFEPNDYFTNSVLTKTYKMKSEPDKADPFSFEGPEIVDCDGCTIDWKKGKNVTVKTIKKKQKHKGRGTVRTITKQVPNESFFNFFNPLKASGDGESLDEDSEFTLASDFEIGHFFRERIVPRAVLYFTGEAIEDDDNFEEGEEGEEEELEGDEEGEDEDDAEINPKV

SEQ ID NO: 58983 - protein, 156 aa, Homo sapiens
  Payload ID: 11519
  Gene Symbol: NAP1L4
  Gene Name: nucleosome assembly protein 1-like 4
  ENSP ID: ENSP00000382523
MQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQEYDEPILKH

SEQ ID NO: 58984 - protein, 278 aa, Homo sapiens
  Payload ID: 11519
  Gene Symbol: NAP1L4
  Gene Name: nucleosome assembly protein 1-like 4
  ENSP ID: ENSP00000387783
MADHSFSDGVPSDSVEAAKNASNTEKLTDQVMQNPRVLAALQERLDNVPHTPSSYIETHEDVVFLTPFFSLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQEYDEPILKHLQDIKVKFSDPGQPMSFVLEFHFEPNDYFTNSVLTKTYKMKSEPDKADPFSFEGPEIVDCDGCTIDWKKGKNVTVKTIK

SEQ ID NO: 58985 - protein, 178 aa, Homo sapiens
  Payload ID: 11519
  Gene Symbol: NAP1L4
  Gene Name: nucleosome assembly protein 1-like 4
  ENSP ID: ENSP00000405912
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQ

SEQ ID NO: 58986 - protein, 101 aa, Homo sapiens
  Payload ID: 11519
  Gene Symbol: NAP1L4
  Gene Name: nucleosome assembly protein 1-like 4
  ENSP ID: ENSP00000412048
MADHSFSDGVPSDSVEAAKNASNTEKLTDQVMQNPRVLAALQERLDNVPHTPSSYIETHEDVVFLTPFFSLPKAVKRRINALKQLQVRCAHIEAKFYEEVH

SEQ ID NO: 58987 - protein, 204 aa, Homo sapiens
  Payload ID: 11519
  Gene Symbol: NAP1L4
  Gene Name: nucleosome assembly protein 1-like 4
  ENSP ID: ENSP00000431644
EKAAATAEEPDPKGIPEFWFTIFRNVDMLSELVQEYDEPILKHLQDIKVKFSDPGQPMSFVLEFHFEPNDYFTNSVLTKTYKMKSEPDKADPFSFEGPEIVDCDGCTIDWKKGKNVTVKTIKKKQKHKGRGTVRTITKQVPNESFFNFFNPLKASGDGESLDEDSEFTLASDFEIGHFFRERIVPRAVLYFTGEAIEDDDNPDM

SEQ ID NO: 58988 - protein, 128 aa, Homo sapiens
  Payload ID: 11519
  Gene Symbol: NAP1L4
  Gene Name: nucleosome assembly protein 1-like 4
  ENSP ID: ENSP00000431799
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENE

SEQ ID NO: 58989 - protein, 133 aa, Homo sapiens
  Payload ID: 11519
  Gene Symbol: NAP1L4
  Gene Name: nucleosome assembly protein 1-like 4
  ENSP ID: ENSP00000432126
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKL

SEQ ID NO: 58990 - protein, 78 aa, Homo sapiens
  Payload ID: 11519
  Gene Symbol: NAP1L4
  Gene Name: nucleosome assembly protein 1-like 4
  ENSP ID: ENSP00000433512
MADHSFSDGVPSDSVEAAKNASNTEKLTDQVMQNPRVLAALQERLDNVPHTPSSYIETLPKAVKRRINALKQLQVRCA

SEQ ID NO: 58991 - protein, 140 aa, Homo sapiens
  Payload ID: 11519
  Gene Symbol: NAP1L4
  Gene Name: nucleosome assembly protein 1-like 4
  ENSP ID: ENSP00000434759
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSK

SEQ ID NO: 58992 - protein, 169 aa, Homo sapiens
  Payload ID: 11519
  Gene Symbol: NAP1L4
  Gene Name: nucleosome assembly protein 1-like 4
  ENSP ID: ENSP00000435327
MADHSFSDGVPSDSVEAAKNASNTEKLTDQVMQNPRVLAALQERLDNVPHTPSSYIETHEDVVFLTPFFSLPKAVKRRINALKQLQVRCAHIEAKFYEEVHDLERKYAALYQPLFDKRREFITGDVEPTDAESEWHSENEEEEKLAGDMKSKVVVTEKAAATAEEPDPK

SEQ ID NO: 58993 - protein, 386 aa, Homo sapiens
  Payload ID: 11519
  Gene Symbol: NAP1L4
  Gene Name: nucleosome assembly protein 1-like 4
  Uniprot ID: Q99733
  ENSP ID: ENSP00000436397
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQEYDEPILKHLQDIKVKFSDPGQPMSFVLEFHFEPNDYFTNSVLTKTYKMKSEPDKADPFSFEGPEIVDCDGCTIDWKKGKNVTVKTIKKKQKHKGRGTVRTITKQVPNESFFNFFNPLKASGDGESLDEDSEFTLASDFEIGHFFRERIVPRAVLYFTGEAIEDDDNFEEGEEGEEEELEGDEEGEDEDDAEINPKKEPSQPAECKQQ

SEQ ID NO: 58994 - protein, 154 aa, Homo sapiens
  Payload ID: 11519
  Gene Symbol: NAP1L4
  Gene Name: nucleosome assembly protein 1-like 4
  ENSP ID: ENSP00000436488
MADHSFSDGVPSDSVEAAKNASNTEKLTDQVMQNPRVLAALQERLDNVPHTPSSYIETLPKAVKRRINALKQLQDIKVKFSDPGQPMSFVLEFHFEPNDYFTNSVLTKTYKMKSEPDKADPFSFEGPEIVDCDGCTIDWKKGKNVTVKTIKKKQ

SEQ ID NO: 58995 - protein, 107 aa, Homo sapiens
  Payload ID: 11519
  Gene Symbol: NAP1L4
  Gene Name: nucleosome assembly protein 1-like 4
  ENSP ID: ENSP00000437130
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRR

SEQ ID NO: 58996 - protein, 386 aa, Homo sapiens; identical to SEQ ID NO: 58993
  Payload ID: 11519
  Gene Symbol: NAP1L4
  Gene Name: nucleosome assembly protein 1-like 4
  Uniprot ID: Q99733
  ENSP ID: ENSP00000478654

SEQ ID NO: 58997 - protein, 386 aa, Homo sapiens; identical to SEQ ID NO: 58993
  Payload ID: 11519
  Gene Symbol: NAP1L4
  Gene Name: nucleosome assembly protein 1-like 4
  Uniprot ID: Q99733
  ENSP ID: ENSP00000481412

SEQ ID NO: 58998 - protein, 375 aa, Homo sapiens; identical to SEQ ID NO: 58982
  Payload ID: 11519
  Gene Symbol: NAP1L4
  Gene Name: nucleosome assembly protein 1-like 4
  Uniprot ID: Q99733
  ENSP ID: ENSP00000483728

SEQ ID NO: 58999 - protein, 133 aa, Homo sapiens; identical to SEQ ID NO: 58989
  Payload ID: 11519
  Gene Symbol: NAP1L4
  Gene Name: nucleosome assembly protein 1-like 4
  ENSP ID: ENSP00000487825

SEQ ID NO: 59000 - protein, 156 aa, Homo sapiens; identical to SEQ ID NO: 58983
  Payload ID: 11519
  Gene Symbol: NAP1L4
  Gene Name: nucleosome assembly protein 1-like 4
  ENSP ID: ENSP00000487901

SEQ ID NO: 59001 - protein, 386 aa, Homo sapiens; identical to SEQ ID NO: 58993
  Payload ID: 11519
  Gene Symbol: NAP1L4
  Gene Name: nucleosome assembly protein 1-like 4
  Uniprot ID: Q99733
  ENSP ID: ENSP00000487984

SEQ ID NO: 59002 - protein, 204 aa, Homo sapiens; identical to SEQ ID NO: 58987
  Payload ID: 11519
  Gene Symbol: NAP1L4
  Gene Name: nucleosome assembly protein 1-like 4
  ENSP ID: ENSP00000488078

SEQ ID NO: 59003 - protein, 128 aa, Homo sapiens; identical to SEQ ID NO: 58988
  Payload ID: 11519
  Gene Symbol: NAP1L4
  Gene Name: nucleosome assembly protein 1-like 4
  ENSP ID: ENSP00000488208

SEQ ID NO: 59004 - protein, 169 aa, Homo sapiens; identical to SEQ ID NO: 58992
  Payload ID: 11519
  Gene Symbol: NAP1L4
  Gene Name: nucleosome assembly protein 1-like 4
  ENSP ID: ENSP00000488420

SEQ ID NO: 59005 - protein, 178 aa, Homo sapiens; identical to SEQ ID NO: 58985
  Payload ID: 11519
  Gene Symbol: NAP1L4
  Gene Name: nucleosome assembly protein 1-like 4
  ENSP ID: ENSP00000488479

SEQ ID NO: 59006 - protein, 278 aa, Homo sapiens; identical to SEQ ID NO: 58984
  Payload ID: 11519
  Gene Symbol: NAP1L4
  Gene Name: nucleosome assembly protein 1-like 4
  ENSP ID: ENSP00000488498

SEQ ID NO: 59007 - protein, 101 aa, Homo sapiens; identical to SEQ ID NO: 58986
  Payload ID: 11519
  Gene Symbol: NAP1L4
  Gene Name: nucleosome assembly protein 1-like 4
  ENSP ID: ENSP00000488634

SEQ ID NO: 59008 - protein, 107 aa, Homo sapiens; identical to SEQ ID NO: 58995
  Payload ID: 11519
  Gene Symbol: NAP1L4
  Gene Name: nucleosome assembly protein 1-like 4
  ENSP ID: ENSP00000488709

SEQ ID NO: 59009 - protein, 140 aa, Homo sapiens; identical to SEQ ID NO: 58991
  Payload ID: 11519
  Gene Symbol: NAP1L4
  Gene Name: nucleosome assembly protein 1-like 4
  ENSP ID: ENSP00000488770

SEQ ID NO: 59010 - protein, 78 aa, Homo sapiens; identical to SEQ ID NO: 58990
  Payload ID: 11519
  Gene Symbol: NAP1L4
  Gene Name: nucleosome assembly protein 1-like 4
  ENSP ID: ENSP00000488875

SEQ ID NO: 59011 - protein, 182 aa, Homo sapiens
  Payload ID: 11520
  Gene Symbol: NAP1L5
  Gene Name: nucleosome assembly protein 1-like 5
  Uniprot ID: Q96NT1
  ENSP ID: ENSP00000320488
MADSENQGPAEPSQAAAAAEAAAEEVMAEGGAQGGDCDSAAGDPDSAAGQMAEEPQTPAENAPKPKNDFIESLPNSVKCRVLALKKLQKRCDKIEAKFDKEFQALEKKYNDIYKPLLAKIQELTGEMEGCAWTLEGEEEEEEEYEDDEEEGEDEEEEEAAAEAAAGAKHDDAHAEMPDDAKK

SEQ ID NO: 59012 - protein, 107 aa, Homo sapiens
  Payload ID: 11521
  Gene Symbol: NAP1L6
  Gene Name: nucleosome assembly protein 1-like 6
  Uniprot ID: A6NFF2
  ENSP ID: ENSP00000362617
MMEGLGEHSTAGEMGPLLGAVAATASPQSLMEYSSDADFIESLPLVVKYRVYTLKKLQAKCAVLEAKYLREFHSVERKFATIYGPLLEKRRQITNALYEPTKEECER

SEQ ID NO: 59013 - protein, 320 aa, Homo sapiens
  Payload ID: 11522
  Gene Symbol: NUBP1
  Gene Name: nucleotide binding protein 1
  Uniprot ID: P53384
  ENSP ID: ENSP00000283027
MEEVPHDCPGADSAQAGRGASCQGCPNQRLCASGAGATPDTAIEEIKEKMKTVKHKILVLSGKGGVGKSTFSAHLAHGLAEDENTQIALLDIDICGPSIPKIMGLEGEQVHQSGSGWSPVYVEDNLGVMSVGFLLSSPDDAVIWRGPKKNGMIKQFLRDVDWGEVDYLIVDTPPGTSDEHLSVVRYLATAHIDGAVIITTPQEVSLQDVRKEINFCRKVKLPIIGVVENMSGFICPKCKKESQIFPPTTGGAELMCQDLEVPLLGRVPLDPLIGKNCDKGQSFFIDAPDSPATLAYRSIIQRIQEFCNLHQSKEENLISS

SEQ ID NO: 59014 - protein, 309 aa, Homo sapiens
  Payload ID: 11522
  Gene Symbol: NUBP1
  Gene Name: nucleotide binding protein 1
  Uniprot ID: P53384
  ENSP ID: ENSP00000409654
MEEVPHDCPGADSAQAGRGASCQGCPNQRLCASGAGATPDTAIEEIKEKMKTVKHKILVLSGKGGVGKSTFSAHLAHGLAEDENTQIALLDIDICGPSIPKIMGLEGEQYVEDNLGVMSVGFLLSSPDDAVIWRGPKKNGMIKQFLRDVDWGEVDYLIVDTPPGTSDEHLSVVRYLATAHIDGAVIITTPQEVSLQDVRKEINFCRKVKLPIIGVVENMSGFICPKCKKESQIFPPTTGGAELMCQDLEVPLLGRVPLDPLIGKNCDKGQSFFIDAPDSPATLAYRSIIQRIQEFCNLHQSKEENLISS

SEQ ID NO: 59015 - protein, 142 aa, Homo sapiens
  Payload ID: 11522
  Gene Symbol: NUBP1
  Gene Name: nucleotide binding protein 1
  ENSP ID: ENSP00000460288
  MOD_RES (1)..(1): Any amino acid
XMIKQFLRDVDWGEVDYLIVDTPPGTSDEHLSVVRYLATAHIDGAVIITTPQEVSLQDVRKEINFCRKVKLPIIGVVENMSGFICPKCKKESQIFPPTTGGAELMCQDLEVPLLGRVPLDPLIGIQEFCNLHQSKEENLISS

SEQ ID NO: 59016 - protein, 63 aa, Homo sapiens
  Payload ID: 11522
  Gene Symbol: NUBP1
  Gene Name: nucleotide binding protein 1
  ENSP ID: ENSP00000461723
  MOD_RES (1)..(1): Any amino acid
XITTPQEVSLQDVRKEINFCRKVKLPIIGVVENMSGFICPKCKVRIVTKASLFSLTPQIPQPR

SEQ ID NO: 59017 - protein, 168 aa, Homo sapiens
  Payload ID: 11522
  Gene Symbol: NUBP1
  Gene Name: nucleotide binding protein 1
  ENSP ID: ENSP00000461746
MEEVPHDCPGADSAQAGRGASCQGCPNQRLCASGAGATPDTAIEEIKEKMKTVKHKILVLSGKGGVGKSTFSAHLAHGLAEDENTQVHQSGSGWSPVYVEDNLGVMSVGFLLSSPDDAVIWRGPKKNGMIKQFLRDVDWGEVDYLIVDTPPGTSDEHLSVVRYLATAH

SEQ ID NO: 59018 - protein, 271 aa, Homo sapiens
  Payload ID: 11523
  Gene Symbol: NUBP2
  Gene Name: nucleotide binding protein 2
  Uniprot ID: Q9Y5Y2
  ENSP ID: ENSP00000262302
MEAAAEPGNLAGVRHIILVLSGKGGVGKSTISTELALALRHAGKKVGILDVDLCGPSIPRMLGAQGRAVHQCDRGWAPVFLDREQSISLMSVGFLLEKPDEAVVWRGPKKNALIKQFVSDVAWGELDYLVVDTPPGTSDEHMATIEALRPYQPLGALVVTTPQAVSVGDVRRELTFCRKTGLRVMGIVENMSGFTCPHCTECTSVFSRGGGEELAQLAGVPFLGSVPLDPALMRTLEEGHDFIQEFPGSPAFAALTSIAQKILDATPACLP

SEQ ID NO: 59019 - protein, 139 aa, Homo sapiens
  Payload ID: 11523
  Gene Symbol: NUBP2
  Gene Name: nucleotide binding protein 2
  ENSP ID: ENSP00000454576
MEAAAEPGNLAGVRHIILVLSGKGGVGKSTISTELALALRHAGKKAVPLLAGGNPGCGPVWPQYPPHARGAGQGCAPVRPRLGTRLPGPGAEHLAHVCGLPAGEAGRGRGVERPQEKRADKAVCVRRGLGGAGLPGGGH

SEQ ID NO: 59020 - protein, 251 aa, Homo sapiens [sequence omitted]

SEQ ID NO: 59021 - protein, 271 aa, Homo sapiens
  Payload ID: 11523
  Gene Symbol: NUBP2
  Gene Name: nucleotide binding protein 2
  ENSP ID: ENSP00000454982
MEAAAGVWGWGCLFRVPWRRPQAASVGLRTRLHARFSGRLWTWEPLNVPLRGGSEGGRFYASCVEPLTCTLQGPVGDGAACWRQGAWPQRWRREPGNLAGVRHIILVLSGKGGVGKSTISTELALALRHAGKKVGILDVDLCGPSIPRMLGAQGRAVHQCDRGWAPVFLDREQSISLMSVGFLLEKPDEAVVWRGPKKNALIKQFVSDVAWGELDYLVVDTPPGTSDEHMATIEALRPYQPLGALVVTTPQAVSVGDVRRELTFCRKTGLR

SEQ ID NO: 59022 - protein, 58 aa, Homo sapiens
  Payload ID: 11523
  Gene Symbol: NUBP2
  Gene Name: nucleotide binding protein 2
  ENSP ID: ENSP00000455739
  MOD_RES (1)..(1): Any amino acid
XEAAAGEWRARVRSRSRASLGAPPRPFPGRPRCVARLRCDHHRPAWLGRARGRGAGIF

SEQ ID NO: 59023 - protein, 211 aa, Homo sapiens
  Payload ID: 11523
  Gene Symbol: NUBP2
  Gene Name: nucleotide binding protein 2
  ENSP ID: ENSP00000455896
MLGAQGRAVHQCDRGWAPVFLDREQSISLMSVGFLLEKPDEAVVWRGPKKNALIKQFVSDVAWGELDYLVVDTPPGTSDEHMATIEALRPYQPLGALVVTTPQAVSVGDVRRELTFCRKTGLRVMGIVENMSGFTCPHCTECTSVFSRGGGEELAQLAGVPFLGSVPLDPALMRTLEEGHDFIQEFPGSPAFAALTSIAQKILDATPACLP

SEQ ID NO: 59024 - protein, 144 aa, Homo sapiens
  Payload ID: 11523
  Gene Symbol: NUBP2
  Gene Name: nucleotide binding protein 2
  ENSP ID: ENSP00000456199
MLGAQGRAVHQCDRGWAPVFLDREQSISLMSVGFLLEKPDEAVVWRGPKKNALIKQFVSDVAWGELDYLVVDTPPGTSDEHMATIEALRPYQPLGALVVTTPQAVSVGDVRRELTFCRKTGLRVMGIVENMSGFTCPHCTECTS

SEQ ID NO: 59025 - protein, 46 aa, Homo sapiens
  Payload ID: 11523
  Gene Symbol: NUBP2
  Gene Name: nucleotide binding protein 2
  ENSP ID: ENSP00000456284
MEAAAEPGNLAGVRHIILVLSGKGGVGKSTISTELALALRHAGKKR

SEQ ID NO: 59026 - protein, 46 aa, Homo sapiens; identical to SEQ ID NO: 59025
  Payload ID: 11523
  Gene Symbol: NUBP2
  Gene Name: nucleotide binding protein 2
  ENSP ID: ENSP00000456928

SEQ ID NO: 59027 - protein, 130 aa, Homo sapiens
  Payload ID: 11523
  Gene Symbol: NUBP2
  Gene Name: nucleotide binding protein 2
  ENSP ID: ENSP00000460079
MATIEALRPYQPLGALVVTTPQAVSVGDVRRELTFCRKTGLRVMGIVENMSGFTCPHCTECTSVFSRGGGEELAQLAGVPFLGSVPLDPALMRTLEEGHDFIQEFPGSPAFAALTSIAQKILDATPACLP

SEQ ID NO: 59028 - protein, 319 aa, Homo sapiens
  Payload ID: 11524
  Gene Symbol: NUBPL
  Gene Name: nucleotide binding protein-like
  Uniprot ID: Q8TB37
  ENSP ID: ENSP00000281081
MGIWQRLLLFGGVSLRAGGGATAPLGGSRAMVCGRQLSGAGSETLKQRRTQIMSRGLPKQKPIEGVKQVIVVASGKGGVGKSTTAVNLALALAANDSSKAIGLLDVDVYGPSVPKMMNLKGNPELSQSNLMRPLLNYGIACMSMGFLVEESEPVVWRGLMVMSAIEKLLRQVDWGQLDYLVVDMPPGTGDVQLSVSQNIPITGAVIVSTPQDIALMDAHKGAEMFRRVHVPVLGLVQNMSVFQCPKCKHKTHIFGADGARKLAQTLGLEVLGDIPLHLNIREASDTGQPIVFSQPESDEAKAYLRIAVEVVRRLPSPSE

SEQ ID NO: 59029 - protein, 54 aa, Homo sapiens
  Payload ID: 11524
  Gene Symbol: NUBPL
  Gene Name: nucleotide binding protein-like
  ENSP ID: ENSP00000446511
MMRIEVKVKMMLSGAGSETLKQRRTQIMSRGLPKQKPIEGVKQVIVVASGKGGV

SEQ ID NO: 59030 - protein, 133 aa, Homo sapiens
  Payload ID: 11524
  Gene Symbol: NUBPL
  Gene Name: nucleotide binding protein-like
  ENSP ID: ENSP00000447234
MSRGLPKQKPIEGVKQVIVVASGKGGVGKSTTAVNLALALAANDSSKAIGLLDVDVYGPSVPKMMNLKGNPELSQSNLMRPLLNYGIACMSMGFLVEESEPVVWRGLMVMSAIEKLLRQVDWGQLDYLVVDMP

SEQ ID NO: 59031 - protein, 103 aa, Homo sapiens
  Payload ID: 11524
  Gene Symbol: NUBPL
  Gene Name: nucleotide binding protein-like
  ENSP ID: ENSP00000447316
MGIWQRLLLFGGVSLRAGGGATAPLGGSRAMVCGRQLSGAGSETLKQRRTQIMSRGLPKQKPIEGVKQVIVVASGKGGVGKSTTAVETGFHRVNQDGLHLLIS

SEQ ID NO: 59032 - protein, 167 aa, Homo sapiens
  Payload ID: 11524
  Gene Symbol: NUBPL
  Gene Name: nucleotide binding protein-like
  ENSP ID: ENSP00000447618
MGIWQRLLLFGGVSLRAGGGATAPLGGSRAMVCGRQLSGAGSETLKQRRTQIMSRGLPKQKPIEGVKQVIVVASGKGGVGKSTTAVNLALALAANDSVLGLVQNMSVFQCPKCKHKTHIFGADGARKLAQTLGLEVLGDIPLHLNIREASDTGQPIVFSQPESDEAK

SEQ ID NO: 59033 - protein, 130 aa, Homo sapiens
  Payload ID: 11524
  Gene Symbol: NUBPL
  Gene Name: nucleotide binding protein-like
  ENSP ID: ENSP00000447658
VSLRAGGGATAPLGGSRAMVCGRQLSGAGSETLKQRRTQIMSRGLPKQKPIEGVKQVIVVASGKGGVGKSTTAVNLALALAANDSSKAIGLLDVDVYGPSVPKMMNLKGNPELSQSISQRCCRSCSRPPQ

SEQ ID NO: 59034 - protein, 173 aa, Homo sapiens
  Payload ID: 11524
  Gene Symbol: NUBPL
  Gene Name: nucleotide binding protein-like
  Uniprot ID: Q8TB37
  ENSP ID: ENSP00000449918
MGIWQRLLLFGGVSLRAGGGATAPLGGSRAMVCGRQLSGAGSETLKQRRTQIMSRGLPKQKPIEGVKQVIVVASGKGGVGKSTTAVNLALALAANDSSKAIGLLDVDVYGPSVPKMMNLKGNPELSQSNLMRPLLNYGIACMSMGFLVEESEPVVWRGLMVMSAIEKLLRQVL

SEQ ID NO: 59035 - protein, 953 aa, Homo sapiens
  Payload ID: 11525
  Gene Symbol: NOD1
  Gene Name: nucleotide-binding oligomerization domain containing 1
  Uniprot ID: Q9Y239
  ENSP ID: ENSP00000222823
MEEQGHSEMEIIPSESHPHIQLLKSNRELLVTHIRNTQCLVDNLLKNDYFSAEDAEIVCACPTQPDKVRKILDLVQSKGEEVSEFFLYLLQQLADAYVDLRPWLLEIGFSPSLLTQSKVVVNTDPVSRYTQQLRHHLGRDSKFVLCYAQKEELLLEEIYMDTIMELVGFSNESLGSLNSLACLLDHTTGILNEQGETIFILGDAGVGKSMLLQRLQSLWATGRLDAGVKFFFHFRCRMFSCFKESDRLCLQDLLFKHYCYPERDPEEVFAFLLRFPHVALFTFDGLDELHSDLDLSRVPDSSCPWEPAHPLVLLANLLSGKLLKGASKLLTARTGIEVPRQFLRKKVLLRGFSPSHLRAYARRMFPERALQDRLLSQLEANPNLCSLCSVPLFCWIIFRCFQHFRAAFEGSPQLPDCTMTLTDVFLLVTEVHLNRMQPSSLVQRNTRSPVETLHAGRDTLCSLGQVAHRGMEKSLFVFTQEEVQASGLQERDMQLGFLRALPELGPGGDQQSYEFFHLTLQAFFTAFFLVLDDRVGTQELLRFFQEWMPPAGAATTSCYPPFLPFQCLQGSGPAREDLFKNKDHFQFTNLFLCGLLSKAKQKLLRHLVPAAALRRKRKALWAHLFSSLRGYLKSLPRVQVESFNQVQAMPTFIWMLRCIYETQSQKVGQLAARGICANYLKLTYCNACSADCSALSFVLHHFPKRLALDLDNNNLNDYGVRELQPCFSRLTVLRLSVNQITDGGVKVLSEELTKYKIVTYLGLYNNQITDVGARYVTKILDECKGLTHLKLGKNKITSEGGKYLALAVKNSKSISEVGMWGNQVGDEGAKAFAEALRNHPSLTTLSLASNGISTEGGKSLARALQQNTSLEILWLTQNELNDEVAESLAEMLKVNQTLKHLWLIQNQITAKGTAQLADALQSNTGITEICLNGNLIKPEEAKVYEDEKRIICF

SEQ ID NO: 59036 - protein, 59 aa, Homo sapiens
  Payload ID: 11525
  Gene Symbol: NOD1
  Gene Name: nucleotide-binding oligomerization domain containing 1
  ENSP ID: ENSP00000395551
MEEQGHSEMEIIPSESHPHIQLLKSNRELLVTHIRNTQCLVDNLLKNDYFSAEDAEIVC

SEQ ID NO: 59037 - protein, 59 aa, Homo sapiens; identical to SEQ ID NO: 59036
  Payload ID: 11525
  Gene Symbol: NOD1
  Gene Name: nucleotide-binding oligomerization domain containing 1
  ENSP ID: ENSP00000396046

SEQ ID NO: 59038 - protein, 59 aa, Homo sapiens; identical to SEQ ID NO: 59036
  Payload ID: 11525
  Gene Symbol: NOD1
  Gene Name: nucleotide-binding oligomerization domain containing 1
  ENSP ID: ENSP00000399505

SEQ ID NO: 59039 - protein, 45 aa, Homo sapiens
  Payload ID: 11525
  Gene Symbol: NOD1
  Gene Name: nucleotide-binding oligomerization domain containing 1
  ENSP ID: ENSP00000410917
MEEQGHSEMEIIPSESHPHIQLLKSNRELLVTHIRNTQCLVDNLL

SEQ ID NO: 59040 - protein, 779 aa, Homo sapiens
  Payload ID: 11525
  Gene Symbol: NOD1
  Gene Name: nucleotide-binding oligomerization domain containing 1
  ENSP ID: ENSP00000416946
MEEQGHSEMEIIPSESHPHIQLLKSNRELLVTHIRNTQCLVDNLLKNDYFSAEDAEIVCACPTQPDKVRKILDLVQSKGEEVSEFFLYLLQQLADAYVDLRPWLLEIGFSPSLLTQSKVVVNTDPVSRYTQQLRHHLGRDSKFVLCYAQKEELLLEEIYMDTIMELVGFSNESLGSLNSLACLLDHTTGILNEQGETIFILGDAGVGKSMLLQRLQSLWATGRLDAGVKFFFHFRCRMFSCFKESDRLCLQDLLFKHYCYPERDPEEVFAFLLRFPHVALFTFDGLDELHSDLDLSRVPDSSCPWEPAHPLVLLANLLSGKLLKGASKLLTARTGIEVPRQFLRKKVLLRGFSPSHLRAYARRMFPERALQDRLLSQLEANPNLCSLCSVPLFCWIIFRCFQHFRAAFEGSPQLPDCTMTLTDVFLLVTEVHLNRMQPSSLVQRNTRSPVETLHAGRDTLCSLGQVAHRGMEKSLFVFTQEEVQASGLQERDMQLGFLRALPELGPGGDQQSYEFFHLTLQAFFTAFFLVLDDRVGTQELLRFFQEWMPPAGAATTSCYPPFLPFQCLQGSGPAREDLFKNKDHFQFTNLFLCGLLSKAKQKLLRHLVPAAALRRKRKALWAHLFSSLRGYLKSLPRVQVESFNQVQAMPTFIWMLRCIYETQSQKVGQLAARGICANYLKLTYCNACSADCSALSFVLHHFPKRLALDLDNNNLNDYGVRELQPCFSRLTVLRLSVNQITDGGVKVLSEELTKYKIVTYLGLWKSVDTICFKKQGLLK

SEQ ID NO: 59041 - protein, 1040 aa, Homo sapiens
  Payload ID: 11526
  Gene Symbol: NOD2
  Gene Name: nucleotide-binding oligomerization domain containing 2
  Uniprot ID: Q9HC29
  ENSP ID: ENSP00000300589
MGEEGGSASHDEEERASVLLGHSPGCEMCSQEAFQAQRSQLVELLVSGSLEGFESVLDWLLSWEVLSWEDYEGFHLLGQPLSHLARRLLDTVWNKGTWACQKLIAAAQEAQADSQSPKLHGCWDPHSLHPARDLQSHRPAIVRRLHSHVENMLDLAWERGFVSQYECDEIRLPIFTPSQRARRLLDLATVKANGLAAFLLQHVQELPVPLALPLEAATCKKYMAKLRTTVSAQSRFLSTYDGAETLCLEDIYTENVLEVWADVGMAGPPQKSPATLGLEELFSTPGHLNDDADTVLVVGEAGSGKSTLLQRLHLLWAAGQDFQEFLFVFPFSCRQLQCMAKPLSVRTLLFEHCCWPDVGQEDIFQLLLDHPDRVLLTFDGFDEFKFRFTDRERHCSPTDPTSVQTLLFNLLQGNLLKNARKVVTSRPAAVSAFLRKYIRTEFNLKGFSEQGIELYLRKRHHEPGVADRLIRLLQETSALHGLCHLPVFSWMVSKCHQELLLQEGGSPKTTTDMYLLILQHFLLHATPPDSASQGLGPSLLRGRLPTLLHLGRLALWGLGMCCYVFSAQQLQAAQVSPDDISLGFLVRAKGVVPGSTAPLEFLHITFQCFFAAFYLALSADVPPALLRHLFNCGRPGNSPMARLLPTMCIQASEGKDSSVAALLQKAEPHNLQITAAFLAGLLSREHWGLLAECQTSEKALLRRQACARWCLARSLRKHFHSIPPAAPGEAKSVHAMPGFIWLIRSLYEMQEERLARKAARGLNVGHLKLTFCSVGPTECAALAFVLQHLRRPVALQLDYNSVGDIGVEQLLPCLGVCKALYLRDNNISDRGICKLIECALHCEQLQKLALFNNKLTDGCAHSMAKLLACRQNFLALRLGNNYITAAGAQVLAEGLRGNTSLQFLGFWGNRVGDEGAQALAEALGDHQSLRWLSLVGNNIGSVGAQALALMLAKNVMLEELCLEENHLQDEGVCSLAEGLKKNSSLKILKLSNNCITYLGAEALLQALERNDTILEVWLRGNTFSLEEVDKLGCRDTRLLL

SEQ ID NO: 59042 - protein, 146 aa, Homo sapiens
  Payload ID: 11526
  Gene Symbol: NOD2
  Gene Name: nucleotide-binding oligomerization domain containing 2
  ENSP ID: ENSP00000431681
MCSQEAFQAQRSQLVELLVSGSLEGFESVLDWLLSWEVLSWEDYEGFHLLGQPLSHLARRLLDTVWNKGTWACQKLIAAAQEAQADSQSPKLHGCWDPHSLHPARDLQSHRPAIVRRLHSHVENMLDLAWERGFVSQYECDEIRLP

SEQ ID NO: 59043 - protein, 35 aa, Homo sapiens
  Payload ID: 11526
  Gene Symbol: NOD2
  Gene Name: nucleotide-binding oligomerization domain containing 2
  ENSP ID: ENSP00000435149
MGEEGGSASHDEEERASVLLGHSPGKRSRHCPVPA

SEQ ID NO: 59044 - protein, 169 aa, Homo sapiens
  Payload ID: 11526
  Gene Symbol: NOD2
  Gene Name: nucleotide-binding oligomerization domain containing 2
  ENSP ID: ENSP00000437246
  MOD_RES (1)..(1): Any amino acid
XLNVGHLKLTFCSVGPTECAALAFVLQHLRRPVALQLDYNSVGDIGVEQLLPCLGVCKALYLRDNNISDRGICKLIECALHCEQLQKLALGNNYITAAGAQVLAEGLRGNTSLQFLGFWGNRVGDEGAQALAEALGDHQSLRWLSLVGNNIGSVGAQALALMLAKNVML

SEQ ID NO: 59045 - protein, 60 aa, Homo sapiens
  Payload ID: 11526
  Gene Symbol: NOD2
  Gene Name: nucleotide-binding oligomerization domain containing 2
  ENSP ID: ENSP00000462443
  MOD_RES (1)..(1): Any amino acid
XLNVGHLKLTFCSVGPTECAALAFVLQHLRRPVALQLDYNSVGDIGVEQLLPCLGVCKAL

SEQ ID NO: 59046 - protein, 60 aa, Homo sapiens; identical to SEQ ID NO: 59045
  Payload ID: 11526
  Gene Symbol: NOD2
  Gene Name: nucleotide-binding oligomerization domain containing 2
  ENSP ID: ENSP00000463145
  MOD_RES (1)..(1): Any amino acid

SEQ ID NO: 59047 - protein, 60 aa, Homo sapiens; identical to SEQ ID NO: 59045
  Payload ID: 11526
  Gene Symbol: NOD2
  Gene Name: nucleotide-binding oligomerization domain containing 2
  ENSP ID: ENSP00000463423
  MOD_RES (1)..(1): Any amino acid

SEQ ID NO: 59048 - protein, 60 aa, Homo sapiens; identical to SEQ ID NO: 59045
  Payload ID: 11526
  Gene Symbol: NOD2
  Gene Name: nucleotide-binding oligomerization domain containing 2
  ENSP ID: ENSP00000464065
  MOD_RES (1)..(1): Any amino acid

SEQ ID NO: 59049 - protein, 527 aa, Homo sapiens
  Payload ID: 11527
  Gene Symbol: NACC1
  Gene Name: nucleus accumbens associated 1, BEN and BTB (POZ) domain containing
  Uniprot ID: Q96RE7
  ENSP ID: ENSP00000292431
MAQTLQMEIPNFGNSILECLNEQRLQGLYCDVSVVVKGHAFKAHRAVLAASSSYFRDLFNNSRSAVVELPAAVQPQSFQQILSFCYTGRLSMNVGDQFLLMYTAGFLQIQEIMEKGTEFFLKVSSPSCDSQGLHAEEAPSSEPQSPVAQTSGWPACSTPLPLVSRVKTEQQESDSVQCMPVAKRLWDSGQKEAGGGGNGSRKMAKFSTPDLAANRPHQPPPPQQAPVVAAAQPAVAAGAGQPAGGVAAAGGVVSGPSTSERTSPGTSSAYTSDSPGSYHNEEDEEEDGGEEGMDEQYRQICNMYTMYSMMNVGQTAEKVEALPEQVAPESRNRIRVRQDLASLPAELINQIGNRCHPKLYDEGDPSEKLELVTGTNVYITRAQLMNCHVSAGTRHKVLLRRLLASFFDRNTLANSCGTGIRSSTNDPRRKPLDSRVLHAVKYYCQNFAPNFKESEMNAIAADMCTNARRVVRKSWMPKVKVLKAEDDAYTTFISETGKIEPDMMGVEHGFETASHEGEAGPSAEALQ

SEQ ID NO: 59050 - protein, 94 aa, Homo sapiens
  Payload ID: 11527
  Gene Symbol: NACC1
  Gene Name: nucleus accumbens associated 1, BEN and BTB (POZ) domain containing
  ENSP ID: ENSP00000466017
VYITRAQLMNCHNFAPNFKESEMNAIAADMCTNARRVVRKSWMPKVKVLKAEDDAYTTFISETGKIEPDMMGVEHGFETASHEGEAGPSAEALQ

SEQ ID NO: 59051 - protein, 165 aa, Homo sapiens
  Payload ID: 11527
  Gene Symbol: NACC1
  Gene Name: nucleus accumbens associated 1, BEN and BTB (POZ) domain containing
  ENSP ID: ENSP00000467120
MAQTLQMEIPNFGNSILECLNEQRLQGLYCDVSVVVKGHAFKAHRAVLAASSSYFRDLFNNSRSAVVELPAAVQPQSFQQILSFCYTGRLSMNVGDQFLLMYTAGFLQIQEIMEKGTEFFLKVSSPSCDSQGLHAEEAPSSEPQSPVAQTSGWPACSTPLPLVSR

SEQ ID NO: 59052 - protein, 583 aa, Homo sapiens
  Payload ID: 11528
  Gene Symbol: NUDCD1
  Gene Name: NudC domain containing 1
  Uniprot ID: Q96RS6
  ENSP ID: ENSP00000239690
MEVAANCSLRVKRPLLDPRFEGYKLSLEPLPCYQLELDAAVAEVKLRDDQYTLEHMHAFGMYNYLHCDSWYQDSVYYIDTLGRIMNLTVMLDTALGKPREVFRLPTDLTACDNRLCASIHFSSSTWVTLSDGTGRLYVIGTGERGNSASEKWEIMFNEELGDPFIIIHSISLLNAEEHSIATLLLRIEKEELDMKGSGFYVSLEWVTISKKNQDNKKYEIIKRDILRGKSVPHYAAIEPDGNGLMIVSYKSLTFVQAGQDLEENMDEDISEKIKEPLYYWQQTEDDLTVTIRLPEDSTKEDIQIQFLPDHINIVLKDHQFLEGKLYSSIDHESSTWIIKESNSLEISLIKKNEGLTWPELVIGDKQGELIRDSAQCAAIAERLMHLTSEELNPNPDKEKPPCNAQELEECDIFFEESSSLCRFDGNTLKTTHVVNLGSNQYLFSVIVDPKEMPCFCLRHDVDALLWQPHSSKQDDMWEHIATFNALGYVQASKRDKKFFACAPNYSYAALCECLRRVFIYRQPAPMSTVLYNRKEGRQVGQVAKQQVASLETNDPILGFQATNERLFVLTTKNLFLIKVNTEN

SEQ ID NO: 59053 - protein, 554 aa, Homo sapiens
  Payload ID: 11528
  Gene Symbol: NUDCD1
  Gene Name: NudC domain containing 1
  Uniprot ID: Q96RS6
  ENSP ID: ENSP00000410707
MLYLQGWSMPAVAEVKLRDDQYTLEHMHAFGMYNYLHCDSWYQDSVYYIDTLGRIMNLTVMLDTALGKPREVFRLPTDLTACDNRLCASIHFSSSTWVTLSDGTGRLYVIGTGERGNSASEKWEIMFNEELGDPFIIIHSISLLNAEEHSIATLLLRIEKEELDMKGSGFYVSLEWVTISKKNQDNKKYEIIKRDILRGKSVPHYAAIEPDGNGLMIVSYKSLTFVQAGQDLEENMDEDISEKIKEPLYYWQQTEDDLTVTIRLPEDSTKEDIQIQFLPDHINIVLKDHQFLEGKLYSSIDHESSTWIIKESNSLEISLIKKNEGLTWPELVIGDKQGELIRDSAQCAAIAERLMHLTSEELNPNPDKEKPPCNAQELEECDIFFEESSSLCRFDGNTLKTTHVVNLGSNQYLFSVIVDPKEMPCFCLRHDVDALLWQPHSSKQDDMWEHIATFNALGYVQASKRDKKFFACAPNYSYAALCECLRRVFIYRQPAPMSTVLYNRKEGRQVGQVAKQQVASLETNDPILGFQATNERLFVLTTKNLFLIKVNTEN

SEQ ID NO: 59054 - protein, 108 aa, Homo sapiens
  Payload ID: 11528
  Gene Symbol: NUDCD1
  Gene Name: NudC domain containing 1
  ENSP ID: ENSP00000430095
MEVAANCSLRVKRPLLDPRFEGYKLSLEPLPCYQLELDAAVAEVKLRDDQYTLEHMHAFGMYNYLHCDSWYQDSVYYIDTLGRIMNLTVMLILKYLNHSIGYCTHLSD

SEQ ID NO: 59055 - protein, 79 aa, Homo sapiens
  Payload ID: 11528
  Gene Symbol: NUDCD1
  Gene Name: NudC domain containing 1
  ENSP ID: ENSP00000430859
MLYLQGWSMPAVAEVKLRDDQYTLEHMHAFGMYNYLHCDSWYQDSVYYIDTLGRIMNLTVMLILKYLNHSIGYCTHLSD

SEQ ID NO: 59056 - protein, 157 aa, Homo sapiens
  Payload ID: 11529
  Gene Symbol: NUDCD2
  Gene Name: NudC domain containing 2
  Uniprot ID: Q8WVJ2
  ENSP ID: ENSP00000304854
MSAPFEERSGVVPCGTPWGQWYQTLEEVFIEVQVPPGTRAQDIQCGLQSRHVALSVGGREILKGKLFDSTIADEGTWTLEDRKMVRIVLTKTKRDAANCWTSLLESEYAADPWVQDQMQRKLTLERFQKENPGFDFSGAEISGNYTKGGPDFSNLEK

SEQ ID NO: 59057 - protein, 132 aa, Homo sapiens
  Payload ID: 11529
  Gene Symbol: NUDCD2
  Gene Name: NudC domain containing 2
  ENSP ID: ENSP00000430347
MSAPFEERSGVVPCGTPWGQWYQTLEEVFIEVQVPPGTRAQDIQCGLQSRHVALSVGGREILKGKLFDSTIADEGTWTLESEYAADPWVQDQMQRKLTLERFQKENPGFDFSGAEISGNYTKGGPDFSNLEK

SEQ ID NO: 59058 - protein, 361 aa, Homo sapiens
  Payload ID: 11530
  Gene Symbol: NUDCD3
  Gene Name: NudC domain containing 3
  Uniprot ID: Q8IVD9
  ENSP ID: ENSP00000347626
METGAAELYDQALLGILQHVGNVQDFLRVLFGFLYRKTDFYRLLRHPSDRMGFPPGAAQALVLQVFKTFDHMARQDDEKRRQELEEKIRRKEEEEAKTVSAAAAEKEPVPVPVQEIEIDSTTELDGHQEVEKVQPPGPVKEMAHGSQEAEAPGAVAGAAEVPREPPILPRIQEQFQKNPDSYNGAVRENYTWSQDYTDLEVRVPVPKHVVKGKQVSVALSSSSIRVAMLEENGERVLMEGKLTHKINTESSLWSLEPGKCVLVNLSKVGEYWWNAILEGEEPIDIDKINKERSMATVDEEEQAVLDRLTFDYHQKLQGKPQSHELKVHEMLKKGWDAEGSPFRGQRFDPAMFNISPGAVQF

SEQ ID NO: 59059 - protein, 331 aa, Homo sapiens
  Payload ID: 11531
  Gene Symbol: NUDC
  Gene Name: nudC nuclear distribution protein
  Uniprot ID: Q9Y266
  ENSP ID: ENSP00000319664
MGGEQEEERFDGMLLAMAQQHEGGVQELVNTFFSFLRRKTDFFIGGEEGMAEKLITQTFSHHNQLAQKTRREKRARQEAERREKAERAARLAKEAKSETSGPQIKELTDEEAERLQLEIDQKKDAENHEAQLKNGSLDSPGKQDTEEDEEEDEKDKGKLKPNLGNGADLPNYRWTQTLSELDLAVPFCVNFRLKGKDMVVDIQRRHLRVGLKGQPAIIDGELYNEVKVEESSWLIEDGKVVTVHLEKINKMEWWSRLVSSDPEINTKKINPENSKLSDLDSETRSMVEKMMYDQRQKSMGLPTSDEQKKQEILKKFMDQHPEMDFSKAKFN

SEQ ID NO: 59060 - protein, 133 aa, Homo sapiens
  Payload ID: 11531
  Gene Symbol: NUDC
  Gene Name: nudC nuclear distribution protein
  ENSP ID: ENSP00000400981
MAEKLITQTFSHHNQLAQKTRREKRARQEAERREKAERAARLAKEAKSETSGPQIKELTDEEAERLQLEIDQKKDAENHEAQLKNGSLDSPGKQDTEEDEEEDEKDKGKLKPNLGNGADLPNYRWTQTLSELD

SEQ ID NO: 59061 - protein, 186 aa, Homo sapiens
  Payload ID: 11531
  Gene Symbol: NUDC
  Gene Name: nudC nuclear distribution protein
  ENSP ID: ENSP00000404020
MISNYRNGSELVCFNSGVGCFLIGCDWAFTVLVNTFFSFLRRKTDFFIGGEEGMAEKLITQTFSHHNQLAQKTRREKRARQEAERREKAERAARLAKEAKSETSGPQIKELTDEEAERLQLEIDQKKDAENHEAQLKNGSLDSPGKQDTEEDEEEDEKDKGKLKPNLGNGADLPNYRWTQTLSELD

SEQ ID NO: 59062 - protein, 335 aa, Homo sapiens
  Payload ID: 11532
  Gene Symbol: NDE1
  Gene Name: nudE neurodevelopment protein 1
  Uniprot ID: Q9NXR1
  ENSP ID: ENSP00000345892
MEDSGKTFSSEEEEANYWKDLAMTYKQRAENTQEELREFQEGSREYEAELETQLQQIETRNRDLLSENNRLRMELETIKEKFEVQHSEGYRQISALEDDLAQTKAIKDQLQKYIRELEQANDDLERAKRATIMSLEDFEQRLNQAIERNAFLESELDEKENLLESVQRLKDEARDLRQELAVQQKQEKPRTPMPSSVEAERTDTAVQATGSVPSTPIAHRGPSSSLNTPGSFRRGLDDSTGGTPLTPAARISALNIVGDLLRKVGALESKLASCRNLVYDQSPNRTGGPASGRSSKNRDGGERRPSSTSVPLGDKGLDTSCRWLSKSTTRSSSSC

SEQ ID NO: 59063 - protein, 335 aa, Homo sapiens; identical to SEQ ID NO: 59062
  Payload ID: 11532
  Gene Symbol: NDE1
  Gene Name: nudE neurodevelopment protein 1
  Uniprot ID: Q9NXR1
  ENSP ID: ENSP00000379642

SEQ ID NO: 59064 - protein, 335 aa, Homo sapiens; identical to SEQ ID NO: 59062
  Payload ID: 11532
  Gene Symbol: NDE1
  Gene Name: nudE neurodevelopment protein 1
  Uniprot ID: Q9NXR1
  ENSP ID: ENSP00000379643

SEQ ID NO: 59065 - protein, 137 aa, Homo sapiens
  Payload ID: 11532
  Gene Symbol: NDE1
  Gene Name: nudE neurodevelopment protein 1
  ENSP ID: ENSP00000459863
  MOD_RES (1)..(1): Any amino acid
XVQQKQEKPRTPMPSSVEAERTDTAVQATGSVPSTPIAHRGPSSSLNTPGSFRRGLDDSTGGTPLTPAARISALNIVGDLLRKVGVGEAPGIWEAAFTHVFIAAAVSPGGSQDVALGKPRKLKVLVLVGHELPLVVQ

SEQ ID NO: 59066 - protein, 173 aa, Homo sapiens
  Payload ID: 11532
  Gene Symbol: NDE1
  Gene Name: nudE neurodevelopment protein 1
  ENSP ID: ENSP00000459875
ERNAFLESELDEKENLLESVQRLKDEARDLRQELAVQQKQEKPRTPMPSSVEAERTDTAVQATGSVPSTPIAHRGPSSSLNTPGSFRRGLDDSTGGTPLTPAARISALNIVGDLLRKVGALESKLASCRNLVYDQSPNRTGGPASGRSSKNRDGGERRPSSTSVPLGDKGREN

SEQ ID NO: 59067 - protein, 127 aa, Homo sapiens
  Payload ID: 11532
  Gene Symbol: NDE1
  Gene Name: nudE neurodevelopment protein 1
  ENSP ID: ENSP00000459889
MEDSGKTFSSEEEEANYWKDLAMTYKQRAENTQEELREFQEGSREYEAELETQLQQIETRNRDLLSENNRLRMELETIKEKFEVQHSEGYRQISALEDDLAQTKAIKDQLQKYIRELEQANDDLERA

SEQ ID NO: 59068 - protein, 139 aa, Homo sapiens
  Payload ID: 11532
  Gene Symbol: NDE1
  Gene Name: nudE neurodevelopment protein 1
  ENSP ID: ENSP00000459918
ATGSVPSTPIAHRGPSSSLNTPGSFRRGLDDSTGGTPLTPAARISALNIVGDLLRKVGALESKLASCRNLVYDQSPNRTGGPASGRSSKNRDGGERRPSSTSVPLGDKGLGKRLEFGKPPSHMSSSPLPSAQGVVKMLL

SEQ ID NO: 59069 - protein, 126 aa, Homo sapiens
  Payload ID: 11532
  Gene Symbol: NDE1
  Gene Name: nudE neurodevelopment protein 1
  ENSP ID: ENSP00000460436
MEDSGKTFSSEEEEANYWKDLAMTYKQRAENTQEELREFQEGSREYEAELETQLQQIETRNRDLLSENNRLRMELETIKEKFEVQHSEGYRQISALEDDLAQTKAIKDQLQKYIRELEQANDDLER

SEQ ID NO: 59070 - protein, 109 aa, Homo sapiens
  Payload ID: 11532
  Gene Symbol: NDE1
  Gene Name: nudE neurodevelopment protein 1
  ENSP ID: ENSP00000460996
MEDSGKTFSSEEEEANYWKDLAMTYKQRAENTQEELREFQEGSREYEAELETQLQQIETRNRDLLSENNRLRMELETIKVPRRSLNRQCSRWSPLAASSWSLRLNLGEV

SEQ ID NO: 59071 - protein, 192 aa, Homo sapiens
  Payload ID: 11532
  Gene Symbol: NDE1
  Gene Name: nudE neurodevelopment protein 1
  ENSP ID: ENSP00000461729
  MOD_RES (1)..(1): Any amino acid
XDDLERAKRATIMSLEDFEQRLNQAIERNAFLESELDEKENLLESVQRLKDEARDLRQELAVQQKQEKPRTPMPSSVEAERTDTAVQATGSVPSTPIAHRGPSSSLNTPGSFRRGLDDSTGGTPLTPAARISALNIVGDLLRKVGRFNKVNQRVKDSRSGFPTSYKRSWIIGRHWSPNSLPAGTSCTISPQT

SEQ ID NO: 59072 - protein, 153 aa, Homo sapiens
  Payload ID: 11532
  Gene Symbol: NDE1
  Gene Name: nudE neurodevelopment protein 1
  ENSP ID: ENSP00000461748
PSSVEAERTDTAVQATGSVPSTPIAHRGPSSSLNTPGSFRRGLDDSTGGTPLTPAARISALNIVGDLLRKVGALESKLASCRNLVYDQSPNRTGGPASGRSSKNRDGGERRPSSTSVPLGDKGLGKRLEFGKPPSHMSSSPLPSAQGVVKMLL

SEQ ID NO: 59073 - protein, 335 aa, Homo sapiens; identical to SEQ ID NO: 59062
  Payload ID: 11532
  Gene Symbol: NDE1
  Gene Name: nudE neurodevelopment protein 1
  Uniprot ID: Q9NXR1
  ENSP ID: ENSP00000478036

SEQ ID NO: 59074 - protein, 139 aa, Homo sapiens; identical to SEQ ID NO: 59068
  Payload ID: 11532
  Gene Symbol: NDE1
  Gene Name: nudE neurodevelopment protein 1
  ENSP ID: ENSP00000487625

SEQ ID NO: 59075 - protein, 127 aa, Homo sapiens; identical to SEQ ID NO: 59067
  Payload ID: 11532
  Gene Symbol: NDE1
  Gene Name: nudE neurodevelopment protein 1
  ENSP ID: ENSP00000487642

SEQ ID NO: 59076 - protein, 153 aa, Homo sapiens; identical to SEQ ID NO: 59072
  Payload ID: 11532
  Gene Symbol: NDE1
  Gene Name: nudE neurodevelopment protein 1
  ENSP ID: ENSP00000487817

SEQ ID NO: 59077 - protein, 335 aa, Homo sapiens; identical to SEQ ID NO: 59062
  Payload ID: 11532
  Gene Symbol: NDE1
  Gene Name: nudE neurodevelopment protein 1
  Uniprot ID: Q9NXR1
  ENSP ID: ENSP00000488050

SEQ ID NO: 59078 - protein, 335 aa, Homo sapiens; identical to SEQ ID NO: 59062
  Payload ID: 11532
  Gene Symbol: NDE1
  Gene Name: nudE neurodevelopment protein 1
  Uniprot ID: Q9NXR1
  ENSP ID: ENSP00000488199

SEQ ID NO: 59079 - protein, 173 aa, Homo sapiens; identical to SEQ ID NO: 59066
  Payload ID: 11532
  Gene Symbol: NDE1
  Gene Name: nudE neurodevelopment protein 1
  ENSP ID: ENSP00000488454

SEQ ID NO: 59080 - protein, 192 aa, Homo sapiens; identical to SEQ ID NO: 59071
  Payload ID: 11532
  Gene Symbol: NDE1
  Gene Name: nudE neurodevelopment protein 1
  ENSP ID: ENSP00000488637
  MOD_RES (1)..(1): Any amino acid

SEQ ID NO: 59081 - protein, 137 aa, Homo sapiens; identical to SEQ ID NO: 59065
  Payload ID: 11532
  Gene Symbol: NDE1
  Gene Name: nudE neurodevelopment protein 1
  ENSP ID: ENSP00000488694
  MOD_RES (1)..(1): Any amino acid

SEQ ID NO: 59082 - protein, 126 aa, Homo sapiens; identical to SEQ ID NO: 59069
  Payload ID: 11532
  Gene Symbol: NDE1
  Gene Name: nudE neurodevelopment protein 1
  ENSP ID: ENSP00000488828

SEQ ID NO: 59083 - protein, 109 aa, Homo sapiens; identical to SEQ ID NO: 59070
  Payload ID: 11532
  Gene Symbol: NDE1
  Gene Name: nudE neurodevelopment protein 1
  ENSP ID: ENSP00000488895

SEQ ID NO: 59084 - protein, 345 aa, Homo sapiens
  Payload ID: 11533
  Gene Symbol: NDEL1
  Gene Name: nudE neurodevelopment protein 1-like 1
  Uniprot ID: Q9GZM8
  ENSP ID: ENSP00000333982
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGALESKLAACRNFAKDQASRKSYISGNVNCGVLNGNGTKFSRSGHTSFFDKGAVNGFDPAPPPPGLGSSRPSSAPGMLPLSV

SEQ ID NO: 59085 - protein, 269 aa, Homo sapiens
  Payload ID: 11533
  Gene Symbol: NDEL1
  Gene Name: nudE neurodevelopment protein 1-like 1
  ENSP ID: ENSP00000369364
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGGSKRL

SEQ ID NO: 59086 - protein, 328 aa, Homo sapiens
  Payload ID: 11533
  Gene Symbol: NDEL1
  Gene Name: nudE neurodevelopment protein 1-like 1
  Uniprot ID: Q9GZM8
  ENSP ID: ENSP00000384963
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGALESKLAACRNFAKDQASRKSYISGNVNCGVLNGNGTKFSRSGHTSFFDKGQEKVIFPTLFMGQ

SEQ ID NO: 59087 - protein, 145 aa, Homo sapiens
  Payload ID: 11533
  Gene Symbol: NDEL1
  Gene Name: nudE neurodevelopment protein 1-like 1
  ENSP ID: ENSP00000462052
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQ

SEQ ID NO: 59088 - protein, 33 aa, Homo sapiens
  Payload ID: 11533
  Gene Symbol: NDEL1
  Gene Name: nudE neurodevelopment protein 1-like 1
  ENSP ID: ENSP00000462458
MDGEDIPDFSSLKEETAYWKELSLKYKQSFQEA

SEQ ID NO: 59089 - protein, 72 aa, Homo sapiens
  Payload ID: 11533
  Gene Symbol: NDEL1
  Gene Name: nudE neurodevelopment protein 1-like 1
  ENSP ID: ENSP00000462759
MDGEDIPDFSSLKEETAYWKELSLKYKQSFQEARDELVEFQEGSRELEAELEAQLVQAEQRNRDLQADNQRL

SEQ ID NO: 59090 - protein, 59 aa, Homo sapiens
  Payload ID: 11533
  Gene Symbol: NDEL1
  Gene Name: nudE neurodevelopment protein 1-like 1
  ENSP ID: ENSP00000463351
MDGEDIPDFSSLKEETAYWKELSLKYKQSFQEARDELVEFQEGSRELEAELEAQLVQAE

SEQ ID NO: 59091 - protein, 158 aa, Homo sapiens
  Payload ID: 11533
  Gene Symbol: NDEL1
  Gene Name: nudE neurodevelopment protein 1-like 1
  ENSP ID: ENSP00000463430
MDGEDIPDFSSLKEETAYWKELSLKYKQSFQEARDELVEFQEGSRELEAELEAQLVQAEQRNRDLQADNQRLKYEVEALKEKLEHQYAQSYKQVSVLEDDLSQTRAIKEQLHKYVRELEQANDDLERAKRATIVSLEDFEQRLNQAIERNAFLESELD

SEQ ID NO: 59092 - protein, 85 aa, Homo sapiens
  Payload ID: 11533
  Gene Symbol: NDEL1
  Gene Name: nudE neurodevelopment protein 1-like 1
  ENSP ID: ENSP00000463492
MDGEDIPDFSSLKEETAYWKELSLKYKQSFQEARDELVEFQEGSRELEAELEAQLVQAACSGGYWALPSPGTLRDINTGYFLFSP

SEQ ID NO: 59093 - protein, 76 aa, Homo sapiens
  Payload ID: 11533
  Gene Symbol: NDEL1
  Gene Name: nudE neurodevelopment protein 1-like 1
  ENSP ID: ENSP00000464154
MDGEDIPDFSSLKEETAYWKELSLKYKQSRRGHLWPVLHALILPHHFGHLEILISCLGLHRTDFTFSSASRKLGMS

SEQ ID NO: 59094 - protein, 196 aa, Homo sapiens
  Payload ID: 11533
  Gene Symbol: NDEL1
  Gene Name: nudE neurodevelopment protein 1-like 1
  ENSP ID: ENSP00000464441
  MOD_RES (1)..(1): Any amino acid
XRNAFLESELDEKESLLVSVQRLKDEARDLRQELAVRERQQEVTRKSAPSSPTLDCEKMDSAVQASLSLPATPVGKGTENTFPSPKAIPNGFGTSPLTPSARISALNIVGDLLRKVGALESKLAACRNFAKDQASRKSYISGNVNCGVLNGNGTKFSRSGHTSFFDKGRAGTTLETLTISESSWDFLPSSIIMAHV

SEQ ID NO: 59095 - protein, 194 aa, Homo sapiens
  Payload ID: 11533
  Gene Symbol: NDEL1
  Gene Name: nudE neurodevelopment protein 1-like 1
  ENSP ID: ENSP00000464634
  MOD_RES (1)..(1): Any amino acid
XLRQELAVRERQQEVTRKSAPSSPTLDCEKMDSAVQASLSLPATPVGKGTENTFPSPKAIPNGFGTSPLTPSARISALNIVGDLLRKVGALESKLAACRNFAKDQASRKSYISGNVNCGVLNGNGTKFSRSGHTSFFDKGCVLTRMNRILTQSWALRACTPCCGGRTLCPTCLISSRFFSSFCSSLVCRSLSNC

SEQ ID NO: 59096 - protein, 179 aa, Homo sapiens
  Payload ID: 11534
  Gene Symbol: NUDT1
  Gene Name: nudix (nucleoside diphosphate linked moiety X)-type motif 1
  Uniprot ID: P36639
  ENSP ID: ENSP00000339503
MSGISPQQMGEPEGSWSGKNPGTMGASRLYTLVLVLQPQRVLLGMKKRGFGAGRWNGFGGKVQEGETIEDGARRELQEESGLTVDALHKVGQIVFEFVGEPELMDVHVFCTDSIQGTPVESDEMRPCWFQLDQIPFKDMWPDDSYWFPLLLQKKKFHGYFKFQGQDTILDYTLREVDTV

SEQ ID NO: 59097 - protein, 156 aa, Homo sapiens
  Payload ID: 11534
  Gene Symbol: NUDT1
  Gene Name: nudix (nucleoside diphosphate linked moiety X)-type motif 1
  Uniprot ID: P36639
  ENSP ID: ENSP00000343439
MGASRLYTLVLVLQPQRVLLGMKKRGFGAGRWNGFGGKVQEGETIEDGARRELQEESGLTVDALHKVGQIVFEFVGEPELMDVHVFCTDSIQGTPVESDEMRPCWFQLDQIPFKDMWPDDSYWFPLLLQKKKFHGYFKFQGQDTILDYTLREVDTV

SEQ ID NO: 59098 - protein, 156 aa, Homo sapiens; identical to SEQ ID NO: 59097
  Payload ID: 11534
  Gene Symbol: NUDT1
  Gene Name: nudix (nucleoside diphosphate linked moiety X)-type motif 1
  Uniprot ID: P36639
  ENSP ID: ENSP00000349148

SEQ ID NO: 59099 - protein, 156 aa, Homo sapiens; identical to SEQ ID NO: 59097
  Payload ID: 11534
  Gene Symbol: NUDT1
  Gene Name: nudix (nucleoside diphosphate linked moiety X)-type motif 1
  Uniprot ID: P36639
  ENSP ID: ENSP00000380239

SEQ ID NO: 59100 - protein, 179 aa, Homo sapiens; identical to SEQ ID NO: 59096
  Payload ID: 11534
  Gene Symbol: NUDT1
  Gene Name: nudix (nucleoside diphosphate linked moiety X)-type motif 1
  Uniprot ID: P36639
  ENSP ID: ENSP00000380241

SEQ ID NO: 59101 - protein, 156 aa, Homo sapiens; identical to SEQ ID NO: 59097
  Payload ID: 11534
  Gene Symbol: NUDT1
  Gene Name: nudix (nucleoside diphosphate linked moiety X)-type motif 1
  Uniprot ID: P36639
  ENSP ID: ENSP00000380242

SEQ ID NO: 59102 - protein, 37 aa, Homo sapiens
  Payload ID: 11534
  Gene Symbol: NUDT1
  Gene Name: nudix (nucleoside diphosphate linked moiety X)-type motif 1
  ENSP ID: ENSP00000405334
MGASRLYTLVLVLQPQRVLLGMKKRGFGAGRWNGFGG

SEQ ID NO: 59103 - protein, 164 aa, Homo sapiens
  Payload ID: 11535
  Gene Symbol: NUDT10
  Gene Name: nudix (nucleoside diphosphate linked moiety X)-type motif 10
  Uniprot ID: Q8NFP7
  ENSP ID: ENSP00000348831
MKCKPNQTRTYDPEGFKKRAACLCFRSEREDEVLLVSSSRYPDRWIVPGGGMEPEEEPGGAAVREVYEEAGVKGKLGRLLGVFEQNQDPKHRTYVYVLTVTELLEDWEDSVSIGRKREWFKVEDAIKVLQCHKPVHAEYLEKLKLGGSPTNGNSMAPSSPDSDP

SEQ ID NO: 59104 - protein, 164 aa, Homo sapiens; identical to SEQ ID NO: 59103
  Payload ID: 11535
  Gene Symbol: NUDT10
  Gene Name: nudix (nucleoside diphosphate linked moiety X)-type motif 10
  Uniprot ID: Q8NFP7
  ENSP ID: ENSP00000365174

SEQ ID NO: 59105 - protein, 164 aa, Homo sapiens
  Payload ID: 11536
  Gene Symbol: NUDT11
  Gene Name: nudix (nucleoside diphosphate linked moiety X)-type motif 11
  Uniprot ID: Q96G61
  ENSP ID: ENSP00000365160
MKCKPNQTRTYDPEGFKKRAACLCFRSEREDEVLLVSSSRYPDRWIVPGGGMEPEEEPGGAAVREVYEEAGVKGKLGRLLGVFEQNQDRKHRTYVYVLTVTELLEDWEDSVSIGRKREWFKVEDAIKVLQCHKPVHAEYLEKLKLGGSPTNGNSMAPSSPDSDP

SEQ ID NO: 59106 - protein, 462 aa, Homo sapiens
  Payload ID: 11537
  Gene Symbol: NUDT12
  Gene Name: nudix (nucleoside diphosphate linked moiety X)-type motif 12
  Uniprot ID: Q9BQG2
  ENSP ID: ENSP00000230792
MSSVKRSLKQEIVTQFHCSAAEGDIAKLTGILSHSPSLLNETSENGWTALMYAARNGHPEIVQFLLEKGCDRSIVNKSRQTALDIAVFWGYKHIANLLATAKGGKKPWFLTNEVEECENYFSKTLLDRKSEKRNNSDWLLAKESHPATVFILFSDLNPLVTLGGNKESFQQPEVRLCQLNYTDIKDYLAQPEKITLIFLGVELEIKDKLLNYAGEVPREEEDGLVAWFALGIDPIAAEEFKQRHENCYFLHPPMPALLQLKEKEAGVVAQARSVLAWHSRYKFCPTCGNATKIEEGGYKRLCLKEDCPSLNGVHNTSYPRVDPVVIMQVIHPDGTKCLLGRQKRFPPGMFTCLAGFIEPGETIEDAVRREVEEESGVKVGHVQYVACQPWPMPSSLMIGCLALAVSTEIKVDKNEIEDARWFTREQVLDVLTKGKQQAFFVPPSRAIAHQLIKHWIRINPNL

SEQ ID NO: 59107 - protein, 444 aa, Homo sapiens
  Payload ID: 11537
  Gene Symbol: NUDT12
  Gene Name: nudix (nucleoside diphosphate linked moiety X)-type motif 12
  ENSP ID: ENSP00000424521
MSSVKRSLKQEIVTQFHCSAAEGDIAKLTGILSHSPSLLNETSENGWTALMCDRSIVNKSRQTALDIAVFWGYKHIANLLATAKGGKKPWFLTNEVEECENYFSKTLLDRKSEKRNNSDWLLAKESHPATVFILFSDLNPLVTLGGNKESFQQPEVRLCQLNYTDIKDYLAQPEKITLIFLGVELEIKDKLLNYAGEVPREEEDGLVAWFALGIDPIAAEEFKQRHENCYFLHPPMPALLQLKEKEAGVVAQARSVLAWHSRYKFCPTCGNATKIEEGGYKRLCLKEDCPSLNGVHNTSYPRVDPVVIMQVIHPDGTKCLLGRQKRFPPGMFTCLAGFIEPGETIEDAVRREVEEESGVKVGHVQYVACQPWPMPSSLMIGCLALAVSTEIKVDKNEIEDARWFTREQVLDVLTKGKQQAFFVPPSRAIAHQLIKHWIRINPNL

SEQ ID NO: 59108 - protein, 263 aa, Homo sapiens
  Payload ID: 11538
  Gene Symbol: NUDT13
  Gene Name: nudix (nucleoside diphosphate linked moiety X)-type motif 13
  Uniprot ID: Q86X67
  ENSP ID: ENSP00000335326
MSLYCGIACRRKFFWCYRLLSTYVTKTRYLFELKEDDDACKKAQQTGAFYLFHSLAPLLQTSAHQYLAPRHSLLELERLLGKFGQDAQRIEDSVLIGCSEQQEAWFALDLGLDSSFSISASLHKPEMETELKGSFIELRKALFQLNARDASLLSTAQALLRWHDAHQFCSRSGQPTKKNVAGSKRVCPSNNIIYYPQIQVNLRELETAAWFSHDEVATALKRKGPYTQQQNGTFPFWLPPKLAISHQLIKEWVEKQTCSSLPA

SEQ ID NO: 59109 - protein, 352 aa, Homo sapiens
  Payload ID: 11538
  Gene Symbol: NUDT13
  Gene Name: nudix (nucleoside diphosphate linked moiety X)-type motif 13
  Uniprot ID: Q86X67
  ENSP ID: ENSP00000349874
MSLYCGIACRRKFFWCYRLLSTYVTKTRYLFELKEDDDACKKAQQTGAFYLFHSLAPLLQTSAHQYLAPRHSLLELERLLGKFGQDAQRIEDSVLIGCSEQQEAWFALDLGLDSSFSISASLHKPEMETELKGSFIELRKALFQLNARDASLLSTAQALLRWHDAHQFCSRSGQPTKKNVAGSKRVCPSNNIIYYPQMAPVAITLVSDGTRCLLARQSSFPKGMYSALAGFCDIGESVEETIRREVAEEVGLEVESLQYYASQHWPFPSGSLMIACHATVKPGQTEIQVNLRELETAAWFSHDEVATALKRKGPYTQQQNGTFPFWLPPKLAISHQLIKEWVEKQTCSSLPA

SEQ ID NO: 59110 - protein, 235 aa, Homo sapiens
  Payload ID: 11538
  Gene Symbol: NUDT13
  Gene Name: nudix (nucleoside diphosphate linked moiety X)-type motif 13
  Uniprot ID: Q86X67
  ENSP ID: ENSP00000362088
MSLYCGIACRRKFFWCYRLLSTYVTKTRYLFELKEDDDACKKAQQTGAFYLFHSLAPLLQTSAHQYLAPRHSLLELERLLGKFGQDAQRIEDSVLIGCSEQQEAWFALDLGLDSSFSISASLHKPEMETELKGSFIELRKALFQLNARDASLLSTAQALLRWHDAHQFCSRSGQPTKKNVAGSKRVCPSNNIIYYPQVKVWKRPSAEKLQKRWDWRWKACSTMHPSIGPSLVAHS

SEQ ID NO: 59111 - protein, 155 aa, Homo sapiens
  Payload ID: 11538
  Gene Symbol: NUDT13
  Gene Name: nudix (nucleoside diphosphate linked moiety X)-type motif 13
  ENSP ID: ENSP00000438223
MAPVAITLVSDGTRCLLARQSSFPKGMYSALAGFCDIGESVEETIRREVAEEVGLEVESLQYYASQHWPFPSGSLMIACHATVKPGQTEIQVNLRELETAAWFSHDEVATALKRKGPYTQQQNGTFPFWLPPKLAISHQLIKEWVEKQTCSSLPA

SEQ ID NO: 59112 - protein, 226 aa, Homo sapiens
  Payload ID: 11538
  Gene Symbol: NUDT13
  Gene Name: nudix (nucleoside diphosphate linked moiety X)-type motif 13
  Uniprot ID: Q86X67
  ENSP ID: ENSP00000440760
METELKGSFIELRKALFQLNARDASLLSTAQALLRWHDAHQFCSRSGQPTKKNVAGSKRVCPSNNIIYYPQMAPVAITLVSDGTRCLLARQSSFPKGMYSALAGFCDIGESVEETIRREVAEEVGLEVESLQYYASQHWPFPSGSLMIACHATVKPGQTEIQVNLRELETAAWFSHDEVATALKRKGPYTQQQNGTFPFWLPPKLAISHQLIKEWVEKQTCSSLPA

SEQ ID NO: 59113 - protein, 241 aa, Homo sapiens
  Payload ID: 11538
  Gene Symbol: NUDT13
  Gene Name: nudix (nucleoside diphosphate linked moiety X)-type motif 13
  ENSP ID: ENSP00000484185
MSLYCGIACRRKFFWCYRLLSTYVTKTRYLFELKEDDDACKKAQQTGAFYLFHSLAPLLQTSAHQYLAPRHSLLELERLLGKFGQDAQRIEDSVLIGCSEQQEAWFALDLGLDSSFSISASLHKPEMETELKGSFIELRKALFQLNARDASLLSTAQALLRWHDAHQFCSRSGQPTKKNVAGSKRVCPSNNIIYYPQMAPVAITLVSDGTRCLLARQSSFPKGMYSALAGFCDIAYRAVLN

SEQ ID NO: 59114 - protein, 222 aa, Homo sapiens
  Payload ID: 11539
  Gene Symbol: NUDT14
  Gene Name: nudix (nucleoside diphosphate linked moiety X)-type motif 14
  Uniprot ID: O95848
  ENSP ID: ENSP00000376349
MERIEGASVGRCAASPYLRPLTLHYRQNGAQKSWDFMKTHDSVTVLLFNSSRRSLVLVKQFRPAVYAGEVERRFPGSLAAVDQDGPRELQPALPGSAGVTVELCAGLVDQPGLSLEEVACKEAWEECGYHLAPSDLRRVATYWSGVGLTGSRQTMFYTEVTDAQRSGPGGGLVEEGELIEVVHLPLEGAQAFADDPDIPKTLGVIFGVSWFLSQVAPNLDLQ

SEQ ID NO: 59115 - protein, 96 aa, Homo sapiens
  Payload ID: 11539
  Gene Symbol: NUDT14
  Gene Name: nudix (nucleoside diphosphate linked moiety X)-type motif 14
  ENSP ID: ENSP00000447933
MERIEGASVGRCAASPYLRPLTLHYRQNGAQKSWDFMKTHDSHPASAASTLTYSAARVSFPAPRLPSCQLEYSRSGSWPDCDPGKLWSRLGLSHPI

SEQ ID NO: 59116 - protein, 164 aa, Homo sapiens [sequence omitted]

SEQ ID NO: 59117 - protein, 227 aa, Homo sapiens
  Payload ID: 11541
  Gene Symbol: NUDT16
  Gene Name: nudix (nucleoside diphosphate linked moiety X)-type motif 16
  Uniprot ID: Q96DE0
  ENSP ID: ENSP00000422375
MAGARRLELGEALALGSGWRHACHALLYAPDPGMLFGRIPLRYAILMQMRFDGRLGFPGGFVDTQDRSLEDGLNRELREELGEAAAAFRVERTDYRSSHVGSGPRVVAHFYAKRLTLEELLAVEAGATRAKDHGLEVGPAWDSVPFPISSSPKAFSPPRKHPWRKVFAPLTLPSPQLSWWSWDRDHLYSELVLPTWAFCKGLSHPLPGEILSRTHSSMSLCCSLLTV

SEQ ID NO: 59118 - protein, 195 aa, Homo sapiens
  Payload ID: 11541
  Gene Symbol: NUDT16
  Gene Name: nudix (nucleoside diphosphate linked moiety X)-type motif 16
  Uniprot ID: Q96DE0
  ENSP ID: ENSP00000429274
MAGARRLELGEALALGSGWRHACHALLYAPDPGMLFGRIPLRYAILMQMRFDGRLGFPGGFVDTQDRSLEDGLNRELREELGEAAAAFRVERTDYRSSHVGSGPRVVAHFYAKRLTLEELLAVEAGATRAKDHGLEVLGLVRVPLYTLRDGVGGLPTFLENSFIGSAREQLLEALQDLGLLQSGSISGLKIPAHH

SEQ ID NO: 59119 - protein, 159 aa, Homo sapiens
  Payload ID: 11541
  Gene Symbol: NUDT16
  Gene Name: nudix (nucleoside diphosphate linked moiety X)-type motif 16
  Uniprot ID: Q96DE0
  ENSP ID: ENSP00000440230
MQMRFDGRLGFPGGFVDTQDRSLEDGLNRELREELGEAAAAFRVERTDYRSSHVGSGPRVVAHFYAKRLTLEELLAVEAGATRAKDHGLEVLGLVRVPLYTLRDGVGGLPTFLENSFIGSAREQLLEAALHGPMKTEMRTLVLGREGRTWECFLIGSER

SEQ ID NO: 59120 - protein, 211 aa, Homo sapiens
  Payload ID: 11542
  Gene Symbol: NUDT16L1
  Gene Name: nudix (nucleoside diphosphate linked moiety X)-type motif 16-like 1
  Uniprot ID: Q9BRJ7
  ENSP ID: ENSP00000306670
MSTAAVPELKQISRVEAMRLGPGWSHSCHAMLYAANPGQLFGRIPMRFSVLMQMRFDGLLGFPGGFVDRRFWSLEDGLNRVLGLGLGCLRLTEADYLSSHLTEGPHRVVAHLYARQLTLEQLHAVEISAVHSRDHGLEVLGLVRVPLYTQKDRVGGFPNFLSNAFVSTAKCQLLFALKVLNMMPEEKLVEALAAATEKQKKALEKLLPASS

SEQ ID NO: 59121 - protein, 247 aa, Homo sapiens
  Payload ID: 11542
  Gene Symbol: NUDT16L1
  Gene Name: nudix (nucleoside diphosphate linked moiety X)-type motif 16-like 1
  Uniprot ID: Q9BRJ7
  ENSP ID: ENSP00000458144
MSTAAVPELKQISRVEAMRLGPGWSHSCHAMLYAANPGQLFGRIPMRFSVLMQMRFDGLLGFPGGFVDRRFWSLEDGLNRVLGLGLGCLRLTEADYLSSHLTEGPHRVVAHLYARQLTLEQLHAVEISAVHSRDHGLEVGPPPGPRPPPRGLALAPWKAPMGNTSPEGPLAGLGRVSLSPAMGWGEGSGAGRPGKEGRGWGPALGLPQGCVTSALLPAIANPGSGGVGSVGRKGWGRSGDCLGSWET

SEQ ID NO: 59122 - protein, 198 aa, Homo sapiens
  Payload ID: 11542
  Gene Symbol: NUDT16L1
  Gene Name: nudix (nucleoside diphosphate linked moiety X)-type motif 16-like 1
  ENSP ID: ENSP00000464821
  MOD_RES (1)..(1): Any amino acid
XSRVEAMRLGPGWSHSCHAMLYAANPGQLFGRIPMRFSVLMRFDGLLGFPGGFVDRRFWSLEDGLNRVLGLGLGCLRLTEADYLSSHLTEGPHRVVAHLYARQLTLEQLHAVEISAVHSRDHGLEVLGLVRVPLYTQKDRVGGFPNFLSNAFVSTAKCQLLFALKVLNMMPEEKLVEALAAATEKQKKALEKLLPASS

SEQ ID NO: 59123 - protein, 171 aa, Homo sapiens
  Payload ID: 11542
  Gene Symbol: NUDT16L1
  Gene Name: nudix (nucleoside diphosphate linked moiety X)-type motif 16-like 1
  ENSP ID: ENSP00000466854
MSTAAVPELKQISRVEAMRLGPGWSHSCHAMLYAANPGQLFGRIPMRFSVLMQMRFDGLLGFPGGFVDRRFWSLEDGLNRVLGLGLGCLRLTEADYLSSHLTEGPHRVVAHLYARQLTLEQLHAVEISAVHSRDHGLEVLNMMPEEKLVEALAAATEKQKKALEKLLPASS

SEQ ID NO: 59124 - protein, 192 aa, Homo sapiens
  Payload ID: 11542
  Gene Symbol: NUDT16L1
  Gene Name: nudix (nucleoside diphosphate linked moiety X)-type motif 16-like 1
  ENSP ID: ENSP00000468346
MSTAAVPELKQISRVEAMRLGPGWSHSCHAMLYAANPGQLFGRIPMRFSVLMQMRFDGLLGFPGGFVDRRFWSLEDGLNRVLGLGLGCLRLTEADYLSSHLTEGPHRVVAHLYARQLTLEQLHAVEISAVHSRDHGLEVGPPPGPRPPPRGLALAPWKAPMGAGPRAGPAVHPEGPSRRLPQLPEQRLREHG

SEQ ID NO: 59125 - protein, 328 aa, Homo sapiens
  Payload ID: 11543
  Gene Symbol: NUDT17
  Gene Name: nudix (nucleoside diphosphate linked moiety X)-type motif 17
  Uniprot ID: P0C025
  ENSP ID: ENSP00000334437
MAEVRVQLLLSRRPESVSFARSVCGLLGAGPGLGTWPIHCSLKRGRLVLSSRPFPGASARLPLQRPPFCPFAALEERPRVPGAELPTDRGVDLGVAVILQSSDKTVLLTRRARTLSVSPNLWVPPGGHVELEEELLDGGLRELWEESGLHLPQGQFSWVPLGLWESAYPPRLSWGLPKYHHIVLYLLVISQESQQQLQARIQPNPNEVSALMWLTPDVAAAVAAAEDGTETPGLLPQDLPPSVLAVELEEDGRARPLVLHMSTLLRMIPTMAEDKERVSTGTKFALKLWLQHLGRTPPPCKSAAYLDPGPAKEEWNMDPLPPNQGSGK

SEQ ID NO: 59126 - protein, 133 aa, Homo sapiens
  Payload ID: 11544
  Gene Symbol: NUDT18
  Gene Name: nudix (nucleoside diphosphate linked moiety X)-type motif 18
  ENSP ID: ENSP00000479883
MASEGLAGALASVLAGQGSSVHSCDSAPAGEPPAPVRLRKNVCYVVLAVFLSEQDEVLLIQEAKRECRGSWYLPAGRMEPGETIVEALQREVKEEAGLHCEPETLLSVEERGPSWVRFVFLARPTGMAHLEAV

SEQ ID NO: 59127 - protein, 323 aa, Homo sapiens
  Payload ID: 11544
  Gene Symbol: NUDT18
  Gene Name: nudix (nucleoside diphosphate linked moiety X)-type motif 18
  Uniprot ID: Q6ZVK8
  ENSP ID: ENSP00000480722
MASEGLAGALASVLAGQGSSVHSCDSAPAGEPPAPVRLRKNVCYVVLAVFLSEQDEVLLIQEAKRECRGSWYLPAGRMEPGETIVEALQREVKEEAGLHCEPETLLSVEERGPSWVRFVFLARPTGGILKTSKEADAESLQAAWYPRTSLPTPLRAHDILHLVELAAQYRQQARHPLILPQELPCDLVCQRLVATFTSAQTVWVLVGTVGMPHLPVTACGLDPMEQRGGMKMAVLRLLQECLTLHHLVVEIKGLLGLQHLGRDHSDGICLNVLVTVAFRSPGIQDEPPKVRGENFSWWKVMEEDLQSQLLQRLQGSSVVPVNR

SEQ ID NO: 59128 - protein, 375 aa, Homo sapiens
  Payload ID: 11545
  Gene Symbol: NUDT19
  Gene Name: nudix (nucleoside diphosphate linked moiety X)-type motif 19
  Uniprot ID: A8MXV4
  ENSP ID: ENSP00000380251
MSSSLRPGPSRWRRAASIVLAAGWSRPETATPPSRPPPAEGFRLLLLQRSPHQGFMPGAHVFSGGVLDAADRSADWLGLFAPHHGPPRFGLGPAPFSRTAFPSLPDTDDHKTDNTGTLPEDVAFRICAVREAFEEAGVLLLRPRTSPPGPAPGPGLALEPPPGLASWRDRVRQDPRHFLRLCAHLDCTPDIWALHNWSAWLTPFLRGTTRRFDTAFFLCCLREPPPVYPDLAEVVGYQWSSPSEATESFLSKEIWLPPPQFYEVRRLANFASLSDLHKFCLGRALEGLERWLPIILLTADGMVHLLPGDELYLEDSDFLENLMSTEKKTEEIMKEGKQFHRIVTYHRHLYDIHVTVQPKYKHVYPKNSVVRKSHL

SEQ ID NO: 59129 - protein, 147 aa, Homo sapiens
  Payload ID: 11546
  Gene Symbol: NUDT2
  Gene Name: nudix (nucleoside diphosphate linked moiety X)-type motif 2
  Uniprot ID: P50583
  ENSP ID: ENSP00000344187
MALRACGLIIFRRCLIPKVDNNAIEFLLLQASDGIHHWTPPKGHVEPGEDDLETALRETQEEAGIEAGQLTIIEGFKRELNYVARNKPKTVIYWLAEVKDYDVEIRLSHEHQAYRWLGLEEACQLAQFKEMKAALQEGHQFLCSIEA

SEQ ID NO: 59130 - protein, 147 aa, Homo sapiens; identical to SEQ ID NO: 59129
  Payload ID: 11546
  Gene Symbol: NUDT2
  Gene Name: nudix (nucleoside diphosphate linked moiety X)-type motif 2
  Uniprot ID: P50583
  ENSP ID: ENSP00000368452

SEQ ID NO: 59131 - protein, 147 aa, Homo sapiens; identical to SEQ ID NO: 59129
  Payload ID: 11546
  Gene Symbol: NUDT2
  Gene Name: nudix (nucleoside diphosphate linked moiety X)-type motif 2
  Uniprot ID: P50583
  ENSP ID: ENSP00000368455

SEQ ID NO: 59132 - protein, 147 aa, Homo sapiens; identical to SEQ ID NO: 59129
  Payload ID: 11546
  Gene Symbol: NUDT2
  Gene Name: nudix (nucleoside diphosphate linked moiety X)-type motif 2
  Uniprot ID: P50583
  ENSP ID: ENSP00000482384

SEQ ID NO: 59133 - protein, 227 aa, Homo sapiens
  Payload ID: 11547
  Gene Symbol: NUDT21
  Gene Name: nudix (nucleoside diphosphate linked moiety X)-type motif 21
  Uniprot ID: O43809
  ENSP ID: ENSP00000300291
MSVVPPNRSQTGWPRGVTQFGNKYIQQTKPLTLERTINLYPLTNYTFGTKEPLYEKDSSVAARFQRMREEFDKIGMRRTVEGVLIVHEHRLPHVLLLQLGTTFFKLPGGELNPGEDEVEGLKRLMTEILGRQDGVLQDWVIDDCIGNWWRPNFEPPQYPYIPAHITKPKEHKKLFLVQLQEKALFAVPKNYKLVAAPLFELYDNAPGYGPIISSLPQLLSRFNFIYN

SEQ ID NO: 59134 - protein, 149 aa, Homo sapiens
  Payload ID: 11547
  Gene Symbol: NUDT21
  Gene Name: nudix (nucleoside diphosphate linked moiety X)-type motif 21
  ENSP ID: ENSP00000454790
MREEFDKIGMRRTVEGVLIVHEHRLPHVLLLQLGTTFFKLPGGELNPGEDEVEGLKRLMTEILGRQDGVLQDWVIDDCIGNWWRPNFEPPQYPYIPAHITKPKEHKKLFLVQLQEKALFAVPKNYKLVAAPLFELYDNAPGYGPIISSL

SEQ ID NO: 59135 - protein, 71 aa, Homo sapiens
  Payload ID: 11547
  Gene Symbol: NUDT21
  Gene Name: nudix (nucleoside diphosphate linked moiety X)-type motif 21
  ENSP ID: ENSP00000457942
MREEFDKIGMRRTVEGVLIVHEHRLPHVLLLQLGTTFFKLPGGELNPGEDEVEGLKRLMTEILGRQDGVLQ

SEQ ID NO: 59136 - protein, 303 aa, Homo sapiens
  Payload ID: 11548
  Gene Symbol: NUDT22
  Gene Name: nudix (nucleoside diphosphate linked moiety X)-type motif 22
  Uniprot ID: Q9BRQ3
  ENSP ID: ENSP00000279206
MDPEVTLLLQCPGGGLPQEQIQAELSPAHDRRPLPGGDEAITAIWETRLKAQPWLFDAPKFRLHSATLAPIGSRGPQLLLRLGLTSYRDFLGTNWSSSAAWLRQQGATDWGDTQAYLADPLGVGAALATADDFLVFLRRSRQVAEAPGLVDVPGGHPEPQALCPGGSPQHQDLAGQLVVHELFSSVLQEICDEVNLPLLTLSQPLLLGIARNETSAGRASAEFYVQCSLTSEQVRKHYLSGGPEAHESTGIFFVETQNVQRLLETEMWAELCPSAKGAIILYNRVQGSPTGAALGSPALLPPL

SEQ ID NO: 59137 - protein, 277 aa, Homo sapiens
  Payload ID: 11548
  Gene Symbol: NUDT22
  Gene Name: nudix (nucleoside diphosphate linked moiety X)-type motif 22
  ENSP ID: ENSP00000401085
MDPEVTLLLQCPGGGLPQEQIQAELSPAHDRRPLPGGDEAITAIWETRLKAQPWLFDAPKFRLHSATLAPIGSRGPQLLLRLGLTSYRDFLGTNWSSSAAWLRQQGATDWGDTQAYLADPLGVGAALATADDFLVFLRRSRQVAEAPGLVDVPGGHPEPQLDLWLSVRERTPDSGSLTLLHCATSDPQGQQALCPGGSPQHQDLAGQLVVHELFSSVLQEICDEVNLPLLTLSQPLLLGIARNETSAGRASAEFYVQCSLTSEQVRKHYLSGGPEAH

SEQ ID NO: 59138 - protein, 270 aa, Homo sapiens
  Payload ID: 11548
  Gene Symbol: NUDT22
  Gene Name: nudix (nucleoside diphosphate linked moiety X)-type motif 22
  Uniprot ID: Q9BRQ3
  ENSP ID: ENSP00000407970
MDPEVTLLLQCPGGGLPQEQIQAELSPAHDRRPLPGGDEAITAIWETRLKAQPWLFDAPKFRLHSATLAPIGSRGPQLLLRLGLTSYRDFLGTNWSSSAAWLRQQGATDWGDTQAYLADPLGVGAALATADDFLVFLRRSRQVAEAPGLVDVPGGHPEPQVNLPLLTLSQPLLLGIARNETSAGRASAEFYVQCSLTSEQVRKHYLSGGPEAHESTGIFFVETQNVQRLLETEMWAELCPSAKGAIILYNRVQGSPTGAALGSPALLPPL

SEQ ID NO: 59139 - protein, 165 aa, Homo sapiens
  Payload ID: 11548
  Gene Symbol: NUDT22
  Gene Name: nudix (nucleoside diphosphate linked moiety X)-type motif 22
  ENSP ID: ENSP00000440166
MDPEVTLLLQCPGGGLPQEQIQAELSPAHDRRPLPGGDEAITAIWETRLKAQPWLFDAPKFRLHSATLAPIGSRGPQLLLRLGLTSYRDFLGTNWSSSAAWLRQQGATDWGDTQAYLADPLGVGAALATADDFLVFLRRSRQVAEAPGLVDVPGGHPEPQVQPDF

SEQ ID NO: 59140 - protein, 165 aa, Homo sapiens; identical to SEQ ID NO: 59139
  Payload ID: 11548
  Gene Symbol: NUDT22
  Gene Name: nudix (nucleoside diphosphate linked moiety X)-type motif 22
  ENSP ID: ENSP00000442014

SEQ ID NO: 59141 - protein, 56 aa, Homo sapiens
  Payload ID: 11548
  Gene Symbol: NUDT22
  Gene Name: nudix (nucleoside diphosphate linked moiety X)-type motif 22
  ENSP ID: ENSP00000443127
STGIFFVETQNVQRLLETEMWAELCPSAKGAIILYNRVQGSPTGAALGSPALLPPL

SEQ ID NO: 59142 - protein, 123 aa, Homo sapiens
  Payload ID: 11548
  Gene Symbol: NUDT22
  Gene Name: nudix (nucleoside diphosphate linked moiety X)-type motif 22
  ENSP ID: ENSP00000444022
MDPEVTLLLQCPGGGLPQEQIQAELSPAHDRRPLPGGDEAITAIWETRLKAQPWLFDAPKFRLHSATLAPIGSRGPQLLLRLGLTSYRDFLGTNWSSSAAWLRQQGATDWGDTQAYLADPLGV

SEQ ID NO: 59143 - protein, 172 aa, Homo sapiens
  Payload ID: 11549
  Gene Symbol: NUDT3
  Gene Name: nudix (nucleoside diphosphate linked moiety X)-type motif 3
  Uniprot ID: O95989
  ENSP ID: ENSP00000476119
MMKLKSNQTRTYDGDGYKKRAACLCFRSESEEEVLLVSSSRHPDRWIVPGGGMEPEEEPSVAAVREVCEEAGVKGTLGRLVGIFENQERKHRTYVYVLIVTEVLEDWEDSVNIGRKREWFKIEDAIKVLQYHKPVQASYFETLRQGYSANNGTPVVATTYSVSAQSSMSGIR

SEQ ID NO: 59144 - protein, 181 aa, Homo sapiens
  Payload ID: 11550
  Gene Symbol: NUDT4
  Gene Name: nudix (nucleoside diphosphate linked moiety X)-type motif 4
  Uniprot ID: Q9NZJ9
  ENSP ID: ENSP00000338352
MMKFKPNQTRTYDREGFKKRAACLCFRSEQEDEVLLVSSSRYPDQWIVPGGGMEPEEEPGGAAVREVYEEAGVKGKLGRLLGIFEQNQDRKHRTYVYVLTVTEILEDWEDSVNIGRKREWFKVEDAIKVLQCHKPVHAEYLEKLKLGCSPANGNSTVPSLPDNNALFVTAAQTSGLPSSVR

SEQ ID NO: 59145 - protein, 180 aa, Homo sapiens
  Payload ID: 11550
  Gene Symbol: NUDT4
  Gene Name: nudix (nucleoside diphosphate linked moiety X)-type motif 4
  Uniprot ID: Q9NZJ9
  ENSP ID: ENSP00000406612
MMKFKPNQTRTYDREGFKKRAACLCFRSEQEDEVLLVSSSRYPDQWIVPGGGMEPEEEPGGAAVREVYEEAGVKGKLGRLLGIFENQDRKHRTYVYVLTVTEILEDWEDSVNIGRKREWFKVEDAIKVLQCHKPVHAEYLEKLKLGCSPANGNSTVPSLPDNNALFVTAAQTSGLPSSVR

SEQ ID NO: 59146 - protein, 129 aa, Homo sapiens
  Payload ID: 11550
  Gene Symbol: NUDT4
  Gene Name: nudix (nucleoside diphosphate linked moiety X)-type motif 4
  Uniprot ID: Q9NZJ9
  ENSP ID: ENSP00000448032
MEPEEEPGGAAVREVYEEAGVKGKLGRLLGIFEQNQDRKHRTYVYVLTVTEILEDWEDSVNIGRKREWFKVEDAIKVLQCHKPVHAEYLEKLKLGCSPANGNSTVPSLPDNNALFVTAAQTSGLPSSVR

SEQ ID NO: 59147 - protein, 95 aa, Homo sapiens
  Payload ID: 11550
  Gene Symbol: NUDT4
  Gene Name: nudix (nucleoside diphosphate linked moiety X)-type motif 4
  ENSP ID: ENSP00000448504
MEPEEEPGGAAVREVYEEAGVKGKLGRLLGIFENQDRKHRTYVYVLTVTEILEDWEDSVNIGRKREWFKVEDAIKVLQCHKPVHAEYLEKLKLGC

SEQ ID NO: 59148 - protein, 112 aa, Homo sapiens
  Payload ID: 11550
  Gene Symbol: NUDT4
  Gene Name: nudix (nucleoside diphosphate linked moiety X)-type motif 4
  ENSP ID: ENSP00000448620
MEPEEEPGGAAVREVYEEAGVKGKLGRLLGIFENQDRKHRTYVYVLTVTEILEDWEDSVNIGRKREWFKVEDAIKVLQCHKPVHAEYLEKLKLGCSPANGNSTVPSLPDNNA

SEQ ID NO: 59149 - protein, 128 aa, Homo sapiens
  Payload ID: 11550
  Gene Symbol: NUDT4
  Gene Name: nudix (nucleoside diphosphate linked moiety X)-type motif 4
  ENSP ID: ENSP00000449552
MEPEEEPGGAAVREVYEEAGVKGKLGRLLGIFENQDRKHRTYVYVLTVTEILEDWEDSVNIGRKREWFKVEDAIKVLQCHKPVHAEYLEKLKLGCSPANGNSTVPSLPDNNALFVTAAQTSGLPSSVR

SEQ ID NO: 59150 - protein, 128 aa, Homo sapiens; identical to SEQ ID NO: 59149
  Payload ID: 11550
  Gene Symbol: NUDT4
  Gene Name: nudix (nucleoside diphosphate linked moiety X)-type motif 4
  ENSP ID: ENSP00000449724

SEQ ID NO: 59151 - protein, 180 aa, Homo sapiens
  Payload ID: 11551
  Gene Symbol: NUDT5
  Gene Name: nudix (nucleoside diphosphate linked moiety X)-type motif 5
  ENSP ID: ENSP00000368209
MESQEPTESSQNGKQYIISEELISEGKWVKLEKTTYMDPTGKTRTWESVKRTTRKEQTADGVAVIPVLQRTLHYECIVLVKQFRPPMGGYCIEFPAGLIDDGETPEAAALRELEEETGYKGDIAECSPAVCMDPGLSNCTIHIVTVTINGDDAENARPKPKPGDGGMFCNSWWPSVYDLV

SEQ ID NO: 59152 - protein, 232 aa, Homo sapiens
  Payload ID: 11551
  Gene Symbol: NUDT5
  Gene Name: nudix (nucleoside diphosphate linked moiety X)-type motif 5
  ENSP ID: ENSP00000368219
MESQEPTESSQNGKQYIISEELISEGKWVKLEKTTYMDPTGKTRRNKEKTTTLLILRTWESVKRTTRKEQTADGVAVIPVLQRTLHYECIVLVKQFRPPMGGYCIEFPAGLIDDGETPEAAALRELEEETGYKGDIAECSPAVCMDPGLSNCTIHIVTVTINGDDAENARPKPKPGDGEFVEVISLPKNDLLQRLDALVAEEHLTVDARVYSYALALKHANAKPFEVPFLKF

SEQ ID NO: 59153 - protein, 186 aa, Homo sapiens
  Payload ID: 11551
  Gene Symbol: NUDT5
  Gene Name: nudix (nucleoside diphosphate linked moiety X)-type motif 5
  ENSP ID: ENSP00000368222
MESQEPTESSQNGKQYIISEELISEGKWVKLEKTTYMDPTGKTRTWESVKRTTRKEQTADGVAVIPVLQRTLHYECIVLVKQFRPPMGGYCIEFPAGLIDDGETPEAAALRELEEETGYKGDIAECSPAVCMDPGLSNCTIHIVTVTINGDDAENARPKPKPGDGEFVEVISLPKNDLLQRLDETL

SEQ ID NO: 59154 - protein, 97 aa, Homo sapiens
  Payload ID: 11551
  Gene Symbol: NUDT5
  Gene Name: nudix (nucleoside diphosphate linked moiety X)-type motif 5
  ENSP ID: ENSP00000407856
MESQEPTESSQNGKQYIISEELISEGKWVKLEKTTYMDPTGKTRTWESVKRTTRKEQTADGRSANLFQPFRKEVSTCDRVAVIPVLQRTLHYECIVL

SEQ ID NO: 59155 - protein, 219 aa, Homo sapiens
  Payload ID: 11551
  Gene Symbol: NUDT5
  Gene Name: nudix (nucleoside diphosphate linked moiety X)-type motif 5
  Uniprot ID: Q9UKK9
  ENSP ID: ENSP00000419628
MESQEPTESSQNGKQYIISEELISEGKWVKLEKTTYMDPTGKTRTWESVKRTTRKEQTADGVAVIPVLQRTLHYECIVLVKQFRPPMGGYCIEFPAGLIDDGETPEAAALRELEEETGYKGDIAECSPAVCMDPGLSNCTIHIVTVTINGDDAENARPKPKPGDGEFVEVISLPKNDLLQRLDALVAEEHLTVDARVYSYALALKHANAKPFEVPFLKF

SEQ ID NO: 59156 - protein, 137 aa, Homo sapiens
  Payload ID: 11551
  Gene Symbol: NUDT5
  Gene Name: nudix (nucleoside diphosphate linked moiety X)-type motif 5
  ENSP ID: ENSP00000436844
  MOD_RES (1)..(1): Any amino acid
XTWESVKRTTRKEQTADGVAVIPVLQRTLHYECIVLVKQFRPPMGGYCIEFPAGLIDDGETPEAAALRELEEETGYKGDIAECSPAVCMDPGLSNCTIHIVTVTINGDDAENARPKPKPGDGGMFCNSWWPSVYDLV

SEQ ID NO: 59157 - protein, 219 aa, Homo sapiens; identical to SEQ ID NO: 59155
  Payload ID: 11551
  Gene Symbol: NUDT5
  Gene Name: nudix (nucleoside diphosphate linked moiety X)-type motif 5
  Uniprot ID: Q9UKK9
  ENSP ID: ENSP00000445116

SEQ ID NO: 59158 - protein, 316 aa, Homo sapiens
  Payload ID: 11552
  Gene Symbol: NUDT6
  Gene Name: nudix (nucleoside diphosphate linked moiety X)-type motif 6
  Uniprot ID: P53370
  ENSP ID: ENSP00000306070
MRQPLSWGRWRAMLARTYGPGPSAGYRWASGAQGYVRNPPVGACDLQGELDRFGGISVRLARLDALDRLDAAAFQKGLQAAVQQWRSEGRTAVWLHIPILQSRFIAPAASLGFCFHHAESDSSTLTLWLREGPSRLPGYASHQVGVAGAVFDESTRKILVVQDRNKLKNMWKFPGGLSEPEEDIGDTAVREVFEETGIKSEFRSVLSIRQQHTNPGAFGKSDMYIICRLKPYSFTINFCQEECLRCEWMDLNDLAKTENTTPITSRVARLLLYGYREGFDKIDLTVEELPAVYTGLFYKLYHKELPENYKTMKGID

SEQ ID NO: 59159 - protein, 147 aa, Homo sapiens
  Payload ID: 11552
  Gene Symbol: NUDT6
  Gene Name: nudix (nucleoside diphosphate linked moiety X)-type motif 6
  Uniprot ID: P53370
  ENSP ID: ENSP00000344011
MWKFPGGLSEPEEDIGDTAVREVFEETGIKSEFRSVLSIRQQHTNPGAFGKSDMYIICRLKPYSFTINFCQEECLRCEWMDLNDLAKTENTTPITSRVARLLLYGYREGFDKIDLTVEELPAVYTGLFYKLYHKELPENYKTMKGID

SEQ ID NO: 59160 - protein, 104 aa, Homo sapiens
  Payload ID: 11552
  Gene Symbol: NUDT6
  Gene Name: nudix (nucleoside diphosphate linked moiety X)-type motif 6
  ENSP ID: ENSP00000420843
MRQPLSWGRWRAMLARTYGPGPSAGYRWASGAQGYVRNPPVGACDLQGELDRFGGISVRLARLDALDRLDAAAFQKGLQGKCAWDEGLPGLQSFSNEITAAPTP

SEQ ID NO: 59161 - protein, 104 aa, Homo sapiens; identical to SEQ ID NO: 59160
  Payload ID: 11552
  Gene Symbol: NUDT6
  Gene Name: nudix (nucleoside diphosphate linked moiety X)-type motif 6
  ENSP ID: ENSP00000422698

SEQ ID NO: 59162 - protein, 50 aa, Homo sapiens
  Payload ID: 11552
  Gene Symbol: NUDT6
  Gene Name: nudix (nucleoside diphosphate linked moiety X)-type motif 6
  ENSP ID: ENSP00000423745
  MOD_RES (1)..(1): Any amino acid
XDLQGELDRFGGISVRLARLDALDRLDAAAFQKGLQVEKYVEVSRRPVRA

SEQ ID NO: 59163 - protein, 147 aa, Homo sapiens; identical to SEQ ID NO: 59159
  Payload ID: 11552
  Gene Symbol: NUDT6
  Gene Name: nudix (nucleoside diphosphate linked moiety X)-type motif 6
  Uniprot ID: P53370
  ENSP ID: ENSP00000424117

SEQ ID NO: 59164 - protein, 238 aa, Homo sapiens
  Payload ID: 11553
  Gene Symbol: NUDT7
  Gene Name: nudix (nucleoside diphosphate linked moiety X)-type motif 7
  Uniprot ID: P0C024
  ENSP ID: ENSP00000268533
MSRLGLPEEPVRNSLLDDAKARLRKYDIGGKYSHLPYNKYSVLLPLVAKEGKLHLLFTVRSEKLRRAPGEVCFPGGKRDPTDMDDAATALREAQEEVGLRPHQVEVVCCLVPCLIDTDTLITPFVGLIDHNFQAQPNPAEVKDVFLVPLAYFLHPQVHDQHYVTRLGHRFINHIFEYTNPEDGVTYQIKGMTANLAVLVAFIILEKKPTFEVQFNLNDVLASSEELFLKVHKKATSRL

SEQ ID NO: 59165 - protein, 185 aa, Homo sapiens
  Payload ID: 11553
  Gene Symbol: NUDT7
  Gene Name: nudix (nucleoside diphosphate linked moiety X)-type motif 7
  Uniprot ID: P0C024
  ENSP ID: ENSP00000387707
MSRLGLPEEPVRNSLLDDAKARLRKYDIGGKYSHLPYNKYSVLLPLVAKEGKLHLLFTVRSEKTDTLITPFVGLIDHNFQAQPNPAEVKDVFLVPLAYFLHPQVHDQHYVTRLGHRFINHIFEYTNPEDGVTYQIKGMTANLAVLVAFIILEKKPTFEVQFNLNDVLASSEELFLKVHKKATSRL

SEQ ID NO: 59166 - protein, 15 aa, Homo sapiens
  Payload ID: 11553
  Gene Symbol: NUDT7
  Gene Name: nudix (nucleoside diphosphate linked moiety X)-type motif 7
  ENSP ID: ENSP00000454617
MSRLGLPEEPVRQIH

SEQ ID NO: 59167 - protein, 120 aa, Homo sapiens
  Payload ID: 11553
  Gene Symbol: NUDT7
  Gene Name: nudix (nucleoside diphosphate linked moiety X)-type motif 7
  ENSP ID: ENSP00000456363
MSRLGLPEEPVRNSLLDDAKARLRKYDIGGKYSHLPYNKYSVLLPLVAKEGKLHLLFTVRSEKLRRAPGEVCFPGGKRDPTDMDDAATALREAQEEVGLRPHQVEVVCCLVPCLIDVRVS

SEQ ID NO: 59168 - protein, 170 aa, Homo sapiens
  Payload ID: 11553
  Gene Symbol: NUDT7
  Gene Name: nudix (nucleoside diphosphate linked moiety X)-type motif 7
  Uniprot ID: P0C024
  ENSP ID: ENSP00000457566
MSRLGLPEEPVRNSLLDDAKARLRKYDIGGKYSHLPYNKYSVLLPLVAKEGKLHLLFTVRSEKLRRAPGEVCFPGGKRDPTDMDDAATALREAQEEVGLRPHQVEVVCCLVPCLIDRWGSRYVDEAGLELLASSDPPTSASQSAGITDRYIDNSICGFNRPQLPGPAESC

SEQ ID NO: 59169 - protein, 223 aa, Homo sapiens
  Payload ID: 11553
  Gene Symbol: NUDT7
  Gene Name: nudix (nucleoside diphosphate linked moiety X)-type motif 7
  ENSP ID: ENSP00000479582
MSRLGLPEEPVRNSLLDDAKARLRKYDIGGKYSHLPYNKYSVLLPLVAKEGKLHLLFTVRSEKPCEVLAPPLPSAMIVSFLRSPQKPSRRQHHAPCTACETTDTLITPFVGLIDHNFQAQPNPAEVKDVFLVPLAYFLHPQVHDQHYVTRLGHRFINHIFEYTNPEDGVTYQIKGMTANLAVLVAFIILEKKPTFEVQFNLNDVLASSEELFLKVHKKATSRL

SEQ ID NO: 59170 - protein, 140 aa, Homo sapiens
  Payload ID: 11554
  Gene Symbol: NUDT8
  Gene Name: nudix (nucleoside diphosphate linked moiety X)-type motif 8
  Uniprot ID: Q8WV74
  ENSP ID: ENSP00000301490
MLPDCLSAEGELRCRRLLAGATARLRARPASAAVLVPLCSVRGVPALLYTLRSSRLTGRHKGDVSFPGGKCDPADQDVVHTALRETREELGLAVPEEHVWGLLRPVYDPQKATVVPVLAGVGPLDPQSLRPNSEEVSWGI

SEQ ID NO: 59171 - protein, 236 aa, Homo sapiens
  Payload ID: 11554
  Gene Symbol: NUDT8
  Gene Name: nudix (nucleoside diphosphate linked moiety X)-type motif 8
  Uniprot ID: Q8WV74
  ENSP ID: ENSP00000365883
MLPDCLSAEGELRCRRLLAGATARLRARPASAAVLVPLCSVRGVPALLYTLRSSRLTGRHKGDVSFPGGKCDPADQDVVHTALRETREELGLAVPEEHVWGLLRPVYDPQKATVVPVLAGVGPLDPQSLRPNSEEVDEVFALPLAHLLQTQNQGYTHFCRGGHFRYTLPVFLHGPHRVWGLTAVITEFALQLLAPGTYQPRLAGLTCSGAEGLARPKQPLASPCQASSTPGLNKGL

SEQ ID NO: 59172 - protein, 350 aa, Homo sapiens
  Payload ID: 11555
  Gene Symbol: NUDT9
  Gene Name: nudix (nucleoside diphosphate linked moiety X)-type motif 9
  Uniprot ID: Q9BW91
  ENSP ID: ENSP00000303575
MAGRLLGKALAAVSLSLALASVTIRSSRCRGIQAFRNSFSSSWFHLNTNVMSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKLFSQDHLVIYKGYVDDPRNTDNAWMETEAVNYHDETGEIMDNLMLEAGDDAGKVKWVDINDKLKLYASHSQFIKLVAEKRDAHWSEDSEADCHAL

SEQ ID NO: 59173 - protein, 284 aa, Homo sapiens
  Payload ID: 11555
  Gene Symbol: NUDT9
  Gene Name: nudix (nucleoside diphosphate linked moiety X)-type motif 9
  ENSP ID: ENSP00000410270
MAGRLLGKALAAVSLSLALASVTIRSSRCRGIQAFRNSFSSSWFHLNTNVMSGSNGSKENSHNKARTSPYPGSKVERSQVPNEKVGWLVEWQDYKPVEYTAVSVLAGPRWADPQIRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKLFSQDHLVIYKGYVDDPRNTDNAWMETEAVNYHDETGEIMDNLMLEAGDDAGKVKWVDIND

SEQ ID NO: 59174 - protein, 300 aa, Homo sapiens
  Payload ID: 11555
  Gene Symbol: NUDT9
  Gene Name: nudix (nucleoside diphosphate linked moiety X)-type motif 9
  Uniprot ID: Q9BW91
  ENSP ID: ENSP00000421811
MSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKLFSQDHLVIYKGYVDDPRNTDNAWMETEAVNYHDETGEIMDNLMLEAGDDAGKVKWVDINDKLKLYASHSQFIKLVAEKRDAHWSEDSEADCHAL

SEQ ID NO: 59175 - protein, 77 aa, Homo sapiens
  Payload ID: 11555
  Gene Symbol: NUDT9
  Gene Name: nudix (nucleoside diphosphate linked moiety X)-type motif 9
  ENSP ID: ENSP00000422232
MAGRLLGKALAAVSLSLALASVTIRSSRCRGIQAFRNPAGRTGLVGRGLLGRWGPNHAADPIITRGWWIQERRLVPH

SEQ ID NO: 59176 - protein, 206 aa, Homo sapiens
  Payload ID: 11555
  Gene Symbol: NUDT9
  Gene Name: nudix (nucleoside diphosphate linked moiety X)-type motif 9
  ENSP ID: ENSP00000424702
MSGSNGSKENSHNKARTSPYPGSKVERSQVPNEKVGWLVEWQDYKPVEYTAVSVLAGPRWADPQISESNFSPKFNEKDGHVERKSKNGLYEIENGRPRNPAGRTGLVGRGLLGRWGPNHAADPIITRWKRDSSGNKIMHPVSGKHILQFVAIKRKDCGEWAIPGGMVDPGEKISATLKREFGEEALNSLQKTSAEKREIEEKLHKL

SEQ ID NO: 59177 - protein, 464 aa, Homo sapiens
  Payload ID: 11556
  Gene Symbol: NUF2
  Gene Name: NUF2, NDC80 kinetochore complex component
  Uniprot ID: Q9BZD4
  ENSP ID: ENSP00000271452
METLSFPRYNVAEIVIHIRNKILTGADGKNLTKNDLYPNPKPEVLHMIYMRALQIVYGIRLEHFYMMPVNSEVMYPHLMEGFLPFSNLVTHLDSFLPICRVNDFETADILCPKAKRTSRFLSGIINFIHFREACRETYMEFLWQYKSSADKMQQLNAAHQEALMKLERLDSVPVEEQEEFKQLSDGIQELQQSLNQDFHQKTIVLQEGNSQKKSNISEKTKRLNELKLSVVSLKEIQESLKTKIVDSPEKLKNYKEKMKDTVQKLKNARQEVVEKYEIYGDSVDCLPSCQLEVQLYQKKIQDLSDNREKLASILKESLNLEDQIESDESELKKLKTEENSFKRLMIVKKEKLATAQFKINKKHEDVKQYKRTVIEDCNKVQEKRGAVYERVTTINQEIQKIKLGIQQLKDAAEREKLKSQEIFLNLKTALEKYHDGIEKAAEDSYAKIDEKTAELKRKMFKMST

SEQ ID NO: 59178 - protein, 464 aa, Homo sapiens; identical to SEQ ID NO: 59177
  Payload ID: 11556
  Gene Symbol: NUF2
  Gene Name: NUF2, NDC80 kinetochore complex component
  Uniprot ID: Q9BZD4
  ENSP ID: ENSP00000356875

SEQ ID NO: 59179 - protein, 202 aa, Homo sapiens
  Payload ID: 11556
  Gene Symbol: NUF2
  Gene Name: NUF2, NDC80 kinetochore complex component
  ENSP ID: ENSP00000392652
METLSFPRYNVAEIVIHIRNKILTGADGKNLTKNDLYPNPKPEVLHMIYMRALQIVYGIRLEHFYMMPVNSEVMYPHLMEGFLPFSNLVTHLDSFLPICRVNDFETADILCPKAKRTSRFLSGIINFIHFREACRETYMEFLWQYKSSADKMQQLNAAHQEALMKLERLDSVPVEEQEEFKQLSDGIQELQQSLNQDFHQKT

SEQ ID NO: 59180 - protein, 145 aa, Homo sapiens
  Payload ID: 11556
  Gene Symbol: NUF2
  Gene Name: NUF2, NDC80 kinetochore complex component
  ENSP ID: ENSP00000403252
METLSFPRYNVAEIVIHIRNKILTGADGKNLTKNDLYPNPKPEVLHMIYMRALQIVYGIRLEHFYMMPVNSEVMYPHLMEGFLPFSNLVTHLDSFLPICRVNDFETADILCPKAKRTSRFLSGIINFIHFREACRETYMEFLWQY

SEQ ID NO: 59181 - protein, 124 aa, Homo sapiens
  Payload ID: 11556
  Gene Symbol: NUF2
  Gene Name: NUF2, NDC80 kinetochore complex component
  ENSP ID: ENSP00000433533
METLSFPRYNVAEIVIHIRNKILTGADGKNLTKNDLYPNPKPEVLHMIYMRALQIVYGIRLEHFYMMPVNSEVMYPHLMEGFLPFSNLVTHLDSFLPICRVNDFETADILCPKAKRTSRFLSGI

SEQ ID NO: 59182 - protein, 221 aa, Homo sapiens
  Payload ID: 11556
  Gene Symbol: NUF2
  Gene Name: NUF2, NDC80 kinetochore complex component
  ENSP ID: ENSP00000436473
METLSFPRYNVAEIVIHIRNKILTGADGKNLTKNDLYPNPKPEVLHMIYMRALQIVYGIRLEHFYMMPVNSEVMYPHLMEGFLPFSNLVTHLDSFLPICRVNDFETADILCPKAKRTSRFLSGIINFIHFREACRETYMEFLWQYKSSADKMQQLNAAHQEALMKLERLDSVPVEEQEEFKQLSDGIQELQQSLNQDFHQKTCCKREIPKRSQIFQRKPSV

SEQ ID NO: 59183 - protein, 417 aa, Homo sapiens
  Payload ID: 11556
  Gene Symbol: NUF2
  Gene Name: NUF2, NDC80 kinetochore complex component
  ENSP ID: ENSP00000436888
METLSFPRYNVAEIVIHIRNKILTGADGKNLTKNDLYPNPKPEVLHMIYMRALQIVYGIRLEHFYMMPVNSEVMYPHLMEGFLPFSNLVTHLDSFLPICRVNDFETADILCPKAKRTSRFLSGIINFIHFREACRETYMEFLWQYKSSADKMQQLNAAHQEALMKLERLDSVPVEEQEEFKQLSDGIQELQQSLNQDFHQKTIVLQEGNSQKKSNISEKTKRLNELKLSVVSLKEIQESLKTKIVDSPEKLKNYKEKMKDTVQKLKNARSLNLEDQIESDESELKKLKTEENSFKRLMIVKKEKLATAQFKINKKHEDVKQYKRTVIEDCNKVQEKRGAVYERVTTINQEIQKIKLGIQQLKDAAEREKLKSQEIFLNLKTALEKYHDGIEKAAEDSYAKIDEKTAELKRKMFKMST

SEQ ID NO: 59184 - protein, 651 aa, Homo sapiens
  Payload ID: 11557
  Gene Symbol: NUMB
  Gene Name: numb homolog (Drosophila)
  Uniprot ID: P49757
  ENSP ID: ENSP00000347169
MNKLRQSFRRKKDVYVPEASRPHQWQTDEEGVRTGKCSFPVKYLGHVEVDESRGMHICEDAVKRLKAERKFFKGFFGKTGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIEQLARQGSFRGFPALSQKMSPFKRQLSLRINELPSTMQRKTDFPIKNAVPEVEGEAESISSLCSQITNAFSTPEDPFSSAPMTKPVTVVAPQSPTFQANGTDSAFHVLAKPAHTALAPVAMPVRETNPWAHAPDAANKEIAATCSGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 59185 - protein, 603 aa, Homo sapiens
  Payload ID: 11557
  Gene Symbol: NUMB
  Gene Name: numb homolog (Drosophila)
  Uniprot ID: P49757
  ENSP ID: ENSP00000348644
MNKLRQSFRRKKDVYVPEASRPHQWQTDEEGVRTGKCSFPVKYLGHVEVDESRGMHICEDAVKRLKAERKFFKGFFGKTGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIEQLARQGSFRGFPALSQKMSPFKRQLSLRINELPSTMQRKTDFPIKNAVPEVEGEAESISSLCSQITNAFSTPEDPFSSAPMTKPVTVVAPQSPTFQGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 59186 - protein, 640 aa, Homo sapiens
  Payload ID: 11557
  Gene Symbol: NUMB
  Gene Name: numb homolog (Drosophila)
  Uniprot ID: P49757
  ENSP ID: ENSP00000352563
MNKLRQSFRRKKDVYVPEASRPHQWQTDEEGVRTGKCSFPVKYLGHVEVDESRGMHICEDAVKRLKATGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIEQLARQGSFRGFPALSQKMSPFKRQLSLRINELPSTMQRKTDFPIKNAVPEVEGEAESISSLCSQITNAFSTPEDPFSSAPMTKPVTVVAPQSPTFQANGTDSAFHVLAKPAHTALAPVAMPVRETNPWAHAPDAANKEIAATCSGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 59187 - protein, 603 aa, Homo sapiens; identical to SEQ ID NO: 59185
  Payload ID: 11557
  Gene Symbol: NUMB
  Gene Name: numb homolog (Drosophila)
  Uniprot ID: P49757
  ENSP ID: ENSP00000441258

SEQ ID NO: 59188 - protein, 456 aa, Homo sapiens
  Payload ID: 11557
  Gene Symbol: NUMB
  Gene Name: numb homolog (Drosophila)
  Uniprot ID: P49757
  ENSP ID: ENSP00000446001
MNKLRQSFRRKKDVYVPEASRPHQWQTDEEGVRTGKCSFPVKYLGHVEVDESRGMHICEDAVKRLKAERKFFKGFFGKTGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 59189 - protein, 445 aa, Homo sapiens
  Payload ID: 11557
  Gene Symbol: NUMB
  Gene Name: numb homolog (Drosophila)
  Uniprot ID: P49757
  ENSP ID: ENSP00000450817
MNKLRQSFRRKKDVYVPEASRPHQWQTDEEGVRTGKCSFPVKYLGHVEVDESRGMHICEDAVKRLKATGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 59190 - protein, 640 aa, Homo sapiens; identical to SEQ ID NO: 59186
  Payload ID: 11557
  Gene Symbol: NUMB
  Gene Name: numb homolog (Drosophila)
  Uniprot ID: P49757
  ENSP ID: ENSP00000451117

SEQ ID NO: 59191 - protein, 651 aa, Homo sapiens; identical to SEQ ID NO: 59184
  Payload ID: 11557
  Gene Symbol: NUMB
  Gene Name: numb homolog (Drosophila)
  Uniprot ID: P49757
  ENSP ID: ENSP00000451300

SEQ ID NO: 59192 - protein, 223 aa, Homo sapiens
  Payload ID: 11557
  Gene Symbol: NUMB
  Gene Name: numb homolog (Drosophila)
  ENSP ID: ENSP00000451326
MNKLRQSFRRKKDVYVPEASRPHQWQTDEEGVRTGKCSFPVKTGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPH

SEQ ID NO: 59193 - protein, 258 aa, Homo sapiens
  Payload ID: 11557
  Gene Symbol: NUMB
  Gene Name: numb homolog (Drosophila)
  ENSP ID: ENSP00000451374
MNKLRQSFRRKKDVYVPEASRPHQWQTDEEGVRTGKCSFPVKYLGHVEVDESRGMHICEDAVKRLKAERKFFKGFFGKTGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNP

SEQ ID NO: 59194 - protein, 507 aa, Homo sapiens
  Payload ID: 11557
  Gene Symbol: NUMB
  Gene Name: numb homolog (Drosophila)
  ENSP ID: ENSP00000451513
MAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIEQLARQGSFRGFPALSQKMSPFKRQLSLRINELPSTMQRKTDFPIKNAVPEVEGEAESISSLCSQITNAFSTPEDPFSSAPMTKPVTVVAPQSPTFQANGTDSAFHVLAKPAHTALAPVAMPVRETNPWAHAPDAANKEIAATCSGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 59195 - protein, 80 aa, Homo sapiens
  Payload ID: 11557
  Gene Symbol: NUMB
  Gene Name: numb homolog (Drosophila)
  ENSP ID: ENSP00000451559
MNKLRQSFRRKKDVYVPEASRPHQWQTDEEGVRTGKCSFPVKYLGHVEVDESRGMHICEDAVKRLKATGTLIEPFLTYAV

SEQ ID NO: 59196 - protein, 603 aa, Homo sapiens; identical to SEQ ID NO: 59185
  Payload ID: 11557
  Gene Symbol: NUMB
  Gene Name: numb homolog (Drosophila)
  Uniprot ID: P49757
  ENSP ID: ENSP00000451625

SEQ ID NO: 59197 - protein, 67 aa, Homo sapiens
  Payload ID: 11557
  Gene Symbol: NUMB
  Gene Name: numb homolog (Drosophila)
  ENSP ID: ENSP00000451959
MNKLRQSFRRKKDVYVPEASRPHQWQTDEEGVRTGKCSFPVKYLGHVEVDESRGMHICEDAVKRLKA

SEQ ID NO: 59198 - protein, 494 aa, Homo sapiens
  Payload ID: 11557
  Gene Symbol: NUMB
  Gene Name: numb homolog (Drosophila)
  Uniprot ID: P49757
  ENSP ID: ENSP00000452069
MNKLRQSFRRKKDVYVPEASRPHQWQTDEEGVRTGKCSFPVKYLGHVEVDESRGMHICEDAVKRLKATGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKVPEVEGEAESISSLCSQITNAFSTPEDPFSSAPMTKPVTVVAPQSPTFQGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 59199 - protein, 258 aa, Homo sapiens; identical to SEQ ID NO: 59193
  Payload ID: 11557
  Gene Symbol: NUMB
  Gene Name: numb homolog (Drosophila)
  ENSP ID: ENSP00000452357

SEQ ID NO: 59200 - protein, 592 aa, Homo sapiens
  Payload ID: 11557
  Gene Symbol: NUMB
  Gene Name: numb homolog (Drosophila)
  Uniprot ID: P49757
  ENSP ID: ENSP00000452416
MNKLRQSFRRKKDVYVPEASRPHQWQTDEEGVRTGKCSFPVKYLGHVEVDESRGMHICEDAVKRLKATGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIEQLARQGSFRGFPALSQKMSPFKRQLSLRINELPSTMQRKTDFPIKNAVPEVEGEAESISSLCSQITNAFSTPEDPFSSAPMTKPVTVVAPQSPTFQGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 59201 - protein, 456 aa, Homo sapiens; identical to SEQ ID NO: 59188
  Payload ID: 11557
  Gene Symbol: NUMB
  Gene Name: numb homolog (Drosophila)
  Uniprot ID: P49757
  ENSP ID: ENSP00000452888

SEQ ID NO: 59202 - protein, 505 aa, Homo sapiens
  Payload ID: 11557
  Gene Symbol: NUMB
  Gene Name: numb homolog (Drosophila)
  Uniprot ID: P49757
  ENSP ID: ENSP00000453209
MNKLRQSFRRKKDVYVPEASRPHQWQTDEEGVRTGKCSFPVKYLGHVEVDESRGMHICEDAVKRLKAERKFFKGFFGKTGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKVPEVEGEAESISSLCSQITNAFSTPEDPFSSAPMTKPVTVVAPQSPTFQGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 59203 - protein, 609 aa, Homo sapiens
  Payload ID: 11558
  Gene Symbol: NUMBL
  Gene Name: numb homolog (Drosophila)-like
  Uniprot ID: Q9Y6R0
  ENSP ID: ENSP00000252891
MSRSAAASGGPRRPERHLPPAPCGAPGPPETCRTEPDGAGTMNKLRQSLRRRKPAYVPEASRPHQWQADEDAVRKGTCSFPVRYLGHVEVEESRGMHVCEDAVKKLKAMGRKSVKSVLWVSADGLRVVDDKTKDLLVDQTIEKVSFCAPDRNLDKAFSYICRDGTTRRWICHCFLALKDSGERLSHAVGCAFAACLERKQRREKECGVTAAFDASRTSFAREGSFRLSGGGRPAEREAPDKKKAEAAAAPTVAPGPAQPGHVSPTPATTSPGEKGEAGTPVAAGTTAAAIPRRHAPLEQLVRQGSFRGFPALSQKNSPFKRQLSLRLNELPSTLQRRTDFQVKGTVPEMEPPGAGDSDSINALCTQISSSFASAGAPAPGPPPATTGTSAWGEPSVPPAAAFQPGHKRTPSEAERWLEEVSQVAKAQQQQQQQQQQQQQQQQQQQQAASVAPVPTMPPALQPFPAPVGPFDAAPAQVAVFLPPPHMQPPFVPAYPGLGYPPMPRVPVVGITPSQMVANAFCSAAQLQPQPATLLGKAGAFPPPAIPSAPGSQARPRPNGAPWPPEPAPAPAPELDPFEAQWAALEGKATVEKPSNPFSGDLQKTFEIEL

SEQ ID NO: 59204 - protein, 568 aa, Homo sapiens
  Payload ID: 11558
  Gene Symbol: NUMBL
  Gene Name: numb homolog (Drosophila)-like
  ENSP ID: ENSP00000442759
MNKLRQSLRRRKPAYVPEASRPHQWQADEDAVRKGTCSFPVRYLGHVEVEESRGMHVCEDAVKKLKAMGRKSVKSVLWVSADGLRVVDDKTKDLLVDQTIEKVSFCAPDRNLDKAFSYICRDGTTRRWICHCFLALKDSGERLSHAVGCAFAACLERKQRREKECGVTAAFDASRTSFAREGSFRLSGGGRPAEREAPDKKKAEAAAAPTVAPGPAQPGHVSPTPATTSPGEKGEAGTPVAAGTTAAAIPRRHAPLEQLVRQGSFRGFPALSQKNSPFKRQLSLRLNELPSTLQRRTDFQVKGTVPEMEPPGAGDSDSINALCTQISSSFASAGAPAPGPPPATTGTSAWGEPSVPPAAAFQPGHKRTPSEAERWLEEVSQVAKAQQQQQQQQQQQQQQQQQQQQAASVAPVPTMPPALQPFPAPVGPFDAAPAQVAVFLPPPHMQPPFVPAYPGLGYPPMPRVPVVGITPSQMVANAFCSAAQLQPQPATLLGKAGAFPPPAIPSAPGSQARPRPNGAPWPPEPAPAPAPELDPFEAQWAALEGKATVEKPSNPFSGDLQKTFEIEL

SEQ ID NO: 59205 - protein, 214 aa, Homo sapiens
  Payload ID: 11558
  Gene Symbol: NUMBL
  Gene Name: numb homolog (Drosophila)-like
  ENSP ID: ENSP00000469310
  MOD_RES (1)..(1): Any amino acid
XCEDAVKKLKAMGRKSVKSVLWVSADGLRVVDDKTKDLLVDQTIEKVSFCAPDRNLDKAFSYICRDGTTRRWICHCFLALKDSGERLSHAVGCAFAACLERKQRREKECGVTAAFDASRTSFAREGSFRLSGGGRPAEREAPDKKKEAAAAPTVAPGPAQPGHVSPTPATTSPGEKGEAGTPVAAGTTAAAIPRRHAPLEQLVRQGSFRGFPAL

SEQ ID NO: 59206 - protein, 235 aa, Homo sapiens
  Payload ID: 11558
  Gene Symbol: NUMBL
  Gene Name: numb homolog (Drosophila)-like
  ENSP ID: ENSP00000469736
MNKLRQSLRRRKPAYVPEASRPHQWQADEDAVRKGTCSFPVRYLGHVEVEESRGMHVCEDAVKKLKAMGRKSVKSVLWVSADGLRVVDDKTKDLLVDQTIEKVSFCAPDRNLDKAFSYICRDGTTRRWICHCFLALKDSGERLSHAVGCAFAACLERKQRREKECGVTAAFDASRTSFAREGSFRLSGGGRPAEREAPDKKKAEAAAAPTVAPGPAQPGHVSPTPATTSPGEKGE

SEQ ID NO: 59207 - protein, 115 aa, Homo sapiens
  Payload ID: 11558
  Gene Symbol: NUMBL
  Gene Name: numb homolog (Drosophila)-like
  ENSP ID: ENSP00000470794
MNKLRQSLRRRKPAYVPEASRPHQWQADEDAVRKGTCSFPVRYLGHVEVEESRGMHVCEDAVKKLKAMGRKSVKSVLWVSADGLRVVDDKTKDLLVDQTIEKVSFCAPDRNLDKA

SEQ ID NO: 59208 - protein, 110 aa, Homo sapiens
  Payload ID: 11558
  Gene Symbol: NUMBL
  Gene Name: numb homolog (Drosophila)-like
  ENSP ID: ENSP00000471376
MNKLRQSLRRRKPAYVPEASRPHQWQADEDAVRKGTCSFPVRYLGHVEVEESRGMHVCEDAVKKLKAMGRKSVKSVLWVSADGLRVVDDKTKDLLVDQTIEKVSFCAPDR

SEQ ID NO: 59209 - protein, 568 aa, Homo sapiens; identical to SEQ ID NO: 59204
  Payload ID: 11558
  Gene Symbol: NUMBL
  Gene Name: numb homolog (Drosophila)-like
  ENSP ID: ENSP00000472400

SEQ ID NO: 59210 - protein, 262 aa, Homo sapiens
  Payload ID: 11559
  Gene Symbol: NRM
  Gene Name: nurim (nuclear envelope membrane protein)
  Uniprot ID: Q8IXM6
  ENSP ID: ENSP00000259953
MAPALLLIPAALASFILAFGTGVEFVRFTSLRPLLGGIPESGGPDARQGWLAALQDRSILAPLAWDLGLLLLFVGQHSLMAAERVKAWTSRYFGVLQRSLYVACTALALQLVMRYWEPIPKGPVLWEARAEPWATWVPLLCFVLHVISWLLIFSILLVFDYAELMGLKQVYYHVLGLGEPLALKSPRALRLFSHLRHPVCVELLTVLWVVPTLGTDRLLLAFLLTLYLGLAHGLDQQDLRYLRAQLQRKLHLLSRPQDGEAE

SEQ ID NO: 59211 - protein, 203 aa, Homo sapiens
  Payload ID: 11559
  Gene Symbol: NRM
  Gene Name: nurim (nuclear envelope membrane protein)
  Uniprot ID: Q8IXM6
  ENSP ID: ENSP00000365602
MAPALLLIPAALASFILAFGTGVEFVRFTSLRPLLGGIPESGGPDARQGWLAALQDRSILAPLAWDLGLLLLFVGQHSLMAAERVKAWTSRYFGVLQRSLYVACTALALQVYYHVLGLGEPLALKSPRALRLFSHLRHPVCVELLTVLWVVPTLGTDRLLLAFLLTLYLGLAHGLDQQDLRYLRAQLQRKLHLLSRPQDGEAE

SEQ ID NO: 59212 - protein, 262 aa, Homo sapiens; identical to SEQ ID NO: 59210
  Payload ID: 11559
  Gene Symbol: NRM
  Gene Name: nurim (nuclear envelope membrane protein)
  Uniprot ID: Q8IXM6
  ENSP ID: ENSP00000365603

SEQ ID NO: 59213 - protein, 203 aa, Homo sapiens; identical to SEQ ID NO: 59211
  Payload ID: 11559
  Gene Symbol: NRM
  Gene Name: nurim (nuclear envelope membrane protein)
  Uniprot ID: Q8IXM6
  ENSP ID: ENSP00000373064

SEQ ID NO: 59214 - protein, 262 aa, Homo sapiens; identical to SEQ ID NO: 59210
  Payload ID: 11559
  Gene Symbol: NRM
  Gene Name: nurim (nuclear envelope membrane protein)
  Uniprot ID: Q8IXM6
  ENSP ID: ENSP00000373065

SEQ ID NO: 59215 - protein, 262 aa, Homo sapiens
  Payload ID: 11559
  Gene Symbol: NRM
  Gene Name: nurim (nuclear envelope membrane protein)
  ENSP ID: ENSP00000389894
  MOD_RES (1)..(1): Any amino acid
XESGREATGEGDLSSKLGTQGLEFWRGGRVRTEGAEKGGDRSILNARQGWLAALQDRSILAPLAWDLGLLLLFVGQHSLMAAERVKAWTSRYFGVLQRSLYVACTALALQLVMRYWEPIPKGPVLWEARAEPWATWVPLLCFVLHVISWLLIFSILLVFDYAELMGLKQVYYHVLGLGEPLALKSPRALRLFSHLRHPVCVELLTVLWVVPTLGTDRLLLAFLLTLYLGLAHGLDQQDLRYLRAQLQRKLHLLSRPQDGEAE

SEQ ID NO: 59216 - protein, 203 aa, Homo sapiens; identical to SEQ ID NO: 59211
  Payload ID: 11559
  Gene Symbol: NRM
  Gene Name: nurim (nuclear envelope membrane protein)
  Uniprot ID: Q8IXM6
  ENSP ID: ENSP00000389958

SEQ ID NO: 59217 - protein, 203 aa, Homo sapiens; identical to SEQ ID NO: 59211
  Payload ID: 11559
  Gene Symbol: NRM
  Gene Name: nurim (nuclear envelope membrane protein)
  Uniprot ID: Q8IXM6
  ENSP ID: ENSP00000392502

SEQ ID NO: 59218 - protein, 203 aa, Homo sapiens; identical to SEQ ID NO: 59211
  Payload ID: 11559
  Gene Symbol: NRM
  Gene Name: nurim (nuclear envelope membrane protein)
  Uniprot ID: Q8IXM6
  ENSP ID: ENSP00000394788

SEQ ID NO: 59219 - protein, 262 aa, Homo sapiens; identical to SEQ ID NO: 59215
  Payload ID: 11559
  Gene Symbol: NRM
  Gene Name: nurim (nuclear envelope membrane protein)
  ENSP ID: ENSP00000394862
  MOD_RES (1)..(1): Any amino acid

SEQ ID NO: 59220 - protein, 262 aa, Homo sapiens; identical to SEQ ID NO: 59210
  Payload ID: 11559
  Gene Symbol: NRM
  Gene Name: nurim (nuclear envelope membrane protein)
  Uniprot ID: Q8IXM6
  ENSP ID: ENSP00000397755

SEQ ID NO: 59221 - protein, 262 aa, Homo sapiens; identical to SEQ ID NO: 59215
  Payload ID: 11559
  Gene Symbol: NRM
  Gene Name: nurim (nuclear envelope membrane protein)
  ENSP ID: ENSP00000397892
  MOD_RES (1)..(1): Any amino acid

SEQ ID NO: 59222 - protein, 262 aa, Homo sapiens; identical to SEQ ID NO: 59210
  Payload ID: 11559
  Gene Symbol: NRM
  Gene Name: nurim (nuclear envelope membrane protein)
  Uniprot ID: Q8IXM6
  ENSP ID: ENSP00000398752

SEQ ID NO: 59223 - protein, 203 aa, Homo sapiens; identical to SEQ ID NO: 59211
  Payload ID: 11559
  Gene Symbol: NRM
  Gene Name: nurim (nuclear envelope membrane protein)
  Uniprot ID: Q8IXM6
  ENSP ID: ENSP00000399560

SEQ ID NO: 59224 - protein, 262 aa, Homo sapiens; identical to SEQ ID NO: 59210
  Payload ID: 11559
  Gene Symbol: NRM
  Gene Name: nurim (nuclear envelope membrane protein)
  Uniprot ID: Q8IXM6
  ENSP ID: ENSP00000405789

SEQ ID NO: 59225 - protein, 262 aa, Homo sapiens; identical to SEQ ID NO: 59215
  Payload ID: 11559
  Gene Symbol: NRM
  Gene Name: nurim (nuclear envelope membrane protein)
  ENSP ID: ENSP00000407049
  MOD_RES (1)..(1): Any amino acid

SEQ ID NO: 59226 - protein, 203 aa, Homo sapiens; identical to SEQ ID NO: 59211
  Payload ID: 11559
  Gene Symbol: NRM
  Gene Name: nurim (nuclear envelope membrane protein)
  Uniprot ID: Q8IXM6
  ENSP ID: ENSP00000407111

SEQ ID NO: 59227 - protein, 262 aa, Homo sapiens; identical to SEQ ID NO: 59215
  Payload ID: 11559
  Gene Symbol: NRM
  Gene Name: nurim (nuclear envelope membrane protein)
  ENSP ID: ENSP00000407779
  MOD_RES (1)..(1): Any amino acid

SEQ ID NO: 59228 - protein, 262 aa, Homo sapiens; identical to SEQ ID NO: 59215
  Payload ID: 11559
  Gene Symbol: NRM
  Gene Name: nurim (nuclear envelope membrane protein)
  ENSP ID: ENSP00000408118
  MOD_RES (1)..(1): Any amino acid

SEQ ID NO: 59229 - protein, 262 aa, Homo sapiens; identical to SEQ ID NO: 59210
  Payload ID: 11559
  Gene Symbol: NRM
  Gene Name: nurim (nuclear envelope membrane protein)
  Uniprot ID: Q8IXM6
  ENSP ID: ENSP00000409285

SEQ ID NO: 59230 - protein, 262 aa, Homo sapiens; identical to SEQ ID NO: 59215
  Payload ID: 11559
  Gene Symbol: NRM
  Gene Name: nurim (nuclear envelope membrane protein)
  ENSP ID: ENSP00000412991
  MOD_RES (1)..(1): Any amino acid

SEQ ID NO: 59231 - protein, 262 aa, Homo sapiens; identical to SEQ ID NO: 59210
  Payload ID: 11559
  Gene Symbol: NRM
  Gene Name: nurim (nuclear envelope membrane protein)
  Uniprot ID: Q8IXM6
  ENSP ID: ENSP00000414927

SEQ ID NO: 59232 - protein, 262 aa, Homo sapiens; identical to SEQ ID NO: 59210
  Payload ID: 11559
  Gene Symbol: NRM
  Gene Name: nurim (nuclear envelope membrane protein)
  Uniprot ID: Q8IXM6
  ENSP ID: ENSP00000478812

SEQ ID NO: 59233 - protein, 262 aa, Homo sapiens; identical to SEQ ID NO: 59210
  Payload ID: 11559
  Gene Symbol: NRM
  Gene Name: nurim (nuclear envelope membrane protein)
  Uniprot ID: Q8IXM6
  ENSP ID: ENSP00000481406

SEQ ID NO: 59234 - protein, 262 aa, Homo sapiens; identical to SEQ ID NO: 59210
  Payload ID: 11559
  Gene Symbol: NRM
  Gene Name: nurim (nuclear envelope membrane protein)
  Uniprot ID: Q8IXM6
  ENSP ID: ENSP00000481407

SEQ ID NO: 59235 - protein, 262 aa, Homo sapiens; identical to SEQ ID NO: 59210
  Payload ID: 11559
  Gene Symbol: NRM
  Gene Name: nurim (nuclear envelope membrane protein)
  Uniprot ID: Q8IXM6
  ENSP ID: ENSP00000482593

SEQ ID NO: 59236 - protein, 262 aa, Homo sapiens; identical to SEQ ID NO: 59210
  Payload ID: 11559
  Gene Symbol: NRM
  Gene Name: nurim (nuclear envelope membrane protein)
  Uniprot ID: Q8IXM6
  ENSP ID: ENSP00000482740

SEQ ID NO: 59237 - protein, 262 aa, Homo sapiens; identical to SEQ ID NO: 59210
  Payload ID: 11559
  Gene Symbol: NRM
  Gene Name: nurim (nuclear envelope membrane protein)
  Uniprot ID: Q8IXM6
  ENSP ID: ENSP00000483875

SEQ ID NO: 59238 - protein, 293 aa, Homo sapiens
  Payload ID: 11560
  Gene Symbol: NUS1
  Gene Name: NUS1 dehydrodolichyl diphosphate synthase subunit
  Uniprot ID: Q96E22
  ENSP ID: ENSP00000357480
MTGLYELVWRVLHALLCLHRTLTSWLRVRFGTWNWIWRRCCRAASAAVLAPLGFTLRKPPAVGRNRRHHRHPRGGSCLAAAHHRMRWRADGRSLEKLPVHMGLVITEVEQEPSFSDIASLVVWCMAVGISYISVYDHQGIFKRNNSRLMDEILKQQQELLGLDCSKYSPEFANSNDKDDQVLNCHLAVKVLSPEDGKADIVRAAQDFCQLVAQKQKRPTDLDVDTLASLLSSNGCPDPDLVLKFGPVDSTLGFLPWHIRLTEIVSLPSHLNISYEDFFSALRQYAACEQRLGK

SEQ ID NO: 59239 - protein, 629 aa, Homo sapiens
  Payload ID: 11561
  Gene Symbol: NUTM2A
  Gene Name: NUT family member 2A
  Uniprot ID: Q8IVF1
  ENSP ID: ENSP00000371107
MEVKGPSGRSFCCESEGQFKSCLKRHTPSLLLPSSWKGNSGSCLMAKALHRMSPTPNSCPLPLPLCRMSGVLCSRNLFTFKFSLFQLDSGASGEPGHSLGLTLGFSHCGNCQTAVVSAQPEGMASNGAYPALGPGVTANPGTSLSVFTALPFTTPAPGPAHGPLLVTAGAPPGGPLVLSTLPSTPLVTEQDGCGPSGAGASNVFVQMRTEVGPVKAAQAQTLVLTQAPLVWQAPGALCGGVVCPPPLLLAAAPVVPVMAAQVVGGTQACEGGWSQGLPLPPPPPPAAQLPPIVSQGNAGPWPQGAHGEGSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAPTACLPPPRPQRPVTKARRPPPRPHRRAETKARLPPPRPQRPAETKVPEEIPPEVVQEYVDIMEELLGPSLGATGEPEKQREEGEVKQPQEEDWTPPDPGLLSYTDKLCSQKDFVTKVEAVIHPQFLEELLSPDPQMDFLALSQELEQEEGLTLAQGAPSDAPGTDRC

SEQ ID NO: 59240 - protein, 878 aa, Homo sapiens
  Payload ID: 11561
  Gene Symbol: NUTM2A
  Gene Name: NUT family member 2A
  Uniprot ID: Q8IVF1
  ENSP ID: ENSP00000371126
MEVKGPSGRSFCCESEGQFKSCLKRHTPSLLLPSSWKGNSGSCLMAKALHRMSPTPNSCPLPLPLCRMSGVLCSRNLFTFKFSLFQLDSGASGEPGHSLGLTLGFSHCGNCQTAVVSAQPEGMASNGAYPALGPGVTANPGTSLSVFTALPFTTPAPGPAHGPLLVTAGAPPGGPLVLSTLPSTPLVTEQDGCGPSGAGASNVFVQMRTEVGPVKAAQAQTLVLTQAPLVWQAPGALCGGVVCPPPLLLAAAPVVPVMAAQVVGGTQACEGGWSQGLPLPPPPPPAAQLPPIVSQGNAGPWPQGAHGEGSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAPTACLPPPRPQRPVTKARRPPPRPHRRAETKARLPPPRPQRPAETKVPEEIPPEVVQEYVDIMEELLGPSLGATGEPEKQREEGEVKQPQEEDWTPPDPGLLSYTDKLCSQKDFVTKVEAVIHPQFLEELLSPDPQMDFLALSQELEQEEGLTLAQLVEKRLLPLKEKQHARAAPSRGTARLDSSSSKFAAGQGAERDVPVPQQGVGMETCPPQTTARDSQGRGRAHTGMARSKDSVVLLGCQDSPGLRAARPTSPPQDHRPTCPGVGTKDALDLPGGSPVRESHGLAQGSSEEEELPSLAFLLGSQHKLLPWWLPQSPVPASGLLSPEKWGPQGTHQFPSAERRGLNLAPSPANKAKKRPLFGSLSPAEKTPHPGPGLRVSGEQSLTWGLGGPSQSQKRKGDPLVSRKEKKQRCSQ

SEQ ID NO: 59241 - protein, 656 aa, Homo sapiens
  Payload ID: 11562
  Gene Symbol: NUTM2B
  Gene Name: NUT family member 2B
  ENSP ID: ENSP00000344811
  MOD_RES (1)..(1): Any amino acid
XLTQAPLVWQAPGALCGGVVCPPPLLLAAAPVVPVMAAQVVGGTQACEGGWSQGLPLPPPPPPAAQLPPIVSQGNAGPWPQGAHGESSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAPTACLPPPRPQRPVTKARRPPPRPHRRAETKARLPPPRPQRPAETKVPEEIPPEVVQEYVDIMEELLGPSLGATGEPEKQREEGKVKQPQEEDWTPPDPGLLSYIDKLCSQKDFVTKVEAVIHPQFLEELLSPDPQMDFLALSQDLEQEEGLTLAQLVEKRLPPLKEKQHARAAPSRGTARLDSSSSKFAAGQGAERDVPDPQQGVGMETCPPQMTARDSQGRGRAHTGMARSEDSVVLLGCQDSPGLRAAWPTSPPQDHRPTCPGVGTKDALDLPGGSPVRESHGLAQGSSEEEELPSLAFLLGSQHKLLPWWLPQSPVPASGLLSPEKWGPQGTHQSPSAERRGLNLAPSPANKAKKRPLFGSLSPAEKTPYPGPGLRVSGEQSLTWGLGGPSQSQKRKGDPLVSRKEKKQHCSQ

SEQ ID NO: 59242 - protein, 562 aa, Homo sapiens
  Payload ID: 11562
  Gene Symbol: NUTM2B
  Gene Name: NUT family member 2B
  ENSP ID: ENSP00000361396
MSGVLCSRNLFTFKFSLFQLDSGASGEPGHSLGLTLGFSYCGNCQTAVVSAQPEGMASNGAYPVLGPGVTANPGTSLSVFTALPFTTPAPGPAHGPLLVTAGAPPGGPLVLSTFPSTPLVTEQDGCGPSGAGASNVFVQMRTEVGPVKAAQAQTLVLTQAPLVWQAPGALCGGVVCPPPLLLAAAPVVPVMAAQVVGGTQACEGGWSQGLPLPPPPPPAAQLPPIVSQGNAGPWPQGAHGESSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAPTACLPPPRPQRPVTKARRPPPRPHRRAETKARLPPPRPQRPAETKVPEEIPPEVVQEYVDIMEELLGPSLGATGEPEKQREEGKVKQPQEEDWTPPDPGLLSYIDKLCSQKDFVTKVEAVIHPQFLEELLSPDPQMDFLALSQDLEQEEGLTLAQGAPSDAPGTDRC

SEQ ID NO: 59243 - protein, 878 aa, Homo sapiens
  Payload ID: 11562
  Gene Symbol: NUTM2B
  Gene Name: NUT family member 2B
  Uniprot ID: A6NNL0
  ENSP ID: ENSP00000394623
MEVKGPSGRSFCCESEGQFKSCLKRHTPSLLLPSSWKGNSGSCLMAEALHRTSPTPNSCPLPLPLCRMSGVLCSRNLFTFKFSLFQLDSGASGEPGHSLGLTLGFSYCGNCQTAVVSAQPEGMASNGAYPVLGPGVTANPGTSLSVFTALPFTTPAPGPAHGPLLVTAGAPPGGPLVLSTFPSTPLVTEQDGCGPSGAGASNVFVQMRTEVGPVKAAQAQTLVLTQAPLVWQAPGALCGGVVCPPPLLLAAAPVVPVMAAQVVGGTQACEGGWSQGLPLPPPPPPAAQLPPIVSQGNAGPWPQGAHGESSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAPTACLPPPRPQRPVTKARRPPPRPHRRAETKARLPPPRPQRPAETKVPEEIPPEVVQEYVDIMEELLGPSLGATGEPEKQREEGKVKQPQEEDWTPPDPGLLSYIDKLCSQKDFVTKVEAVIHPQFLEELLSPDPQMDFLALSQDLEQEEGLTLAQLVEKRLPPLKEKQHARAAPSRGTARLDSSSSKFAAGQGAERDVPDPQQGVGMETCPPQMTARDSQGRGRAHTGMARSEDSVVLLGCQDSPGLRAAWPTSPPQDHRPTCPGVGTKDALDLPGGSPVRESHGLAQGSSEEEELPSLAFLLGSQHKLLPWWLPQSPVPASGLLSPEKWGPQGTHQSPSAERRGLNLAPSPANKAKKRPLFGSLSPAEKTPYPGPGLRVSGEQSLTWGLGGPSQSQKRKGDPLVSRKEKKQHCSQ

SEQ ID NO: 59244 - protein, 806 aa, Homo sapiens
  Payload ID: 11563
  Gene Symbol: NUTM2D
  Gene Name: NUT family member 2D
  Uniprot ID: Q5VT03
  ENSP ID: ENSP00000371116
MFQEPVYFQIFLFQLDSGASGEPGHSLGLTLGFSHCGNCQTAVVSAQPEGMASNGAYPALGPGVTANPGTSLSVFTALPFTTPAPGPAHGPLLVTAGAPPGGPLVLSNFPSTPLVTEQDGCGPSGAGASNVFVQMRTEVGPVKAAQAQTLVLTQTPLVWQAPGALCGGVVCPPPLLLAAAPVVPVMAAQVVGGTQACEGGWSQGLPLPPPPPPAAQLPPIVSQGNAGPWPQGAHGEGSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAPTACLPPPRPQRPVTKARRPPPRPHRRAETKARLPPPRPQRPAETKVPEEIPPEVVQEYVDIMEELLGPSLGATGEPEKQREEGEVKQPQEEDWTPPDPGLLSYTDKLCSQKDFVTKVEAVIHPQFLEELLSPDPQMDFLALSQELEQEEGLTLAQLVEKRLLPLKEKQHARAAPSRGTARLDSSSSKFAAGQGAERDVPDPQQGVGMETCPPQTTARDSQGRGRAHTGMARSKDSVVLLGCQDSPGLRAARPTSPPQDHRPTCPGVGTKDALDLPGGSPVRESHGLAQGSSEEEELPSLAFLLGSQHKLLPWWLPQSPVPASGLLSPEKWGPQGTHQSPSAERRGLNLAPSPANKAKKRPLFGSLSPAEKTPHPGPGLRVSGEQSLTWGLGGPSQSQKRKGDPLVSRKEKKQRCSQ

SEQ ID NO: 59245 - protein, 557 aa, Homo sapiens
  Payload ID: 11563
  Gene Symbol: NUTM2D
  Gene Name: NUT family member 2D
  ENSP ID: ENSP00000396080
MFQEPVYFQIFLFQLDSGASGEPGHSLGLTLGFSHCGNCQTAVVSAQPEGMASNGAYPALGPGVTANPGTSLSVFTALPFTTPAPGPAHGPLLVTAGAPPGGPLVLSNFPSTPLVTEQDGCGPSGAGASNVFVQMRTEVGPVKAAQAQTLVLTQTPLVWQAPGALCGGVVCPPPLLLAAAPVVPVMAAQVVGGTQACEGGWSQGLPLPPPPPPAAQLPPIVSQGNAGPWPQGAHGEGSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAPTACLPPPRPQRPVTKARRPPPRPHRRAETKARLPPPRPQRPAETKVPEEIPPEVVQEYVDIMEELLGPSLGATGEPEKQREEGEVKQPQEEDWTPPDPGLLSYTDKLCSQKDFVTKVEAVIHPQFLEELLSPDPQMDFLALSQELEQEEGLTLAQGAPSDAPGTDRC

SEQ ID NO: 59246 - protein, 152 aa, Homo sapiens
  Payload ID: 11563
  Gene Symbol: NUTM2D
  Gene Name: NUT family member 2D
  ENSP ID: ENSP00000475197
  MOD_RES (1)..(1): Any amino acid
XVPEEIPPEVVQEYVDIMEELLGPSLGATGEPEKQREEGEVKQPQEEDWTPPDPGLLSYTDKLCSQKDFVTKVEAVIHPQFLEELLSPDPQMDFLALSQELEQEEGLTLAQVPQGQEGPGTQGPPDCLIPPAGDARLLGEPLWSGKMQVQRE

SEQ ID NO: 59247 - protein, 877 aa, Homo sapiens
  Payload ID: 11563
  Gene Symbol: NUTM2D
  Gene Name: NUT family member 2D
  ENSP ID: ENSP00000484887
MEVKGPSGRSFCCESEGQFKSCLKRHTPSLLLPSSWKGNSGSCLMAEALHRMSPTPNSCPLPLPLCRMSGVLCSRNLFTFKFSFQLDSGASGEPGHSLGLTLGFSHCGNCQTAVVSAQPEGMASNGAYPALGPGVTANPGTSLSVFTALPFTTPAPGPAHGPLLVTAGAPPGGPLVLSNFPSTPLVTEQDGCGPSGAGASNVFVQMRTEVGPVKAAQAQTLVLTQTPLVWQAPGALCGGVVCPPPLLLAAAPVVPVMAAQVVGGTQACEGGWSQGLPLPPPPPPAAQLPPIVSQGNAGPWPQGAHGEGSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAPTACLPPPRPQRPVTKARRPPPRPHRRAETKARLPPPRPQRPAETKVPEEIPPEVVQEYVDIMEELLGPSLGATGEPEKQREEGEVKQPQEEDWTPPDPGLLSYTDKLCSQKDFVTKVEAVIHPQFLEELLSPDPQMDFLALSQELEQEEGLTLAQLVEKRLLPLKEKQHARAAPSRGTARLDSSSSKFAAGQGAERDVPDPQQGVGMETCPPQTTARDSQGRGRAHTGMARSKDSVVLLGCQDSPGLRAARPTSPPQDHRPTCPGVGTKDALDLPGGSPVRESHGLAQGSSEEEELPSLAFLLGSQHKLLPWWLPQSPVPASGLLSPEKWGPQGTHQSPSAERRGLNLAPSPANKAKKRPLFGSLSPAEKTPHPGPGLRVSGEQSLTWGLGGPSQSQKRKGDPLVSRKEKKQRCSQ

SEQ ID NO: 59248 - protein, 878 aa, Homo sapiens
  Payload ID: 11564
  Gene Symbol: NUTM2E
  Gene Name: NUT family member 2E
  Uniprot ID: B1AL46
  ENSP ID: ENSP00000407521
MEVKGPSGRSFCCESEGQFKSCLKRHTPSLLLPSSWKGNSGSCLMAEALHRTSPTPNSCPLPLPLCRMSGVLCSRNLFTFKFSLFQLDSGASGEPGHSLGLTLGFSYCGNCQTAVVSAQPEGMASNGAYPVLGPGVTANPGTSLSVFTALPFTTPAPGPAHGPLLVTAGAPPGGPLVLSTFPSTPLVTEQDGCSPSGAGASNVFVQMRTEVGPVKAAQAQTLVLTQAPLVWQAPGALCGGVVCPPPLLLAAAPVVPVMAAQVVGGTQACEGGWSQGLPLPPPPPPAAQLPPIVSQGNAGPWPQGAHGESSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAQTACLPPPRPQRPVTKARRPPPQPHRRAETKARLPPPRPQRPAETKVPEEIPPEVVQEYVDIMEELLGPSLGATGEPEKQREEGKVKQPQEEDWTPPDPGLLSYIDKLCSQKDFVTKVEAVIHPQFLEELLSPDPQMDFLALSQDLEQEEGLTLAQLVEKRLPPLKEKQHSRAAPSRGTARLDSSSSKFAAGQGAERDVPDPQEGVGMETCPPQTTARDSQGRGRAHTGMARSEDSVVLLGCQDSPGLRAARPTSPPQDHRPTCPGVGTKDALDLPGGSPVRESHGLAQGSSEEEELPSLAFLLGSQHKLLPWWLPQSPVPASGLLSPEKWGPQGTHQSPSAERRGLNLAPSPANKAKKQPLFGSLSPAEKTPHRGPGLRVSGEQSLTWGLGGPSQSQKRKGDPLVSRKEKKQHCSQ

SEQ ID NO: 59249 - protein, 658 aa, Homo sapiens
  Payload ID: 11564
  Gene Symbol: NUTM2E
  Gene Name: NUT family member 2E
  ENSP ID: ENSP00000473558
MEVKGPSGRSFCCESEGQFKSCLKRHTPSLLLPSSWKGNSGSCLMAEALHRTSPTPNSCPLPLPLCRMSGVLCSRNLFTFKFSLFQLDSGASGEPGHSLGLTLGFSYCGNCQTAVVSAQPEGMASNGAYPVLGPGVTANPGTSLSVFTALPFTTPAPGPAHGPLLVTAGAPPGGPLVLSTFPSTPLVTEQDGCSPSGAGASNVFVQMRTEVGPVKAAQAQTLVLTQAPLVWQAPGALCGGVVCPPPLLLAAAPVVPVMAAQVVGGTQACEGGWSQGLPLPPPPPPAAQLPPIVSQGNAGPWPQGAHGESSLASSQAKAPPDDSCNPRSVYENFRLWQHYKPLARRHLPQSPDTEALSCFLIPVLRSLARRKPTMTLEEGLWRAMREWQHTSNFDRMIFYEMAEKFLEFEAEEEMQIQKSQWMKGPQCLPPPATPRLEPRGPPAPEVVKQPVYLPSKAGPKAQTACLPPPRPQRPVTKARRPPPQPHRRAETKARLPPPRPQRPAETKVPEEIPPEVVQEYVDIMEELLGPSLGATGEPEKQREEGKVKQPQEEDWTPPDPGLLSYIDKLCSQKDFVTKVEAVIHPQFLEELLSPDPQMDFLALSQDLEQEEGLTLAQVPQGQEGPGTQGPPDCLIPPAGDARLLGEPLWSGKMQVQRE

SEQ ID NO: 59250 - protein, 756 aa, Homo sapiens
  Payload ID: 11565
  Gene Symbol: NUTM2F
  Gene Name: NUT family member 2F
  Uniprot ID: A1L443
  ENSP ID: ENSP00000253262
MASNGAYPVLGPGVTVNPGTSLSVFTALPFATPAPGPAHRPPLVTAVVPPAGPLVLSAFPSTPLVAGQDGRGPSGAGASNVFVQMRTEVGPVKPPQAQTLILTQAPLVWQAPGTLCGGVMCPPPLLLAAAPGVPVTSAQVVGGTQACEGGWSHGLPLPPPPPAAQVAPIVSPGNARPWPQGAHGEGSLAPSQAKARPDDSCKPKSVYENFRLWQHYKPLARRHLPQSPDTEALSCFLIPVLRSLARRKPTMTLEEGLWQAMREWQHTSNFDRMIFYEMAEKFLEFEAEEEMQIQKSQWMKGPQSLPPPAPPRLEPRGPPAPEVVKQPVYLPSKDGPKAPTACLPPPRPQRPAETKAHLPPPRPQRPAETNAHLPPPRPQRPAETKVPEEIPPEVVQEYVDIMEELLGSHPGDTGEPEGQREKGKVEQPQEEDGITSDPGLLSYIDKLCSQEDFVTKVEAVIHPRFLEELLSPDPQMDFLALSQELEQEEGLTLAQLVEKRLLSLKEKGCGRAAPRHGTARLDSSPSEFAAGQEAAREVPDPQQRVSVETSPPQTAAQDPQGQGRVRTGMARSEDPAVLLGCQDSPRLKAVRPTSPPQDHRPTCPGLGTKDALGLPGESPVKESHGLAKGSSEETELPGMVYVVGSHHRLRPWRLSQSPVPSSGLLSPGGRGPQGALQSPSAQKRGLSPSPSPASKSKKRPLFGSPSPAEKTPHPGPGLRVSGEQSLAWGLGGPSQSQKRKGDPLASRRKKKRHCSQ

SEQ ID NO: 59251 - protein, 741 aa, Homo sapiens
  Payload ID: 11565
  Gene Symbol: NUTM2F
  Gene Name: NUT family member 2F
  ENSP ID: ENSP00000343865
MASNGAYPVLGPGVTVNPGTSLSVFTALPFATPAPGPAHRPPLVTAVVPPAGPLVLSAFPSTPLVAGQDGRGPSGAGASNVFVQMRTEVGPVKPPQAQTLILTQAPLVWQAPGTLCGGVMCPPPLLLAAAPGVPVTSAQVVGGTQACEGGWSHGLPLPPPPPAAQVAPIVSPGNARPWPQGAHGEGSLAPSQAKARPDDSCKPKSVYENFRLWQHYKPLARRHLPQSPDTEALSCFLIPVLRSLARRKPTMTLEEGLWQAMREWQHTSNFDRMIFYEMAEKFLEFEAEEEMQIQKSQWMKGPQSLPPPAPPRLEPRGPPAPEVVKQPVYLPSKDGPKAPTACLPPPRPQRPAETKAHLPPPRPQRPAETKVPEEIPPEVVQEYVDIMEELLGSHPGDTGEPEGQREKGKVEQPQEEDGITSDPGLLSYIDKLCSQEDFVTKVEAVIHPRFLEELLSPDPQMDFLALSQELEQEEGLTLAQLVEKRLLSLKEKGCGRAAPRHGTARLDSSPSEFAAGQEAAREVPDPQQRVSVETSPPQTAAQDPQGQGRVRTGMARSEDPAVLLGCQDSPRLKAVRPTSPPQDHRPTCPGLGTKDALGLPGESPVKESHGLAKGSSEETELPGMVYVVGSHHRLRPWRLSQSPVPSSGLLSPGGRGPQGALQSPSAQKRGLSPSPSPASKSKKRPLFGSPSPAEKTPHPGPGLRVSGEQSLAWGLGGPSQSQKRKGDPLASRRKKKRHCSQ

SEQ ID NO: 59252 - protein, 492 aa, Homo sapiens
  Payload ID: 11566
  Gene Symbol: NUTM2G
  Gene Name: NUT family member 2G
  Uniprot ID: Q5VZR2
  ENSP ID: ENSP00000346670
MASNGAYPVLGPGVTVNPGTSLSVFTALPFATPSPGPTHRPPLVTAVVPPAGPLVLSAFPSTPLVAGQDGRGPSGAGASNVFVQMRTEVGPVKPPQAQTLILTQAPLVWQAPGTLCGGVMCPPPLLLAAAPGVPVTSAQVVGGTQACEGGWSHGLPLPPPPPAAQVAPIVSPGNAGPWPQGAHGEGSLAPSQAKARPDDSCKPKSVYENFRLWQHYKPLARRHLPQSPDTEALSCFLIPVLRSLARRKPTMTLEEGLWRAMREWQHTSNFDRMIFYEMAAKFLEFEAEEEMQIQKSQWMKGPQSLPPPAPPRLEPRGPPAPEVVKQPVYLPSKDGPKAPTACLPPPRPQRPAETKAHLPPPRPPRPAETKVPEEIPPEVVQEYVDIMEELLGSHPGDTGEPEGQREKGKVEQPQEEDGMTSDPGLLSYIDKLCSQEDFVTKVEAVIHPRFLEELLSPDPQMDFLALSQELEQEEGLTLAQGAPSDALGTDRC

SEQ ID NO: 59253 - protein, 741 aa, Homo sapiens
  Payload ID: 11566
  Gene Symbol: NUTM2G
  Gene Name: NUT family member 2G
  Uniprot ID: Q5VZR2
  ENSP ID: ENSP00000361397
MASNGAYPVLGPGVTVNPGTSLSVFTALPFATPSPGPTHRPPLVTAVVPPAGPLVLSAFPSTPLVAGQDGRGPSGAGASNVFVQMRTEVGPVKPPQAQTLILTQAPLVWQAPGTLCGGVMCPPPLLLAAAPGVPVTSAQVVGGTQACEGGWSHGLPLPPPPPAAQVAPIVSPGNAGPWPQGAHGEGSLAPSQAKARPDDSCKPKSVYENFRLWQHYKPLARRHLPQSPDTEALSCFLIPVLRSLARRKPTMTLEEGLWRAMREWQHTSNFDRMIFYEMAAKFLEFEAEEEMQIQKSQWMKGPQSLPPPAPPRLEPRGPPAPEVVKQPVYLPSKDGPKAPTACLPPPRPQRPAETKAHLPPPRPPRPAETKVPEEIPPEVVQEYVDIMEELLGSHPGDTGEPEGQREKGKVEQPQEEDGMTSDPGLLSYIDKLCSQEDFVTKVEAVIHPRFLEELLSPDPQMDFLALSQELEQEEGLTLAQLVEKRLLSLKEKGCGRAAPRHGTARLDSSPSEFAAGQEAAREVPDPQQRVSVETSPPQTAAQDPQGQGRVRTGMARSEDPAVLLGCQDSPRLKAVRPTSPPQDHRPTCPGLGTKDALGLPGESPVKESHGLAKGSSEETELPGMVYVVGSHHRLRPWRLSQSPVPSSGLLSPGGRGPQGALQSPSAQKRGLSPSPSPASKSKKRPLFGSPSPAEKTPHPGPGLRVSGEQSLAWGLGGPSQSQKRKGDPLASRRKKKRHCSQ

SEQ ID NO: 59254 - protein, 1132 aa, Homo sapiens
  Payload ID: 11567
  Gene Symbol: NUTM1
  Gene Name: NUT midline carcinoma, family member 1
  Uniprot ID: Q86Y26
  ENSP ID: ENSP00000329448
MASDGASALPGPDMSMKPSAAPSPSPALPFLPPTSDPPDHPPREPPPQPIMPSVFSPDNPLMLSAFPSSLLVTGDGGPCLSGAGAGKVIVKVKTEGGSAEPSQTQNFILTQTALNSTAPGTPCGGLEGPAPPFVTASNVKTILPSKAVGVSQEGPPGLPPQPPPPVAQLVPIVPLEKAWPGPHGTTGEGGPVATLSKPSLGDRSKISKDVYENFRQWQRYKALARRHLSQSPDTEALSCFLIPVLRSLARLKPTMTLEEGLPLAVQEWEHTSNFDRMIFYEMAERFMEFEAEEMQIQNTQLMNGSQGLSPATPLKLDPLGPLASEVCQQPVYIPKKAASKTRAPRRRQRKAQRPPAPEAPKEIPPEAVKEYVDIMEWLVGTHLATGESDGKQEEEGQQQEEEGMYPDPGLLSYINELCSQKVFVSKVEAVIHPQFLADLLSPEKQRDPLALIEELEQEEGLTLAQLVQKRLMALEEEEDAEAPPSFSGAQLDSSPSGSVEDEDGDGRLRPSPGLQGAGGAACLGKVSSSGKRAREVHGGQEQALDSPRGMHRDGNTLPSPSSWDLQPELAAPQGTPGPLGVERRGSGKVINQVSLHQDGHLGGAGPPGHCLVADRTSEALPLCWQGGFQPESTPSLDAGLAELAPLQGQGLEKQVLGLQKGQQTGGRGVLPQGKEPLAVPWEGSSGAMWGDDRGTPMAQSYDQNPSPRAAGERDDVCLSPGVWLSSEMDAVGLELPVQIEEVIESFQVEKCVTEYQEGCQGLGSRGNISLGPGETLVPGDTESSVIPCGGTVAAAALEKRNYCSLPGPLRANSPPLRSKENQEQSCETVGHPSDLWAEGCFPLLESGDSTLGSSKETLPPTCQGNLLIMGTEDASSLPEASQEAGSRGNSFSPLLETIEPVNILDVKDDCGLQLRVSEDTCPLNVHSYDPQGEGRVDPDLSKPKNLAPLQESQESYTTGTPKATSSHQGLGSTLPRRGTRNAIVPRETSVSKTHRSADRAKGKEKKKKEAEEEDEELSNFAYLLASKLSLSPREHPLSPHHASGGQGSQRASHLLPAGAKGPSKLPYPVAKSGKRALAGGPAPTEKTPHSGAQLGVPREKPLALGVVRPSQPRKRRCDSFVTGRRKKRRRSQ

SEQ ID NO: 59255 - protein, 1150 aa, Homo sapiens
  Payload ID: 11567
  Gene Symbol: NUTM1
  Gene Name: NUT midline carcinoma, family member 1
  Uniprot ID: Q86Y26
  ENSP ID: ENSP00000407031
MFQRSNQDLKLGPYRKFSALSYGASALPGPDMSMKPSAAPSPSPALPFLPPTSDPPDHPPREPPPQPIMPSVFSPDNPLMLSAFPSSLLVTGDGGPCLSGAGAGKVIVKVKTEGGSAEPSQTQNFILTQTALNSTAPGTPCGGLEGPAPPFVTASNVKTILPSKAVGVSQEGPPGLPPQPPPPVAQLVPIVPLEKAWPGPHGTTGEGGPVATLSKPSLGDRSKISKDVYENFRQWQRYKALARRHLSQSPDTEALSCFLIPVLRSLARLKPTMTLEEGLPLAVQEWEHTSNFDRMIFYEMAERFMEFEAEEMQIQNTQLMNGSQGLSPATPLKLDPLGPLASEVCQQPVYIPKKAASKTRAPRRRQRKAQRPPAPEAPKEIPPEAVKEYVDIMEWLVGTHLATGESDGKQEEEGQQQEEEGMYPDPGLLSYINELCSQKVFVSKVEAVIHPQFLADLLSPEKQRDPLALIEELEQEEGLTLAQLVQKRLMALEEEEDAEAPPSFSGAQLDSSPSGSVEDEDGDGRLRPSPGLQGAGGAACLGKVSSSGKRAREVHGGQEQALDSPRGMHRDGNTLPSPSSWDLQPELAAPQGTPGPLGVERRGSGKVINQVSLHQDGHLGGAGPPGHCLVADRTSEALPLCWQGGFQPESTPSLDAGLAELAPLQGQGLEKQVLGLQKGQQTGGRGVLPQGKEPLAVPWEGSSGAMWGDDRGTPMAQSYDQNPSPRAAGERDDVCLSPGVWLSSEMDAVGLELPVQIEEVIESFQVEKCVTEYQEGCQGLGSRGNISLGPGETLVPGDTESSVIPCGGTVAAAALEKRNYCSLPGPLRANSPPLRSKENQEQSCETVGHPSDLWAEGCFPLLESGDSTLGSSKETLPPTCQGNLLIMGTEDASSLPEASQEAGSRGNSFSPLLETIEPVNILDVKDDCGLQLRVSEDTCPLNVHSYDPQGEGRVDPDLSKPKNLAPLQESQESYTTGTPKATSSHQGLGSTLPRRGTRNAIVPRETSVSKTHRSADRAKGKEKKKKEAEEEDEELSNFAYLLASKLSLSPREHPLSPHHASGGQGSQRASHLLPAGAKGPSKLPYPVAKSGKRALAGGPAPTEKTPHSGAQLGVPREKPLALGVVRPSQPRKRRCDSFVTGRRKKRRRSQ

SEQ ID NO: 59256 - protein, 1160 aa, Homo sapiens
  Payload ID: 11567
  Gene Symbol: NUTM1
  Gene Name: NUT midline carcinoma, family member 1
  Uniprot ID: Q86Y26
  ENSP ID: ENSP00000444896
MVVTLGPGPDCLILEASRQPQLVPKPERMASDGASALPGPDMSMKPSAAPSPSPALPFLPPTSDPPDHPPREPPPQPIMPSVFSPDNPLMLSAFPSSLLVTGDGGPCLSGAGAGKVIVKVKTEGGSAEPSQTQNFILTQTALNSTAPGTPCGGLEGPAPPFVTASNVKTILPSKAVGVSQEGPPGLPPQPPPPVAQLVPIVPLEKAWPGPHGTTGEGGPVATLSKPSLGDRSKISKDVYENFRQWQRYKALARRHLSQSPDTEALSCFLIPVLRSLARLKPTMTLEEGLPLAVQEWEHTSNFDRMIFYEMAERFMEFEAEEMQIQNTQLMNGSQGLSPATPLKLDPLGPLASEVCQQPVYIPKKAASKTRAPRRRQRKAQRPPAPEAPKEIPPEAVKEYVDIMEWLVGTHLATGESDGKQEEEGQQQEEEGMYPDPGLLSYINELCSQKVFVSKVEAVIHPQFLADLLSPEKQRDPLALIEELEQEEGLTLAQLVQKRLMALEEEEDAEAPPSFSGAQLDSSPSGSVEDEDGDGRLRPSPGLQGAGGAACLGKVSSSGKRAREVHGGQEQALDSPRGMHRDGNTLPSPSSWDLQPELAAPQGTPGPLGVERRGSGKVINQVSLHQDGHLGGAGPPGHCLVADRTSEALPLCWQGGFQPESTPSLDAGLAELAPLQGQGLEKQVLGLQKGQQTGGRGVLPQGKEPLAVPWEGSSGAMWGDDRGTPMAQSYDQNPSPRAAGERDDVCLSPGVWLSSEMDAVGLELPVQIEEVIESFQVEKCVTEYQEGCQGLGSRGNISLGPGETLVPGDTESSVIPCGGTVAAAALEKRNYCSLPGPLRANSPPLRSKENQEQSCETVGHPSDLWAEGCFPLLESGDSTLGSSKETLPPTCQGNLLIMGTEDASSLPEASQEAGSRGNSFSPLLETIEPVNILDVKDDCGLQLRVSEDTCPLNVHSYDPQGEGRVDPDLSKPKNLAPLQESQESYTTGTPKATSSHQGLGSTLPRRGTRNAIVPRETSVSKTHRSADRAKGKEKKKKEAEEEDEELSNFAYLLASKLSLSPREHPLSPHHASGGQGSQRASHLLPAGAKGPSKLPYPVAKSGKRALAGGPAPTEKTPHSGAQLGVPREKPLALGVVRPSQPRKRRCDSFVTGRRKKRRRSQ

SEQ ID NO: 59257 - protein, 1132 aa, Homo sapiens; identical to SEQ ID NO: 59254
  Payload ID: 11567
  Gene Symbol: NUTM1
  Gene Name: NUT midline carcinoma, family member 1
  Uniprot ID: Q86Y26
  ENSP ID: ENSP00000478903

SEQ ID NO: 59258 - protein, 481 aa, Homo sapiens
  Payload ID: 11568
  Gene Symbol: NYX
  Gene Name: nyctalopin
  Uniprot ID: Q9GZU5
  ENSP ID: ENSP00000340328
MKGRGMLVLLLHAVVLGLPSAWAVGACARACPAACACSTVERGCSVRCDRAGLLRVPAELPCEAVSIDLDRNGLRFLGERAFGTLPSLRRLSLRHNNLSFITPGAFKGLPRLAELRLAHNGDLRYLHARTFAALSRLRRLDLAACRLFSVPERLLAELPALRELAAFDNLFRRVPGALRGLANLTHAHLERGRIEAVASSSLQGLRRLRSLSLQANRVRAVHAGAFGDCGVLEHLLLNDNLLAELPADAFRGLRRLRTLNLGGNALDRVARAWFADLAELELLYLDRNSIAFVEEGAFQNLSGLLALHLNGNRLTVLAWVAFQPGFFLGRLFLFRNPWCCDCRLEWLRDWMEGSGRVTDVPCASPGSVAGLDLSQVTFGRSSDGLCVDPEELNLTTSSPGPSPEPAATTVSRFSSLLSKLLAPRVPVEEAANTTGGLANASLSDSLSSRGVGGAGRQPWFLLASCLLPSVAQHVVFGLQMD

SEQ ID NO: 59259 - protein, 481 aa, Homo sapiens; identical to SEQ ID NO: 59258
  Payload ID: 11568
  Gene Symbol: NYX
  Gene Name: nyctalopin
  Uniprot ID: Q9GZU5
  ENSP ID: ENSP00000367465

SEQ ID NO: 59260 - protein, 1898 aa, Homo sapiens
  Payload ID: 11569
  Gene Symbol: NYNRIN
  Gene Name: NYN domain and retroviral integrase containing
  Uniprot ID: Q9P2P1
  ENSP ID: ENSP00000371994
MLLSGGDPPAQEWFMVQTKSKPRVQRQRLQVQRIFRVKLNAFQSRPDTPYFWLQLEGPRENMGKAKEYLKGLCSPELWKEVRYPPILHCAFLGAQGLFLDCLCWSTLAYLVPGPPGSLMVGGLTESFIMTQNWLEELVGRLRWGPAPLLTPRGIWEAEVTRAFGALVWIRGDQHAGDLLQLPPAVQELLLSLVRDAAGKEDIIEWLSRFGISDSHSDPEVLICPPQQQKEAPAMVSVGESPGPFVDMGTLQNRGPENSKRLSSLGATGSLITAQSTPQEAANQLVRVGSNNQDGMDSAQEEGTVQATSSQDSTNHTQALLKQRQVQKIEDKLLFQPPVSALGVCPPWKAWTPGPAFGPLWPGAIAATFWRINELHSLHLAWLLSQACFNFPFWQRPLGPIQLKLPGQNPLPLNLEWKQKELAPLPSAESPAGRPDGGLGGEAALQNCPRPEISPKVTSLLVVPGSSDVKDKVSSDLPQIGPPLTSTPQLQAGGEPGDQGSMQLDFKGLEEGPAPVLPTGQGKPVAQGGLTDQSVPGAQTVPETLKVPMAAAVPKAENPSRTQVPSAAPKLPTSRMMLAVHTEPAAPEVPLAPTKPTAQLMATAQKTVVNQPVLVAQVEPTTPKTPQAQKMPVAKTSPAGPKTPKAQAGPAATVSKAPAASKAPAAPKVPVTPRVSRAPKTPAAQKVPTDAGPTLDVARLLSEVQPTSRASVSLLKGQGQAGRQGPQSSGTLALSSKHQFQMEGLLGAWEGAPRQPPRHLQANSTVTSFQRYHEALNTPFELNLSGEPGNQGLRRVVIDGSSVAMVHGLQHFFSCRGIAMAVQFFWNRGHREVTVFVPTWQLKKNRRVRESHFLTKLHSLKMLSITPSQLENGKKITTYDYRFMVKLAEETDGIIVTNEQIHILMNSSKKLMVKDRLLPFTFAGNLFMVPDDPLGRDGPTLDEFLKKPNRLDTDIGNFLKVWKTLPPSSASVTELSDDADSGPLESLPNMEEVREEKEERQDEEQRQGQGTQKAAEEDDLDSSLASVFRVECPSLSEEILRCLSLHDPPDGALDIDLLPGAASPYLGIPWDGKAPCQQVLAHLAQLTIPSNFTALSFFMGFMDSHRDAIPDYEALVGPLHSLLKQKPDWQWDQEHEEAFLALKRALVSALCLMAPNSQLPFRLEVTVSHVALTAILHQEHSGRKHPIAYTSKPLLPDEESQGPQSGGDSPYAVAWALKHFSRCIGDTPVVLDLSYASRTTADPEVREGRRVSKAWLIRWSLLVQDKGKRALELALLQGLLGENRLLTPAASMPRFFQVLPPFSDLSTFVCIHMSGYCFYREDEWCAGFGLYVLSPTSPPVSLSFSCSPYTPTYAHLAAVACGLERFGQSPLPVVFLTHCNWIFSLLWELLPLWRARGFLSSDGAPLPHPSLLSYIISLTSGLSSLPFIYRTSYRGSLFAVTVDTLAKQGAQGGGQWWSLPKDVPAPTVSPHAMGKRPNLLALQLSDSTLADIIARLQAGQKLSGSSPFSSAFNSLSLDKESGLLMFKGDKKPRVWVVPTQLRRDLIFSVHDIPLGAHQRPEETYKKLRLLGWWPGMQEHVKDYCRSCLFCIPRNLIGSELKVIESPWPLRSTAPWSNLQIEVVGPVTISEEGHKHVLIVADPNTRWVEAFPLKPYTHTAVAQVLLQHVFARWGVPVRLEAAQGPQFARHVLVSCGLALGAQVASLSRDLQFPCLTSSGAYWEFKRALKEFIFLHGKKWAASLPLLHLAFRASSTDATPFKVLTGGESRLTEPLWWEMSSANIEGLKMDVFLLQLVGELLELHWRVADKASEKAENRRFKRESQEKEWNVGDQVLLLSLPRNGSSAKWVGPFYIGDRLSLSLYRIWGFPTPEKLGCIYPSSLMKAFAKSGTPLSFKVLEQ

SEQ ID NO: 59261 - protein, 238 aa, Homo sapiens
  Payload ID: 11570
  Gene Symbol: MGMT
  Gene Name: O-6-methylguanine-DNA methyltransferase
  Uniprot ID: P16455
  ENSP ID: ENSP00000302111
MLGQPAPLERFASRRPQVLAVRTVCDLVLGKMDKDCEMKRTTLDSPLGKLELSGCEQGLHEIKLLGKGTSAADAVEVPAPAAVLGGPEPLMQCTAWLNAYFHQPEAIEEFPVPALHHPVFQQESFTRQVLWKLLKVVKFGEVISYQQLAALAGNPKAARAVGGAMRGNPVPILIPCHRVVCSSGAVGNYSGGLAVKEWLLAHEGHRLGKPGLGGSSGLAGAWLKGAGATSGSPPAGRN

SEQ ID NO: 59262 - protein, 86 aa, Homo sapiens
  Payload ID: 11571
  Gene Symbol: OARD1
  Gene Name: O-acyl-ADP-ribose deacylase 1
  ENSP ID: ENSP00000362247
MASSLNEDPEGSRITYVKGDLFACPKTDSLAHCISEDCRMGAGIAVLFKKKFGGVQELLNQQKKSGEVAVLKRDGRYIYYLDWMWS

SEQ ID NO: 59263 - protein, 152 aa, Homo sapiens
  Payload ID: 11571
  Gene Symbol: OARD1
  Gene Name: O-acyl-ADP-ribose deacylase 1
  Uniprot ID: Q9Y530
  ENSP ID: ENSP00000416829
MASSLNEDPEGSRITYVKGDLFACPKTDSLAHCISEDCRMGAGIAVLFKKKFGGVQELLNQQKKSGEVAVLKRDGRYIYYLITKKRASHKPTYENLQKSLEAMKSHCLKNGVTDLSMPRIGCGLDRLQWENVSAMIEEVFEATDIKITVYTL

SEQ ID NO: 59264 - protein, 88 aa, Homo sapiens
  Payload ID: 11571
  Gene Symbol: OARD1
  Gene Name: O-acyl-ADP-ribose deacylase 1
  ENSP ID: ENSP00000417333
MASSLNEDPEGSRITYVKGDLFACPKTDSLAHCISEDCRMGAGIAVLFKKKFGGVQELLNQREFWKPLTWFALARAPFNLLHFNKICV

SEQ ID NO: 59265 - protein, 77 aa, Homo sapiens
  Payload ID: 11571
  Gene Symbol: OARD1
  Gene Name: O-acyl-ADP-ribose deacylase 1
  ENSP ID: ENSP00000418098
MASSLNEDPEGSRITYVKGDLFACPKTDSLAHCISEDCRMGAGIAVLFKKKFGGVQELLNQRLDVVLIVCNGKMYLR

SEQ ID NO: 59266 - protein, 86 aa, Homo sapiens; identical to SEQ ID NO: 59262
  Payload ID: 11571
  Gene Symbol: OARD1
  Gene Name: O-acyl-ADP-ribose deacylase 1
  ENSP ID: ENSP00000418400

SEQ ID NO: 59267 - protein, 88 aa, Homo sapiens; identical to SEQ ID NO: 59264
  Payload ID: 11571
  Gene Symbol: OARD1
  Gene Name: O-acyl-ADP-ribose deacylase 1
  ENSP ID: ENSP00000418966

SEQ ID NO: 59268 - protein, 113 aa, Homo sapiens
  Payload ID: 11571
  Gene Symbol: OARD1
  Gene Name: O-acyl-ADP-ribose deacylase 1
  ENSP ID: ENSP00000419175
MGAGIAVLFKKKFGGVQELLNQQKKSGEVAVLKRDGRYIYYLITKKRASHKPTYENLQKSLEAMKSHCLKNGVTDLSMPRIGCGLDRLQWENVSAMIEEVFEATDIKITVYTL

SEQ ID NO: 59269 - protein, 77 aa, Homo sapiens; identical to SEQ ID NO: 59265
  Payload ID: 11571
  Gene Symbol: OARD1
  Gene Name: O-acyl-ADP-ribose deacylase 1
  ENSP ID: ENSP00000419875

SEQ ID NO: 59270 - protein, 152 aa, Homo sapiens; identical to SEQ ID NO: 59263
  Payload ID: 11571
  Gene Symbol: OARD1
  Gene Name: O-acyl-ADP-ribose deacylase 1
  Uniprot ID: Q9Y530
  ENSP ID: ENSP00000420193

SEQ ID NO: 59271 - protein, 131 aa, Homo sapiens
  Payload ID: 11571
  Gene Symbol: OARD1
  Gene Name: O-acyl-ADP-ribose deacylase 1
  ENSP ID: ENSP00000420414
MASSLNEDPEGSRITYVKGDLFACPKTDSLAHCISEDCRMGAGIAVLFKKKFGGVQELLNQQKKSGEVAVLKRDGRYIYYLITKKRASHKPTYENLQKSLEAMKSHCLKNGVTDLSMPRIGCGLDRLQWEN

SEQ ID NO: 59272 - protein, 77 aa, Homo sapiens
  Payload ID: 11571
  Gene Symbol: OARD1
  Gene Name: O-acyl-ADP-ribose deacylase 1
  ENSP ID: ENSP00000420472
  MOD_RES (1)..(1): Any amino acid
XISEDCRMGAGIAVLFKKKFGGVQELLNQQKKSGEVAVLKRDGRYIYYLVLFQVLGIWQKNKANENPCCDDLWSLRN

SEQ ID NO: 59273 - protein, 152 aa, Homo sapiens; identical to SEQ ID NO: 59263
  Payload ID: 11571
  Gene Symbol: OARD1
  Gene Name: O-acyl-ADP-ribose deacylase 1
  Uniprot ID: Q9Y530
  ENSP ID: ENSP00000420484

SEQ ID NO: 59274 - protein, 152 aa, Homo sapiens; identical to SEQ ID NO: 59263
  Payload ID: 11571
  Gene Symbol: OARD1
  Gene Name: O-acyl-ADP-ribose deacylase 1
  Uniprot ID: Q9Y530
  ENSP ID: ENSP00000420601

SEQ ID NO: 59275 - protein, 86 aa, Homo sapiens; identical to SEQ ID NO: 59262
  Payload ID: 11571
  Gene Symbol: OARD1
  Gene Name: O-acyl-ADP-ribose deacylase 1
  ENSP ID: ENSP00000487484

SEQ ID NO: 59276 - protein, 396 aa, Homo sapiens
  Payload ID: 11572
  Gene Symbol: OLA1
  Gene Name: Obg-like ATPase 1
  Uniprot ID: Q9NTK5
  ENSP ID: ENSP00000284719
MPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISACDGIFHLTRAFEDDDITHVEGSVDPIRDIEIIHEELQLKDEEMIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVIPFSGALELKLQELSAEERQKYLEANMTQSALPKIIKAGFAALQLEYFFTAGPDEVRAWTIRKGTKAPQAAGKIHTDFEKGFIMAEVMKYEDFKEEGSENAVKAAGKYRQQGRNYIVEDGDIIFFKFNTPQQPKKK

SEQ ID NO: 59277 - protein, 238 aa, Homo sapiens
  Payload ID: 11572
  Gene Symbol: OLA1
  Gene Name: Obg-like ATPase 1
  Uniprot ID: Q9NTK5
  ENSP ID: ENSP00000340167
MIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVIPFSGALELKLQELSAEERQKYLEANMTQSALPKIIKAGFAALQLEYFFTAGPDEVRAWTIRKGTKAPQAAGKIHTDFEKGFIMAEVMKYEDFKEEGSENAVKAAGKYRQQGRNYIVEDGDIIFFKFNTPQQPKKK

SEQ ID NO: 59278 - protein, 416 aa, Homo sapiens
  Payload ID: 11572
  Gene Symbol: OLA1
  Gene Name: Obg-like ATPase 1
  ENSP ID: ENSP00000386350
MSRTFSAKGGRDLVEGPQYLMPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISACDGIFHLTRAFEDDDITHVEGSVDPIRDIEIIHEELQLKDEEMIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVIPFSGALELKLQELSAEERQKYLEANMTQSALPKIIKAGFAALQLEYFFTAGPDEVRAWTIRKGTKAPQAAGKIHTDFEKGFIMAEVMKYEDFKEEGSENAVKAAGKYRQQGRNYIVEDGDIIFFKFNTPQQPKKK

SEQ ID NO: 59279 - protein, 103 aa, Homo sapiens
  Payload ID: 11572
  Gene Symbol: OLA1
  Gene Name: Obg-like ATPase 1
  ENSP ID: ENSP00000404864
MIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVI

SEQ ID NO: 59280 - protein, 278 aa, Homo sapiens
  Payload ID: 11572
  Gene Symbol: OLA1
  Gene Name: Obg-like ATPase 1
  Uniprot ID: Q9NTK5
  ENSP ID: ENSP00000410385
MPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISACDGIFHLTRAFEDDDITHVEGSVDPIRDIEIIHEELQLKDEEMIGPIIDKLEKVAVRGGDKKLKPEYDIMCKVKSWVIDQKKPVRFYHDWNDKEIEVLNKHLFLTSKPMVYLVNLSEKDYIRKKNKWLLESTDNKAEIILLKMEILSSSNLTHLNNRRRNKI

SEQ ID NO: 59281 - protein, 116 aa, Homo sapiens
  Payload ID: 11572
  Gene Symbol: OLA1
  Gene Name: Obg-like ATPase 1
  ENSP ID: ENSP00000414568
MPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISA

SEQ ID NO: 59282 - protein, 6620 aa, Homo sapiens
  Payload ID: 11573
  Gene Symbol: OBSCN
  Gene Name: obscurin, cytoskeletal calmodulin and titin-interacting RhoGEF
  Uniprot ID: Q5VST9
  ENSP ID: ENSP00000284548
MDQPQFSGAPRFLTRPKAFVVSVGKDATLSCQIVGNPTPQVSWEKDQQPVAAGARFRLAQDGDLYRLTILDLALGDSGQYVCRARNAIGEAFAAVGLQVDAEAACAEQAPHFLLRPTSIRVREGSEATFRCRVGGSPRPAVSWSKDGRRLGEPDGPRVRVEELGEASALRIRAARPRDGGTYEVRAENPLGAASAAAALVVDSDAADTASRPGTSTAALLAHLQRRREAMRAEGAPASPPSTGTRTCTVTEGKHARLSCYVTGEPKPETVWKKDGQLVTEGRRHVVYEDAQENFVLKILFCKQSDRGLYTCTASNLVGQTYSSVLVVVREPAVPFKKRLQDLEVREKESATFLCEVPQPSTEAAWFKEETRLWASAKYGIEEEGTERRLTVRNVSADDDAVYICETPEGSRTVAELAVQGNLLRKLPRKTAVRVGDTAMFCVELAVPVGPVHWLRNQEEVVAGGRVAISAEGTRHTLTISQCCLEDVGQVAFMAGDCQTSTQFCVSAPRKPPLQPPVDPVVKARMESSVILSWSPPPHGERPVTIDGYLVEKKKLGTYTWIRCHEAEWVATPELTVADVAEEGNFQFRVSALNSFGQSPYLEFPGTVHLAPKLAVRTPLKAVQAVEGGEVTFSVDLTVASAGEWFLDGQALKASSVYEIHCDRTRHTLTIREVPASLHGAQLKFVANGIESSIRMEVRAAPGLTANKPPAAAAREVLARLHEEAQLLAELSDQAAAVTWLKDGRTLSPGPKYEVQASAGRRVLLVRDVARDDAGLYECVSRGGRIAYQLSVQGLARFLHKDMAGSCVDAVAGGPAQFECETSEAHVHVHWYKDGMELGHSGERFLQEDVGTRHRLVAATVTRQDEGTYSCRVGEDSVDFRLRVSEPKVVFAKEQLARRKLQAEAGASATLSCEVAQAQTEVTWYKDGKKLSSSSKVCMEATGCTRRLVVQQAGQADAGEYSCEAGGQRLSFHLDVKEPKVVFAKDQVAHSEVQAEAGASATLSCEVAQAQTEVMWYKDGKKLSSSLKVHVEAKGCRRRLVVQQAGKTDAGDYSCEARGQRVSFRLHITEPKMMFAKEQSVHNEVQAEAGASAMLSCEVAQAQTEVTWYKDGKKLSSSSKVGMEVKGCTRRLVLPQAGKADAGEYSCEAGGQRVSFHLHITEPKGVFAKEQSVHNEVQAEAGTTAMLSCEVAQPQTEVTWYKDGKKLSSSSKVRMEVKGCTRRLVVQQVGKADAGEYSCEAGGQRVSFQLHITEPKAVFAKEQLVHNEVRTEAGASATLSCEVAQAQTEVTWYKDGKKLSSSSKVRIEAAGCMRQLVVQQAGQADAGEYTCEAGGQRLSFHLDVSEPKAVFAKEQLAHRKVQAEAGAIATLSCEVAQAQTEVTWYKDGKKLSSSSKVRMEAVGCTRRLVVQQACQADTGEYSCEAGGQRLSFSLDVAEPKVVFAKEQPVHREVQAQAGASTTLSCEVAQAQTEVMWYKDGKKLSFSSKVRMEAVGCTRRLVVQQAGQAVAGEYSCEAGSQRLSFHLHVAEPKAVFAKEQPASREVQAEAGTSATLSCEVAQAQTEVTWYKDGKKLSSSSKVRMEAVGCTRRLVVQEAGQADAGEYSCKAGDQRLSFHLHVAEPKVVFAKEQPAHREVQAEAGASATLSCEVAQAQTEVTWYKDGKKLSSSSKVRVEAVGCTRRLVVQQAGQAEAGEYSCEAGGQQLSFRLQVAELEPQISERPCRREPLVVKEHEDIILTATLATPSAATVTWLKDGVEIRRSKRHETASQGDTHTLTVHGAQVLDSAIYSCRVGAEGQDFPVQVEEVAAKFCRLLEPVCGELGGTVTLACELSPACAEVVWRCGNTQLRVGKRFQMVAEGPVRSLTVLGLRAEDAGEYVCESRDDHTSAQLTVSVPRVVKFMSGLSTVVAEEGGEATFQCVVSPSDVAVVWFRDGALLQPSEKFAISQSGASHSLTISDLVLEDAGQITVEAEGASSSAALRVREAPVLFKKKLEPQTVEERSSVTLEVELTRPWPELRWTRNATALAPGKNVEIHAEGARHRLVLHNVGFADRGFFGCETPDDKTQAKLTVEMRQVRLVRGLQAVEAREQGTATMEVQLSHADVDGSWTRDGLRFQQGPTCHLAVRGPMHTLTLSGLRPEDSGLMVFKAEGVHTSARLVVTELPVSFSRPLQDVVTTEKEKVTLECELSRPNVDVRWLKDGVELRAGKTMAIAAQGACRSLTIYRCEFADQGVYVCDAHDAQSSASVKVQGRTYTLIYRRVLAEDAGEIQFVAENAESRAQLRVKELPVTLVRPLRDKIAMEKHRGVLECQVSRASAQVRWFKGSQELQPGPKYELVSDGLYRKLIISDVHAEDEDTYTCDAGDVKTSAQFFVEEQSITIVRGLQDVTVMEPAPAWFECETSIPSVRPPKWLLGKTVLQAGGNVGLEQEGTVHRLMLRRTCSTMTGPVHFTVGKSRSSARLVVSDIPVVLTRPLEPKTGRELQSVVLSCDFRPAPKAVQWYKDDTPLSPSEKFKMSLEGQMAELRILRLMPADAGVYRCQAGSAHSSTEVTVEAREVTVTGPLQDAEATEEGWASFSCELSHEDEEVEWSLNGMPLYNDSFHEISHKGRRHTLVLKSIQRADAGIVRASSLKVSTSARLEVRVKPVVFLKALDDLSAEERGTLALQCEVSDPEAHVVWRKDGVQLGPSDKYDFLHTAGTRGLVVHDVSPEDAGLYTCHVGSEETRARVRVHDLHVGITKRLKTMEVLEGESCSFECVLSHESASDPAMWTVGGKTVGSSSRFQATRQGRKYILVVREAAPSDAGEVVFSVRGLTSKASLIVRERPAAIIKPLEDQWVAPGEDVELRCELSRAGTPVHWLKDRKAIRKSQKYDVVCEGTMAMLVIRGASLKDAGEYTCEVEASKSTASLHVEEKANCFTEELTNLQVEEKGTAVFTCKTEHPAATVTWRKGLLELRASGKHQPSQEGLTLRLTISALEKADSDTYTCDIGQAQSRAQLLVQGRRVHIIEDLEDVDVQEGSSATFRCRISPANYEPVHWFLDKTPLHANELNEIDAQPGGYHVLTLRQLALKDSGTIYFEAGDQRASAALRVTEKPSVFSRELTDATITEGEDLTLVCETSTCDIPVCWTKDGKTLRGSARCQLSHEGHRAQLLITGATLQDSGRYKCEAGGACSSSIVRVHARPVRFQEALKDLEVLEGGAATLRCVLSSVAAPVKWCYGNNVLRPGDKYSLRQEGAMLELVVRNLRPQDSGRYSCSFGDQTTSATLTVTALPAQFIGKLRNKEATEGATATLRCELSKAAPVEWRKGSETLRDGDRYCLRQDGAMCELQIRGLAMVDAAEYSCVCGEERTSASLTIRPMPAHFIGRLRHQESIEGATATLRCELSKAAPVEWRKGRESLRDGDRHSLRQDGAVCELQICGLAVADAGEYSCVCGEERTSATLTVKALPAKFTEGLRNEEAVEGATAMLWCELSKVAPVEWRKGPENLRDGDRYILRQEGTRCELQICGLAMADAGEYLCVCGQERTSATLTIRALPARFIEDVKNQEAREGATAVLQCELNSAAPVEWRKGSETLRDGDRYSLRQDGTKCELQIRGLAMADTGEYSCVCGQERTSAMLTVRALPIKFTEGLRNEEATEGATAVLRCELSKMAPVEWWKGHETLRDGDRHSLRQDGARCELQIRGLVAEDAGEYLCMCGKERTSAMLTVRAMPSKFIEGLRNEEATEGDTATLWCELSKAAPVEWRKGHETLRDGDRHSLRQDGSRCELQIRGLAVVDAGEYSCVCGQERTSATLTVRALPARFIEDVKNQEAREGATAVLQCELSKAAPVEWRKGSETLRGGDRYSLRQDGTRCELQIHGLSVADTGEYSCVCGQERTSATLTVRAPQPVFREPLQSLQAEEGSTATLQCELSEPTATVVWSKGGLQLQANGRREPRLQGCTAELVLQDLQREDTGEYTCTCGSQATSATLTVTAAPVRFLRELQHQEVDEGGTAHLCCELSRAGASVEWRKGSLQLFPCAKYQMVQDGAAAELLVRGVEQEDAGDYTCDTGHTQSMASLSVRVPRPKFKTRLQSLEQETGDIARLCCQLSDAESGAVVQWLKEGVELHAGPKYEMRSQGATRELLIHQLEAKDTGEYACVTGGQKTAASLRVTEPEVTIVRGLVDAEVTADEDVEFSCEVSRAGATGVQWCLQGLPLQSNEVTEVAVRDGRIHTLRLKGVTPEDAGTVSFHLGNHASSAQLTVRAPEVTILEPLQDVQLSEGQDASFQCRLSRASGQEARWALGGVPLQANEMNDITVEQGTLHLLTLHKVTLEDAGTVSFHVGTCSSEAQLKVTAKNTVVRGLENVEALEGGEALFECQLSQPEVAAHTWLLDDEPVHTSENAEVVFFENGLRHLLLLKNLRPQDSCRVTFLAGDMVTSAFLTVRGWRLEILEPLKNAAVRAGAQACFTCTLSEAVPVGEASWYINGAAVQPDDSDWTVTADGSHHALLLRSAQPHHAGEVTFACRDAVASARLTVLGLPDPPEDAEVVARSSHTVTLSWAAPMSDGGGGLCGYRVEVKEGATGQWRLCHELVPGPECVVDGLAPGETYRFRVAAVGPVGAGEPVHLPQTVRLAEPPKPVPPQPSAPESRQVAAGEDVSLELEVVAEAGEVIWHKGMERIQPGGRFEVVSQGRQQMLVIKGFTAEDQGEYHCGLAQGSICPAAATFQVALSPASVDEAPQPSLPPEAAQEGDLHLLWEALARKRRMSREPTLDSISELPEEDGRSQRLPQEAEEVAPDLSEGYSTADELARTGDADLSHTSSDDESRAGTPSLVTYLKKAGRPGTSPLASKVGAPAAPSVKPQQQQEPLAAVRPPLGDLSTKDLGDPSMDKAAVKIQAAFKGYKVRKEMKQQEGPMFSHTFGDTEAQVGDALRLECVVASKADVRARWLKDGVELTDGRHHHIDQLGDGTCSLLITGLDRADAGCYTCQVSNKFGQVTHSACVVVSGSESEAESSSGGELDDAFRRAARRLHRLFRTKSPAEVSDEELFLSADEGPAEPEEPADWQTYREDEHFICIRFEALTEARQAVTRFQEMFATLGIGVEIKLVEQGPRRVEMCISKETPAPVVPPEPLPSLLTSDAAPVFLTELQNQEVQDGYPVSFDCVVTGQPMPSVRWFKDGKLLEEDDHYMINEDQQGGHQLIITAVVPADMGVYRCLAENSMGVSSTKAELRVDLTSTDYDTAADATESSSYFSAQGYLSSREQEGTESTTDEGQLPQVVEELRDLQVAPGTRLAKFQLKVKGYPAPRLYWFKDGQPLTASAHIRMTDKKILHTLEIISVTREDSGQYAAYISNAMGAAYSSARLLVRGPDEPEEKPASDVHEQLVPPRMLERFTPKKVKKGSSITFSVKVEGRPVPTVHWLREEAERGVLWIGPDTPGYTVASSAQQHSLVLLDVGRQHQGTYTCIASNAAGQALCSASLHVSGLPKVEEQEKVKEALISTFLQGTTQAISAQGLETASFADLGGQRKEEPLAAKEALGHLSLAEVGTEEFLQKLTSQITEMVSAKITQAKLQVPGGDSDEDSKTPSASPRHGRSRPSSSIQESSSESEDGDARGEIFDIYVVTADYLPLGAEQDAITLREGQYVEVLDAAHPLRWLVRTKPTKSSPSRQGWVSPAYLDRRLKLSPEWGAAEAPEFPGEAVSEDEYKARLSSVIQELLSSEQAFVEELQFLQSHHLQHLERCPHVPIAVAGQKAVIFRNVRDIGRFHSSFLQELQQCDTDDDVAMCFIKNQAAFEQYLEFLVGRVQAESVVVSTAIQEFYKKYAEEALLAGDPSQPPPPPLQHYLEQPVERVQRYQALLKELIRNKARNRQNCALLEQAYAVVSALPQRAENKLHVSLMENYPGTLQALGEPIRQGHFIVWEGAPGARMPWKGHNRHVFLFRNHLVICKPRRDSRTDTVSYVFRNMMKLSSIDLNDQVEGDDRAFEVWQEREDSVRKYLLQARTAIIKSSWVKEICGIQQRLALPVWRPPDFEEELADCTAELGETVKLACRVTGTPKPVISWYKDGKAVQVDPHHILIEDPDGSCALILDSLTGVDSGQYMCFAASAAGNCSTLGKILVQVPPRFVNKVRASPFVEGEDAQFTCTIEGAPYPQIRWYKDGALLTTGNKFQTLSEPRSGLLVLVIRAASKEDLGLYECELVNRLGSARASAELRIQSPMLQAQEQCHREQLVAAVEVTEQETKVPKKTVIIEETITTVVKSPRGQRRSPSKSPSRSPSRCSASPLRPGLLAPDLLYLPGAGQPRRPEAEPGQKPVVPTLYVTEAEAHSPALPGLSGPQPKWVEVEETIEVRVKKMGPQGVSPTTEVPRSSSGHLFTLPGATPGGDPNSNNSNNKLLAQEAWAQGTAMVGVREPLVFRVDARGSVDWAASGMGSLEEEGTMEEAGEEEGEDGDAFVTEESQDTHSLGDRDPKILTHNGRMLTLADLEDYVPGEGETFHCGGPGPGAPDDPPCEVSVIQREIGEPTVGQPVLLSVGHALGPRGPLGLFRPEPRGASPPGPQVRSLEGTSFLLREAPARPVGSAPWTQSFCTRIRRSADSGQSSFTTELSTQTVNFGTVGETVTLHICPDRDGDEAAQP

SEQ ID NO: 59283 - protein, 858 aa, Homo sapiens
  Payload ID: 11573
  Gene Symbol: OBSCN
  Gene Name: obscurin, cytoskeletal calmodulin and titin-interacting RhoGEF
  ENSP ID: ENSP00000355667
AGKTMAIAAQGACRSLTIYRCEFADQGVYVCDAHDAQSSASVKVQGRNIQIVRPLEDVEVMEKDGATFSCEVSHDEVPGQWFWEGSKLRPTDNVRIRQEGRTYTLIYRRVLAEDAGEIQFVAENAESRAQLRVKELPVTLVRPLRDKIAMEKHRGVLECQVSRASAQVRWFKGSQELQPGPKYELVSDGLYRKLIISDVHAEDEDTYTCDAGDVKTSAQFFVEEQSITIVRGLQDVTVMEPAPAWFECETSIPSVRPPKWLLGKTVLQAGGNVGLEQEGTVHRLMLRRTCSTMTGPVHFTVGKSRSSARLVVSDIPVVLTRPLEPKTGRELQSVVLSCDFRPAPKAVQWYKDDTPLSPSEKFKMSLEGQMAELRILRLMPADAGVYRCQAGSAHSSTEVTVEAREVTVTGPLQDAEATEEGWASFSCELSHEDEEVEWSLNGMPLYNDSFHEISHKGRRHTLVLKSIQRADAGIVRASSLKVSTSARLEVRVKPVVFLKALDDLSAEERGTLALQCEVSDPEAHVVWRKDGVQLGPSDKYDFLHTAGTRGLVVHDVSPEDAGLYTCHVGSEETRARVRVHDLHVGITKRLKTMEVLEGESCSFECVLSHESASDPAMWTVGGKTVGSSSRFQATRQGRKYILVVREAAPSDAGEVVFSVRGLTSKASLIVRERPAAIIKPLEDQWVAPGEDVELRCELSRAGTPVHWLKDRKAIRKSQKYDVVCEGTMAMLVIRGASLKDAGEYTCEVEASKSTASLHVEEKANCFTEELTNLQVEEKGTAVFTCKTEHPAATVTWRKGLLELRASGKHQPSQEGLTLRLTISALEKADSDTYTCDIGQAQSRAQLLVQGEAAKCARA

SEQ ID NO: 59284 - protein, 8925 aa, Homo sapiens
  Payload ID: 11573
  Gene Symbol: OBSCN
  Gene Name: obscurin, cytoskeletal calmodulin and titin-interacting RhoGEF
  ENSP ID: ENSP00000355668
MDQPQFSGAPRFLTRPKAFVVSVGKDATLSCQIVGNPTPQVSWEKDQQPVAAGARFRLAQDGDLYRLTILDLALGDSGQYVCRARNAIGEAFAAVGLQVDAEAACAEQAPHFLLRPTSIRVREGSEATFRCRVGGSPRPAVSWSKDGRRLGEPDGPRVRVEELGEASALRIRAARPRDGGTYEVRAENPLGAASAAAALVVDSDAADTASRPGTSTAALLAHLQRRREAMRAEGAPASPPSTGTRTCTVTEGKHARLSCYVTGEPKPETVWKKDGQLVTEGRRHVVYEDAQENFVLKILFCKQSDRGLYTCTASNLVGQTYSSVLVVVREPAVPFKKRLQDLEVREKESATFLCEVPQPSTEAAWFKEETRLWASAKYGIEEEGTERRLTVRNVSADDDAVYICETPEGSRTVAELAVQGNLLRKLPRKTAVRVGDTAMFCVELAVPVGPVHWLRNQEEVVAGGRVAISAEGTRHTLTISQCCLEDVGQVAFMAGDCQTSTQFCVSAPRKPPLQPPVDPVVKARMESSVILSWSPPPHGERPVTIDGYLVEKKKLGTYTWIRCHEAEWVATPELTVADVAEEGNFQFRVSALNSFGQSPYLEFPGTVHLAPKLAVRTPLKAVQAVEGGEVTFSVDLTVASAGEWFLDGQALKASSVYEIHCDRTRHTLTIREVPASLHGAQLKFVANGIESSIRMEVRAAPGLTANKPPAAAAREVLARLHEEAQLLAELSDQAAAVTWLKDGRTLSPGPKYEVQASAGRRVLLVRDVARDDAGLYECVSRGGRIAYQLSVQGLARFLHKDMAGSCVDAVAGGPAQFECETSEAHVHVHWYKDGMELGHSGERFLQEDVGTRHRLVAATVTRQDEGTYSCRVGEDSVDFRLRVSEPKAVFAKEQPACREVQAEVGASATLSCEVAQDQMEVTWYKDGKKLSSSSKVHVEAVGCMRRLVVQQVGQADSGEYSCEARGQRVSFRLDVAEPKVVFAKEQLARRKLQAEAGASATLSCEVAQAQTEVTWYKDGKKLSSSSKVCMEATGCTRRLVVQQAGQADAGEYSCEAGGQRLSFHLDVKEPKVVFAKDQVAHSEVQAEAGASATLSCEVAQAQTEVMWYKDGKKLSSSLKVHVEAKGCRRRLVVQQAGKTDAGDYSCEARGQRVSFRLHITEPKMMFAKEQSVHNEVQAEAGASAMLSCEVAQAQTEVTWYKDGKKLSSSSKVGMEVKGCTRRLVLPQAGKADAGEYSCEAGGQRVSFHLHITEPKGVFAKEQSVHNEVQAEAGTTAMLSCEVAQPQTEVTWYKDGKKLSSSSKVRMEVKGCTRRLVVQQVGKADAGEYSCEAGGQRVSFQLHITEPKAVFAKEQLVHNEVRTEAGASATLSCEVAQAQTEVTWYKDGKKLSSSSKVRIEAAGCMRQLVVQQAGQADAGEYTCEAGGQRLSFHLDVSEPKAVFAKEQLAHRKVQAEAGAIATLSCEVAQAQTEVTWYKDGKKLSSSSKVRMEAVGCTRRLVVQQACQADTGEYSCEAGGQRLSFSLDVAEPKVVFAKEQPVHREVQAQAGASTTLSCEVAQAQTEVMWYKDGKKLSFSSKVRMEAVGCTRRLVVQQAGQAVAGEYSCEAGSQRLSFHLHVAEPKAVFAKEQPAHREVQAEAGASATLSCEVAQAQTEVTWYKDGKKLSSSLKVHVEAAGCTRRLVVQQAGQADTGEYSCEAGGQQLSFRLQVAEPKAVFAKEQPASREVQAEAGTSATLSCEVAQAQTEVTWYKDGKKLSSSSKVRMEAVGCTRRLVVQEAGQADAGEYSCKAGDQRLSFHLHVAEPKVVFAKEQPAHREVQAEAGASATLSCEVAQAQTEVTWYKDGKKLSSSSKVRVEAVGCTRRLVVQQAGQAEAGEYSCEAGGQQLSFRLQVAEPKAVFAKEQVVFAKDQPVHREVQAEAGTSTMLSCEVAQAQTEVMWYKDGKKLSSSSKMRVEAVGCTRRLVVQEAGQADAGEYSCEAGGQRLSFHLHVAEPKVVFAKEQPACREVQAEAGASATLSCEVAQGQMEVTWYKDGKKLSSSSKVHMEASGYTRRLVVQQAGQADAGEYSCEAGGQRLSFRLHVAELEPQISERPCRREPLVVKEHEDIILTATLATPSAATVTWLKDGVEIRRSKRHETASQGDTHTLTVHGAQVLDSAIYSCRVGAEGQDFPVQVEEVAAKFCRLLEPVCGELGGTVTLACELSPACAEVVWRCGNTQLRVGKRFQMVAEGPVRSLTVLGLRAEDAGEYVCESRDDHTSAQLTVSVPRVVKFMSGLSTVVAEEGGEATFQCVVSPSDVAVVWFRDGALLQPSEKFAISQSGASHSLTISDLVLEDAGQITVEAEGASSSAALRVREAPVLFKKKLEPQTVEERSSVTLEVELTRPWPELRWTRNATALAPGKNVEIHAEGARHRLVLHNVGFADRGFFGCETPDDKTQAKLTVEMRQVRLVRGLQAVEAREQGTATMEVQLSHADVDGSWTRDGLRFQQGPTCHLAVRGPMHTLTLSGLRPEDSGLMVFKAEGVHTSARLVVTELPVSFSRPLQDVVTTEKEKVTLECELSRPNVDVRWLKDGVELRAGKTMAIAAQGACRSLTIYRCEFADQGVYVCDAHDAQSSASVKVQGRNIQIVRPLEDVEVMEKDGATFSCEVSHDEVPGQWFWEGSKLRPTDNVRIRQEGRTYTLIYRRVLAEDAGEIQFVAENAESRAQLRVKELPVTLVRPLRDKIAMEKHRGVLECQVSRASAQVRWFKGSQELQPGPKYELVSDGLYRKLIISDVHAEDEDTYTCDAGDVKTSAQFFVEEQSITIVRGLQDVTVMEPAPAWFECETSIPSVRPPKWLLGKTVLQAGGNVGLEQEGTVHRLMLRRTCSTMTGPVHFTVGKSRSSARLVVSDIPVVLTRPLEPKTGRELQSVVLSCDFRPAPKAVQWYKDDTPLSPSEKFKMSLEGQMAELRILRLMPADAGVYRCQAGSAHSSTEVTVEAREVTVTGPLQDAEATEEGWASFSCELSHEDEEVEWSLNGMPLYNDSFHEISHKGRRHTLVLKSIQRADAGIVRASSLKVSTSARLEVRVKPVVFLKALDDLSAEERGTLALQCEVSDPEAHVVWRKDGVQLGPSDKYDFLHTAGTRGLVVHDVSPEDAGLYTCHVGSEETRARVRVHDLHVGITKRLKTMEVLEGESCSFECVLSHESASDPAMWTVGGKTVGSSSRFQATRQGRKYILVVREAAPSDAGEVVFSVRGLTSKASLIVRERPAAIIKPLEDQWVAPGEDVELRCELSRAGTPVHWLKDRKAIRKSQKYDVVCEGTMAMLVIRGASLKDAGEYTCEVEASKSTASLHVEEKANCFTEELTNLQVEEKGTAVFTCKTEHPAATVTWRKGLLELRASGKHQPSQEGLTLRLTISALEKADSDTYTCDIGQAQSRAQLLVQGRRVHIIEDLEDVDVQEGSSATFRCRISPANYEPVHWFLDKTPLHANELNEIDAQPGGYHVLTLRQLALKDSGTIYFEAGDQRASAALRVTEKPSVFSRELTDATITEGEDLTLVCETSTCDIPVCWTKDGKTLRGSARCQLSHEGHRAQLLITGATLQDSGRYKCEAGGACSSSIVRVHARPVRFQEALKDLEVLEGGAATLRCVLSSVAAPVKWCYGNNVLRPGDKYSLRQEGAMLELVVRNLRPQDSGRYSCSFGDQTTSATLTVTALPAQFIGKLRNKEATEGATATLRCELSKAAPVEWRKGSETLRDGDRYCLRQDGAMCELQIRGLAMVDAAEYSCVCGEERTSASLTIRPMPAHFIGRLRHQESIEGATATLRCELSKAAPVEWRKGRESLRDGDRHSLRQDGAVCELQICGLAVADAGEYSCVCGEERTSATLTVKALPAKFTEGLRNEEAVEGATAMLWCELSKVAPVEWRKGPENLRDGDRYILRQEGTRCELQICGLAMADAGEYLCVCGQERTSATLTIRALPARFIEDVKNQEAREGATAVLQCELNSAAPVEWRKGSETLRDGDRYSLRQDGTKCELQIRGLAMADTGEYSCVCGQERTSAMLTVRALPIKFTEGLRNEEATEGATAVLRCELSKMAPVEWWKGHETLRDGDRHSLRQDGARCELQIRGLVAEDAGEYLCMCGKERTSAMLTVRAMPSKFIEGLRNEEATEGDTATLWCELSKAAPVEWRKGHETLRDGDRHSLRQDGSRCELQIRGLAVVDAGEYSCVCGQERTSATLTVRALPARFIEDVKNQEAREGATAVLQCELSKAAPVEWRKGSETLRGGDRYSLRQDGTRCELQIHGLSVADTGEYSCVCGQERTSATLTVRALPARFTQDLKTKEASEGATATLQCELSKVAPVEWKKGPETLRDGGRYSLKQDGTRCELQIHDLSVADAGEYSCMCGQERTSATLTVRALPARFTEGLRNEEAMEGATATLQCELSKAAPVEWRKGLEALRDGDKYSLRQDGAVCELQIHGLAMADNGVYSCVCGQERTSATLTVRALPARFIEDMRNQKATEGATVTLQCKLRKAAPVEWRKGPNTLKDGDRYSLKQDGTSCELQIRGLVIADAGEYSCICEQERTSATLTVRALPARFIEDVRNHEATEGATAVLQCELSKAAPVEWRKGSETLRDGDRYSLRQDGTRCELQIRGLAVEDTGEYLCVCGQERTSATLTVRALPARFIDNMTNQEAREGATATLHCELSKVAPVEWRKGPETLRDGDRHSLRQDGTRCELQIRGLSVADAGEYSCVCGQERTSATLTIRALPAKFTKGLRNEEATEGATAMLQCELSKVAPVEWRKGPETLRDGDRYNLRQDGTRCELQIHGLSVADTGEYSCVCGQEKTSATLTVKAPQPVFREPLQSLQAEEGSTATLQCELSEPTATVVWSKGGLQLQANGRREPRLQGCTAELVLQDLQREDTGEYTCTCGSQATSATLTVTAAPVRFLRELQHQEVDEGGTAHLCCELSRAGASVEWRKGSLQLFPCAKYQMVQDGAAAELLVRGVEQEDAGDYTCDTGHTQSMASLSVRVPRPKFKTRLQSLEQETGDIARLCCQLSDAESGAVVQWLKEGVELHAGPKYEMRSQGATRELLIHQLEAKDTGEYACVTGGQKTAASLRVTEPEVTIVRGLVDAEVTADEDVEFSCEVSRAGATGVQWCLQGLPLQSNEVTEVAVRDGRIHTLRLKGVTPEDAGTVSFHLGNHASSAQLTVRAPEVTILEPLQDVQLSEGQDASFQCRLSRASGQEARWALGGVPLQANEMNDITVEQGTLHLLTLHKVTLEDAGTVSFHVGTCSSEAQLKVTAKNTVVRGLENVEALEGGEALFECQLSQPEVAAHTWLLDDEPVHTSENAEVVFFENGLRHLLLLKNLRPQDSCRVTFLAGDMVTSAFLTVRGWRLEILEPLKNAAVRAGAQACFTCTLSEAVPVGEASWYINGAAVQPDDSDWTVTADGSHHALLLRSAQPHHAGEVTFACRDAVASARLTVLGLPDPPEDAEVVARSSHTVTLSWAAPMSDGGGGLCGYRVEVKEGATGQWRLCHELVPGPECVVDGLAPGETYRFRVAAVGPVGAGEPVHLPQTVRLAEPPKPVPPQPSAPESRQVAAGEDVSLELEVVAEAGEVIWHKGMERIQPGGRFEVVSQGRQQMLVIKGFTAEDQGEYHCGLAQGSICPAAATFQVALSPASVDEAPQPSLPPEAAQEGDLHLLWEALARKRRMSREPTLDSISELPEEDGRSQRLPQEAEEVAPDLSEGYSTADELARTGDADLSHTSSDDESRAGTPSLVTYLKKAGRPGTSPLASKVGAPAAPSVKPQQQQEPLAAVRPPLGDLSTKDLGDPSMDKAAVKIQAAFKGYKVRKEMKQQEGPMFSHTFGDTEAQVGDALRLECVVASKADVRARWLKDGVELTDGRHHHIDQLGDGTCSLLITGLDRADAGCYTCQVSNKFGQVTHSACVVVSGSESEAESSSGGELDDAFRRAARRLHRLFRTKSPAEVSDEELFLSADEGPAEPEEPADWQTYREDEHFICIRFEALTEARQAVTRFQEMFATLGIGVEIKLVEQGPRRVEMCISKETPAPVVPPEPLPSLLTSDAAPVFLTELQNQEVQDGYPVSFDCVVTGQPMPSVRWFKDGKLLEEDDHYMINEDQQGGHQLIITAVVPADMGVYRCLAENSMGVSSTKAELRVDLTSTDYDTAADATESSSYFSAQGYLSSREQEGTESTTDEGQLPQVVEELRDLQVAPGTRLAKFQLKVKGYPAPRLYWFKDGQPLTASAHIRMTDKKILHTLEIISVTREDSGQYAAYISNAMGAAYSSARLLVRGPDEPEEKPASDVHEQLVPPRMLERFTPKKVKKGSSITFSVKVEGRPVPTVHWLREEAERGVLWIGPDTPGYTVASSAQQHSLVLLDVGRQHQGTYTCIASNAAGQALCSASLHVSGLPKVEEQEKVKEALISTFLQGTTQAISAQGLETASFADLGGQRKEEPLAAKEALGHLSLAEVGTEEFLQKLTSQITEMVSAKITQAKLQVPGGDSDEDSKTPSASPRHGRSRPSSSIQESSSESEDGDARGEIFDIYVVTADYLPLGAEQDAITLREGQYVEVLDAAHPLRWLVRTKPTKSSPSRQGWVSPAYLDRRLKLSPEWGAAEAPEFPGEAVSEDEYKARLSSVIQELLSSEQAFVEELQFLQSHHLQHLERCPHVPIAVAGQKAVIFRNVRDIGRFHSSFLQELQQCDTDDDVAMCFIKNQAAFEQYLEFLVGRVQAESVVVSTAIQEFYKKYAEEALLAGDPSQPPPPPLQHYLEQPVERVQRYQALLKELIRNKARNRQNCALLEQAYAVVSALPQRAENKLHVSLMENYPGTLQALGEPIRQGHFIVWEGAPGARMPWKGHNRHVFLFRNHLVICKPRRDSRTDTVSYVFRNMMKLSSIDLNDQVEGDDRAFEVWQEREDSVRKYLLQARTAIIKSSWVKEICGIQQRLALPVWRPPDFEEELADCTAELGETVKLACRVTGTPKPVISWYKDGKAVQVDPHHILIEDPDGSCALILDSLTGVDSGQYMCFAASAAGNCSTLGKILVQVPPRFVNKVRASPFVEGEDAQFTCTIEGAPYPQIRWYKDGALLTTGNKFQTLSEPRSGLLVLVIRAASKEDLGLYECELVNRLGSARASAELRIQSPMLQAQEQCHREQLVAAVEDTTLERADQEVTSVLKRLLGPKAPGPSTGDLTGPGPCPRGAPALQETGSQPPVTGTSEAPAVPPRVPQPLLHEGPEQEPEAIARAQEWTVPIRMEGAAWPGAGTGELLWDVHSHVVRETTQRTYTYQAIDTHTARPPSMQVTIEDVQAQTGGTAQFEAIIEGDPQPSVTWYKDSVQLVDSTRLSQQQEGTTYSLVLRHVASKDAGVYTCLAQNTGGQVLCKAELLVLGGDNEPDSEKQSHRRKLHSFYEVKEEIGRGVFGFVKRVQHKGNKILCAAKFIPLRSRTRAQAYRERDILAALSHPLVTGLLDQFETRKTLILILELCSSEELLDRLYRKGVVTEAEVKVYIQQLVEGLHYLHSHGVLHLDIKPSNILMVHPAREDIKICDFGFAQNITPAELQFSQYGSPEFVSPEIIQQNPVSEASDIWAMGVISYLSLTCSSPFAGESDRATLLNVLEGRVSWSSPMAAHLSEDAKDFIKATLQRAPQARPSAAQCLSHPWFLKSMPAEEAHFINTKQLKFLLARSRWQRSLMSYKSILVMRSIPELLRGPPDSPSLGVARHLCRDTGGSSSSSSSSDNELAPFARAKSLPPSPVTHSPLLHPRGFLRPSASLPEEAEASERSTEAPAPPASPEGAGPPAAQGCVPRHSVIRSLFYHQAGESPEHGALAPGSRRHPARRRHLLKGGYIAGALPGLREPLMEHRVLEEEAAREEQATLLAKAPSFETALRLPASGTHLAPGHSHSLEHDSPSTPRPSSEACGEAQRLPSAPSGGAPIRDMGHPQGSKQLPSTGGHPGTAQPERPSPDSPWGQPAPFCHPKQGSAPQEGCSPHPAVAPCPPGSFPPGSCKEAPLVPSSPFLGQPQAPPAPAKASPPLDSKMGPGDISLPGRPKPGPCSSPGSASQASSSQVSSLRVGSSQVGTEPGPSLDAEGWTQEAEDLSDSTPTLQRPQEQATMRKFSLGGRGGYAGVAGYGTFAFGGDAGGMLGQGPMWARIAWAVSQSEEEEQEEARAESQSEEQQEARAESPLPQVSARPVPEVGRAPTRSSPEPTPWEDIGQVSLVQIRDLSGDAEAADTISLDISEVDPAYLNLSDLYDIKYLPFEFMIFRKVPKSAQPEPPSPMAEEELAEFPEPTWPWPGELGPHAGLEITEESEDVDALLAEAAVGRKRKWSSPSRSLFHFPGRHLPLDEPAELGLRERVKASVEHISRILKGRPEGLEKEGPPRKKPGLASFRLSGLKSWDRAPTFLRELSDETVVLGQSVTLACQVSAQPAAQATWSKDGAPLESSSRVLISATLKNFQLLTILVVVAEDLGVYTCSVSNALGTVTTTGVLRKAERPSSSPCPDIGEVYADGVLLVWKPVESYGPVTYIVQCSLEGGSWTTLASDIFDCCYLTSKLSRGGTYTFRTACVSKAGMGPYSSPSEQVLLGGPSHLASEEESQGRSAQPLPSTKTFAFQTQIQRGRFSVVRQCWEKASGRALAAKIIPYHPKDKTAVLREYEALKGLRHPHLAQLHAAYLSPRHLVLILELCSGPELLPCLAERASYSESEVKDYLWQMLSATQYLHNQHILHLDLRSENMIITEYNLLKVVDLGNAQSLSQEKVLPSDKFKDYLETMAPELLEGQGAVPQTDIWAIGVTAFIMLSAEYPVSSEGARDLQRGLRKGLVRLSRCYAGLSGGAVAFLRSTLCAQPWGRPCASSCLQCPWLTEEGPACSRPAPVTFPTARLRVFVRNREKRRALLYKRHNLAQVR

SEQ ID NO: 59285 - protein, 7968 aa, Homo sapiens
  Payload ID: 11573
  Gene Symbol: OBSCN
  Gene Name: obscurin, cytoskeletal calmodulin and titin-interacting RhoGEF
  Uniprot ID: Q5VST9
  ENSP ID: ENSP00000409493
MDQPQFSGAPRFLTRPKAFVVSVGKDATLSCQIVGNPTPQVSWEKDQQPVAAGARFRLAQDGDLYRLTILDLALGDSGQYVCRARNAIGEAFAAVGLQVDAEAACAEQAPHFLLRPTSIRVREGSEATFRCRVGGSPRPAVSWSKDGRRLGEPDGPRVRVEELGEASALRIRAARPRDGGTYEVRAENPLGAASAAAALVVDSDAADTASRPGTSTAALLAHLQRRREAMRAEGAPASPPSTGTRTCTVTEGKHARLSCYVTGEPKPETVWKKDGQLVTEGRRHVVYEDAQENFVLKILFCKQSDRGLYTCTASNLVGQTYSSVLVVVREPAVPFKKRLQDLEVREKESATFLCEVPQPSTEAAWFKEETRLWASAKYGIEEEGTERRLTVRNVSADDDAVYICETPEGSRTVAELAVQGNLLRKLPRKTAVRVGDTAMFCVELAVPVGPVHWLRNQEEVVAGGRVAISAEGTRHTLTISQCCLEDVGQVAFMAGDCQTSTQFCVSAPRKPPLQPPVDPVVKARMESSVILSWSPPPHGERPVTIDGYLVEKKKLGTYTWIRCHEAEWVATPELTVADVAEEGNFQFRVSALNSFGQSPYLEFPGTVHLAPKLAVRTPLKAVQAVEGGEVTFSVDLTVASAGEWFLDGQALKASSVYEIHCDRTRHTLTIREVPASLHGAQLKFVANGIESSIRMEVRAAPGLTANKPPAAAAREVLARLHEEAQLLAELSDQAAAVTWLKDGRTLSPGPKYEVQASAGRRVLLVRDVARDDAGLYECVSRGGRIAYQLSVQGLARFLHKDMAGSCVDAVAGGPAQFECETSEAHVHVHWYKDGMELGHSGERFLQEDVGTRHRLVAATVTRQDEGTYSCRVGEDSVDFRLRVSEPKVVFAKEQLARRKLQAEAGASATLSCEVAQAQTEVTWYKDGKKLSSSSKVCMEATGCTRRLVVQQAGQADAGEYSCEAGGQRLSFHLDVKEPKVVFAKDQVAHSEVQAEAGASATLSCEVAQAQTEVMWYKDGKKLSSSLKVHVEAKGCRRRLVVQQAGKTDAGDYSCEARGQRVSFRLHITEPKMMFAKEQSVHNEVQAEAGASAMLSCEVAQAQTEVTWYKDGKKLSSSSKVGMEVKGCTRRLVLPQAGKADAGEYSCEAGGQRVSFHLHITEPKGVFAKEQSVHNEVQAEAGTTAMLSCEVAQPQTEVTWYKDGKKLSSSSKVRMEVKGCTRRLVVQQVGKADAGEYSCEAGGQRVSFQLHITEPKAVFAKEQLVHNEVRTEAGASATLSCEVAQAQTEVTWYKDGKKLSSSSKVRIEAAGCMRQLVVQQAGQADAGEYTCEAGGQRLSFHLDVSEPKAVFAKEQLAHRKVQAEAGAIATLSCEVAQAQTEVTWYKDGKKLSSSSKVRMEAVGCTRRLVVQQACQADTGEYSCEAGGQRLSFSLDVAEPKVVFAKEQPVHREVQAQAGASTTLSCEVAQAQTEVMWYKDGKKLSFSSKVRMEAVGCTRRLVVQQAGQAVAGEYSCEAGSQRLSFHLHVAEPKAVFAKEQPASREVQAEAGTSATLSCEVAQAQTEVTWYKDGKKLSSSSKVRMEAVGCTRRLVVQEAGQADAGEYSCKAGDQRLSFHLHVAEPKVVFAKEQPAHREVQAEAGASATLSCEVAQAQTEVTWYKDGKKLSSSSKVRVEAVGCTRRLVVQQAGQAEAGEYSCEAGGQQLSFRLQVAELEPQISERPCRREPLVVKEHEDIILTATLATPSAATVTWLKDGVEIRRSKRHETASQGDTHTLTVHGAQVLDSAIYSCRVGAEGQDFPVQVEEVAAKFCRLLEPVCGELGGTVTLACELSPACAEVVWRCGNTQLRVGKRFQMVAEGPVRSLTVLGLRAEDAGEYVCESRDDHTSAQLTVSVPRVVKFMSGLSTVVAEEGGEATFQCVVSPSDVAVVWFRDGALLQPSEKFAISQSGASHSLTISDLVLEDAGQITVEAEGASSSAALRVREAPVLFKKKLEPQTVEERSSVTLEVELTRPWPELRWTRNATALAPGKNVEIHAEGARHRLVLHNVGFADRGFFGCETPDDKTQAKLTVEMRQVRLVRGLQAVEAREQGTATMEVQLSHADVDGSWTRDGLRFQQGPTCHLAVRGPMHTLTLSGLRPEDSGLMVFKAEGVHTSARLVVTELPVSFSRPLQDVVTTEKEKVTLECELSRPNVDVRWLKDGVELRAGKTMAIAAQGACRSLTIYRCEFADQGVYVCDAHDAQSSASVKVQGRTYTLIYRRVLAEDAGEIQFVAENAESRAQLRVKELPVTLVRPLRDKIAMEKHRGVLECQVSRASAQVRWFKGSQELQPGPKYELVSDGLYRKLIISDVHAEDEDTYTCDAGDVKTSAQFFVEEQSITIVRGLQDVTVMEPAPAWFECETSIPSVRPPKWLLGKTVLQAGGNVGLEQEGTVHRLMLRRTCSTMTGPVHFTVGKSRSSARLVVSDIPVVLTRPLEPKTGRELQSVVLSCDFRPAPKAVQWYKDDTPLSPSEKFKMSLEGQMAELRILRLMPADAGVYRCQAGSAHSSTEVTVEAREVTVTGPLQDAEATEEGWASFSCELSHEDEEVEWSLNGMPLYNDSFHEISHKGRRHTLVLKSIQRADAGIVRASSLKVSTSARLEVRVKPVVFLKALDDLSAEERGTLALQCEVSDPEAHVVWRKDGVQLGPSDKYDFLHTAGTRGLVVHDVSPEDAGLYTCHVGSEETRARVRVHDLHVGITKRLKTMEVLEGESCSFECVLSHESASDPAMWTVGGKTVGSSSRFQATRQGRKYILVVREAAPSDAGEVVFSVRGLTSKASLIVRERPAAIIKPLEDQWVAPGEDVELRCELSRAGTPVHWLKDRKAIRKSQKYDVVCEGTMAMLVIRGASLKDAGEYTCEVEASKSTASLHVEEKANCFTEELTNLQVEEKGTAVFTCKTEHPAATVTWRKGLLELRASGKHQPSQEGLTLRLTISALEKADSDTYTCDIGQAQSRAQLLVQGRRVHIIEDLEDVDVQEGSSATFRCRISPANYEPVHWFLDKTPLHANELNEIDAQPGGYHVLTLRQLALKDSGTIYFEAGDQRASAALRVTEKPSVFSRELTDATITEGEDLTLVCETSTCDIPVCWTKDGKTLRGSARCQLSHEGHRAQLLITGATLQDSGRYKCEAGGACSSSIVRVHARPVRFQEALKDLEVLEGGAATLRCVLSSVAAPVKWCYGNNVLRPGDKYSLRQEGAMLELVVRNLRPQDSGRYSCSFGDQTTSATLTVTALPAQFIGKLRNKEATEGATATLRCELSKAAPVEWRKGSETLRDGDRYCLRQDGAMCELQIRGLAMVDAAEYSCVCGEERTSASLTIRPMPAHFIGRLRHQESIEGATATLRCELSKAAPVEWRKGRESLRDGDRHSLRQDGAVCELQICGLAVADAGEYSCVCGEERTSATLTVKALPAKFTEGLRNEEAVEGATAMLWCELSKVAPVEWRKGPENLRDGDRYILRQEGTRCELQICGLAMADAGEYLCVCGQERTSATLTIRALPARFIEDVKNQEAREGATAVLQCELNSAAPVEWRKGSETLRDGDRYSLRQDGTKCELQIRGLAMADTGEYSCVCGQERTSAMLTVRALPIKFTEGLRNEEATEGATAVLRCELSKMAPVEWWKGHETLRDGDRHSLRQDGARCELQIRGLVAEDAGEYLCMCGKERTSAMLTVRAMPSKFIEGLRNEEATEGDTATLWCELSKAAPVEWRKGHETLRDGDRHSLRQDGSRCELQIRGLAVVDAGEYSCVCGQERTSATLTVRALPARFIEDVKNQEAREGATAVLQCELSKAAPVEWRKGSETLRGGDRYSLRQDGTRCELQIHGLSVADTGEYSCVCGQERTSATLTVRAPQPVFREPLQSLQAEEGSTATLQCELSEPTATVVWSKGGLQLQANGRREPRLQGCTAELVLQDLQREDTGEYTCTCGSQATSATLTVTAAPVRFLRELQHQEVDEGGTAHLCCELSRAGASVEWRKGSLQLFPCAKYQMVQDGAAAELLVRGVEQEDAGDYTCDTGHTQSMASLSVRVPRPKFKTRLQSLEQETGDIARLCCQLSDAESGAVVQWLKEGVELHAGPKYEMRSQGATRELLIHQLEAKDTGEYACVTGGQKTAASLRVTEPEVTIVRGLVDAEVTADEDVEFSCEVSRAGATGVQWCLQGLPLQSNEVTEVAVRDGRIHTLRLKGVTPEDAGTVSFHLGNHASSAQLTVRAPEVTILEPLQDVQLSEGQDASFQCRLSRASGQEARWALGGVPLQANEMNDITVEQGTLHLLTLHKVTLEDAGTVSFHVGTCSSEAQLKVTAKNTVVRGLENVEALEGGEALFECQLSQPEVAAHTWLLDDEPVHTSENAEVVFFENGLRHLLLLKNLRPQDSCRVTFLAGDMVTSAFLTVRGWRLEILEPLKNAAVRAGAQACFTCTLSEAVPVGEASWYINGAAVQPDDSDWTVTADGSHHALLLRSAQPHHAGEVTFACRDAVASARLTVLGLPDPPEDAEVVARSSHTVTLSWAAPMSDGGGGLCGYRVEVKEGATGQWRLCHELVPGPECVVDGLAPGETYRFRVAAVGPVGAGEPVHLPQTVRLAEPPKPVPPQPSAPESRQVAAGEDVSLELEVVAEAGEVIWHKGMERIQPGGRFEVVSQGRQQMLVIKGFTAEDQGEYHCGLAQGSICPAAATFQVALSPASVDEAPQPSLPPEAAQEGDLHLLWEALARKRRMSREPTLDSISELPEEDGRSQRLPQEAEEVAPDLSEGYSTADELARTGDADLSHTSSDDESRAGTPSLVTYLKKAGRPGTSPLASKVGAPAAPSVKPQQQQEPLAAVRPPLGDLSTKDLGDPSMDKAAVKIQAAFKGYKVRKEMKQQEGPMFSHTFGDTEAQVGDALRLECVVASKADVRARWLKDGVELTDGRHHHIDQLGDGTCSLLITGLDRADAGCYTCQVSNKFGQVTHSACVVVSGSESEAESSSGGELDDAFRRAARRLHRLFRTKSPAEVSDEELFLSADEGPAEPEEPADWQTYREDEHFICIRFEALTEARQAVTRFQEMFATLGIGVEIKLVEQGPRRVEMCISKETPAPVVPPEPLPSLLTSDAAPVFLTELQNQEVQDGYPVSFDCVVTGQPMPSVRWFKDGKLLEEDDHYMINEDQQGGHQLIITAVVPADMGVYRCLAENSMGVSSTKAELRVDLTSTDYDTAADATESSSYFSAQGYLSSREQEGTESTTDEGQLPQVVEELRDLQVAPGTRLAKFQLKVKGYPAPRLYWFKDGQPLTASAHIRMTDKKILHTLEIISVTREDSGQYAAYISNAMGAAYSSARLLVRGPDEPEEKPASDVHEQLVPPRMLERFTPKKVKKGSSITFSVKVEGRPVPTVHWLREEAERGVLWIGPDTPGYTVASSAQQHSLVLLDVGRQHQGTYTCIASNAAGQALCSASLHVSGLPKVEEQEKVKEALISTFLQGTTQAISAQGLETASFADLGGQRKEEPLAAKEALGHLSLAEVGTEEFLQKLTSQITEMVSAKITQAKLQVPGGDSDEDSKTPSASPRHGRSRPSSSIQESSSESEDGDARGEIFDIYVVTADYLPLGAEQDAITLREGQYVEVLDAAHPLRWLVRTKPTKSSPSRQGWVSPAYLDRRLKLSPEWGAAEAPEFPGEAVSEDEYKARLSSVIQELLSSEQAFVEELQFLQSHHLQHLERCPHVPIAVAGQKAVIFRNVRDIGRFHSSFLQELQQCDTDDDVAMCFIKNQAAFEQYLEFLVGRVQAESVVVSTAIQEFYKKYAEEALLAGDPSQPPPPPLQHYLEQPVERVQRYQALLKELIRNKARNRQNCALLEQAYAVVSALPQRAENKLHVSLMENYPGTLQALGEPIRQGHFIVWEGAPGARMPWKGHNRHVFLFRNHLVICKPRRDSRTDTVSYVFRNMMKLSSIDLNDQVEGDDRAFEVWQEREDSVRKYLLQARTAIIKSSWVKEICGIQQRLALPVWRPPDFEEELADCTAELGETVKLACRVTGTPKPVISWYKDGKAVQVDPHHILIEDPDGSCALILDSLTGVDSGQYMCFAASAAGNCSTLGKILVQVPPRFVNKVRASPFVEGEDAQFTCTIEGAPYPQIRWYKDGALLTTGNKFQTLSEPRSGLLVLVIRAASKEDLGLYECELVNRLGSARASAELRIQSPMLQAQEQCHREQLVAAVEDTTLERADQEVTSVLKRLLGPKAPGPSTGDLTGPGPCPRGAPALQETGSQPPVTGTSEAPAVPPRVPQPLLHEGPEQEPEAIARAQEWTVPIRMEGAAWPGAGTGELLWDVHSHVVRETTQRTYTYQAIDTHTARPPSMQVTIEDVQAQTGGTAQFEAIIEGDPQPSVTWYKDSVQLVDSTRLSQQQEGTTYSLVLRHVASKDAGVYTCLAQNTGGQVLCKAELLVLGGDNEPDSEKQSHRRKLHSFYEVKEEIGRGVFGFVKRVQHKGNKILCAAKFIPLRSRTRAQAYRERDILAALSHPLVTGLLDQFETRKTLILILELCSSEELLDRLYRKGVVTEAEVKVYIQQLVEGLHYLHSHGVLHLDIKPSNILMVHPAREDIKICDFGFAQNITPAELQFSQYGSPEFVSPEIIQQNPVSEASDIWAMGVISYLSLTCSSPFAGESDRATLLNVLEGRVSWSSPMAAHLSEDAKDFIKATLQRAPQARPSAAQCLSHPWFLKSMPAEEAHFINTKQLKFLLARSRWQRSLMSYKSILVMRSIPELLRGPPDSPSLGVARHLCRDTGGSSSSSSSSDNELAPFARAKSLPPSPVTHSPLLHPRGFLRPSASLPEEAEASERSTEAPAPPASPEGAGPPAAQGCVPRHSVIRSLFYHQAGESPEHGALAPGSRRHPARRRHLLKGGYIAGALPGLREPLMEHRVLEEEAAREEQATLLAKAPSFETALRLPASGTHLAPGHSHSLEHDSPSTPRPSSEACGEAQRLPSAPSGGAPIRDMGHPQGSKQLPSTGGHPGTAQPERPSPDSPWGQPAPFCHPKQGSAPQEGCSPHPAVAPCPPGSFPPGSCKEAPLVPSSPFLGQPQAPPAPAKASPPLDSKMGPGDISLPGRPKPGPCSSPGSASQASSSQVSSLRVGSSQVGTEPGPSLDAEGWTQEAEDLSDSTPTLQRPQEQATMRKFSLGGRGGYAGVAGYGTFAFGGDAGGMLGQGPMWARIAWAVSQSEEEEQEEARAESQSEEQQEARAESPLPQVSARPVPEVGRAPTRSSPEPTPWEDIGQVSLVQIRDLSGDAEAADTISLDISEVDPAYLNLSDLYDIKYLPFEFMIFRKVPKSAQPEPPSPMAEEELAEFPEPTWPWPGELGPHAGLEITEESEDVDALLAEAAVGRKRKWSSPSRSLFHFPGRHLPLDEPAELGLRERVKASVEHISRILKGRPEGLEKEGPPRKKPGLASFRLSGLKSWDRAPTFLRELSDETVVLGQSVTLACQVSAQPAAQATWSKDGAPLESSSRVLISATLKNFQLLTILVVVAEDLGVYTCSVSNALGTVTTTGVLRKAERPSSSPCPDIGEVYADGVLLVWKPVESYGPVTYIVQCSLEGGSWTTLASDIFDCCYLTSKLSRGGTYTFRTACVSKAGMGPYSSPSEQVLLGGPSHLASEEESQGRSAQPLPSTKTFAFQTQIQRGRFSVVRQCWEKASGRALAAKIIPYHPKDKTAVLREYEALKGLRHPHLAQLHAAYLSPRHLVLILELCSGPELLPCLAERASYSESEVKDYLWQMLSATQYLHNQHILHLDLRSENMIITEYNLLKVVDLGNAQSLSQEKVLPSDKFKDYLETMAPELLEGQGAVPQTDIWAIGVTAFIMLSAEYPVSSEGARDLQRGLRKGLVRLSRCYAGLSGGAVAFLRSTLCAQPWGRPCASSCLQCPWLTEEGPACSRPAPVTFPTARLRVFVRNREKRRALLYKRHNLAQVR

SEQ ID NO: 59286 - protein, 68 aa, Homo sapiens
  Payload ID: 11573
  Gene Symbol: OBSCN
  Gene Name: obscurin, cytoskeletal calmodulin and titin-interacting RhoGEF
  ENSP ID: ENSP00000455500
  MOD_RES (1)..(1): Any amino acid
XGSSSWLQWKSLSKRLKSPRKPSSCKCRRVPNLPSDCSASCMPLTCLDHACVAQPPACCLSAHITCTL

SEQ ID NO: 59287 - protein, 8923 aa, Homo sapiens
  Payload ID: 11573
  Gene Symbol: OBSCN
  Gene Name: obscurin, cytoskeletal calmodulin and titin-interacting RhoGEF
  ENSP ID: ENSP00000455507
MDQPQFSGAPRFLTRPKAFVVSVGKDATLSCQIVGNPTPQVSWEKDQQPVAAGARFRLAQDGDLYRLTILDLALGDSGQYVCRARNAIGEAFAAVGLQVDAEAACAEQAPHFLLRPTSIRVREGSEATFRCRVGGSPRPAVSWSKDGRRLGEPDGPRVRVEELGEASALRIRAARPRDGGTYEVRAENPLGAASAAAALVVDSDAADTASRPGTSTAALLAHLQRRREAMRAEGAPASPPSTGTRTCTVTEGKHARLSCYVTGEPKPETVWKKDGQLVTEGRRHVVYEDAQENFVLKILFCKQSDRGLYTCTASNLVGQTYSSVLVVVREPAVPFKKRLQDLEVREKESATFLCEVPQPSTEAAWFKEETRLWASAKYGIEEEGTERRLTVRNVSADDDAVYICETPEGSRTVAELAVQGNLLRKLPRKTAVRVGDTAMFCVELAVPVGPVHWLRNQEEVVAGGRVAISAEGTRHTLTISQCCLEDVGQVAFMAGDCQTSTQFCVSAPRKPPLQPPVDPVVKARMESSVILSWSPPPHGERPVTIDGYLVEKKKLGTYTWIRCHEAEWVATPELTVADVAEEGNFQFRVSALNSFGQSPYLEFPGTVHLAPKLAVRTPLKAVQAVEGGEVTFSVDLTVASAGEWFLDGQALKASSVYEIHCDRTRHTLTIREVPASLHGAQLKFVANGIESSIRMEVRAAPGLTANKPPAAAAREVLARLHEEAQLLAELSDQAAAVTWLKDGRTLSPGPKYEVQASAGRRVLLVRDVARDDAGLYECVSRGGRIAYQLSVQGLARFLHKDMAGSCVDAVAGGPAQFECETSEAHVHVHWYKDGMELGHSGERFLQEDVGTRHRLVAATVTRQDEGTYSCRVGEDSVDFRLRVSEPKAVFAKEQPACREVQAEVGASATLSCEVAQDQMEVTWYKDGKKLSSSSKVHVEAVGCMRRLVVQQVGQADSGEYSCEARGQRVSFRLDVAEPKVVFAKEQLARRKLQAEAGASATLSCEVAQAQTEVTWYKDGKKLSSSSKVCMEATGCTRRLVVQQAGQADAGEYSCEAGGQRLSFHLDVKEPKVVFAKDQVAHSEVQAEAGASATLSCEVAQAQTEVMWYKDGKKLSSSLKVHVEAKGCRRRLVVQQAGKTDAGDYSCEARGQRVSFRLHITEPKMMFAKEQSVHNEVQAEAGASAMLSCEVAQAQTEVTWYKDGKKLSSSSKVGMEVKGCTRRLVLPQAGKADAGEYSCEAGGQRVSFHLHITEPKGVFAKEQSVHNEVQAEAGTTAMLSCEVAQPQTEVTWYKDGKKLSSSSKVRMEVKGCTRRLVVQQVGKADAGEYSCEAGGQRVSFQLHITEPKAVFAKEQLVHNEVRTEAGASATLSCEVAQAQTEVTWYKDGKKLSSSSKVRIEAAGCMRQLVVQQAGQADAGEYTCEAGGQRLSFHLDVSEPKAVFAKEQLAHRKVQAEAGAIATLSCEVAQAQTEVTWYKDGKKLSSSSKVRMEAVGCTRRLVVQQACQADTGEYSCEAGGQRLSFSLDVAEPKVVFAKEQPVHREVQAQAGASTTLSCEVAQAQTEVMWYKDGKKLSFSSKVRMEAVGCTRRLVVQQAGQAVAGEYSCEAGSQRLSFHLHVAEPKAVFAKEQPAHREVQAEAGASATLSCEVAQAQTEVTWYKDGKKLSSSLKVHVEAAGCTRRLVVQQAGQADTGEYSCEAGGQQLSFRLQVAEPKAVFAKEQPASREVQAEAGTSATLSCEVAQAQTEVTWYKDGKKLSSSSKVRMEAVGCTRRLVVQEAGQADAGEYSCKAGDQRLSFHLHVAEPKVVFAKEQPAHREVQAEAGASATLSCEVAQAQTEVTWYKDGKKLSSSSKVRVEAVGCTRRLVVQQAGQAEAGEYSCEAGGQQLSFRLQVAEPKAVFAKEQVVFAKDQPVHREVQAEAGTSTMLSCEVAQAQTEVMWYKDGKKLSSSSKMRVEAVGCTRRLVVQEAGQADAGEYSCEAGGQRLSFHLHVAEPKVVFAKEQPACREVQAEAGASATLSCEVAQGQMEVTWYKDGKKLSSSSKVHMEASGYTRRLVVQQAGQADAGEYSCEAGGQRLSFRLHVAELEPQISERPCRREPLVVKEHEDIILTATLATPSAATVTWLKDGVEIRRSKRHETASQGDTHTLTVHGAQVLDSAIYSCRVGAEGQDFPVQVEEVAAKFCRLLEPVCGELGGTVTLACELSPACAEVVWRCGNTQLRVGKRFQMVAEGPVRSLTVLGLRAEDAGEYVCESRDDHTSAQLTVSVPRVVKFMSGLSTVVAEEGGEATFQCVVSPSDVAVVWFRDGALLQPSEKFAISQSGASHSLTISDLVLEDAGQITVEAEGASSSAALRVREAPVLFKKKLEPQTVEERSSVTLEVELTRPWPELRWTRNATALAPGKNVEIHAEGARHRLVLHNVGFADRGFFGCETPDDKTQAKLTVEMRQVRLVRGLQAVEAREQGTATMEVQLSHADVDGSWTRDGLRFQQGPTCHLAVRGPMHTLTLSGLRPEDSGLMVFKAEGVHTSARLVVTELPVSFSRPLQDVVTTEKEKVTLECELSRPNVDVRWLKDGVELRAGKTMAIAAQGACRSLTIYRCEFADQGVYVCDAHDAQSSASVKVQGRNIQIVRPLEDVEVMEKDGATFSCEVSHDEVPGQWFWEGSKLRPTDNVRIRQEGRTYTLIYRRVLAEDAGEIQFVAENAESRAQLRVKELPVTLVRPLRDKIAMEKHRGVLECQVSRASAQVRWFKGSQELQPGPKYELVSDGLYRKLIISDVHAEDEDTYTCDAGDVKTSAQFFVEEQSITIVRGLQDVTVMEPAPAWFECETSIPSVRPPKWLLGKTVLQAGGNVGLEQEGTVHRLMLRRTCSTMTGPVHFTVGKSRSSARLVVSDIPVVLTRPLEPKTGRELQSVVLSCDFRPAPKAVQWYKDDTPLSPSEKFKMSLEGQMAELRILRLMPADAGVYRCQAGSAHSSTEVTVEAREVTVTGPLQDAEATEEGWASFSCELSHEDEEVEWSLNGMPLYNDSFHEISHKGRRHTLVLKSIQRADAGIVRASSLKVSTSARLEVRVKPVVFLKALDDLSAEERGTLALQCEVSDPEAHVVWRKDGVQLGPSDKYDFLHTAGTRGLVVHDVSPEDAGLYTCHVGSEETRARVRVHDLHVGITKRLKTMEVLEGESCSFECVLSHESASDPAMWTVGGKTVGSSSRFQATRQGRKYILVVREAAPSDAGEVVFSVRGLTSKASLIVRERPAAIIKPLEDQWVAPGEDVELRCELSRAGTPVHWLKDRKAIRKSQKYDVVCEGTMAMLVIRGASLKDAGEYTCEVEASKSTASLHVEEKANCFTEELTNLQVEEKGTAVFTCKTEHPAATVTWRKGLLELRASGKHQPSQEGLTLRLTISALEKADSDTYTCDIGQAQSRAQLLVQGRRVHIIEDLEDVDVQEGSSATFRCRISPANYEPVHWFLDKTPLHANELNEIDAQPGGYHVLTLRQLALKDSGTIYFEAGDQRASAALRVTEKPSVFSRELTDATITEGEDLTLVCETSTCDIPVCWTKDGKTLRGSARCQLSHEGHRAQLLITGATLQDSGRYKCEAGGACSSSIVRVHARPVRFQEALKDLEVLEGGAATLRCVLSSVAAPVKWCYGNNVLRPGDKYSLRQEGAMLELVVRNLRPQDSGRYSCSFGDQTTSATLTVTALPAQFIGKLRNKEATEGATATLRCELSKAAPVEWRKGSETLRDGDRYCLRQDGAMCELQIRGLAMVDAAEYSCVCGEERTSASLTIRPMPAHFIGRLRHQESIEGATATLRCELSKAAPVEWRKGRESLRDGDRHSLRQDGAVCELQICGLAVADAGEYSCVCGEERTSATLTVKALPAKFTEGLRNEEAVEGATAMLWCELSKVAPVEWRKGPENLRDGDRYILRQEGTRCELQICGLAMADAGEYLCVCGQERTSATLTIRALPARFIEDVKNQEAREGATAVLQCELNSAAPVEWRKGSETLRDGDRYSLRQDGTKCELQIRGLAMADTGEYSCVCGQERTSAMLTVRALPIKFTEGLRNEEATEGATAVLRCELSKMAPVEWWKGHETLRDGDRHSLRQDGARCELQIRGLVAEDAGEYLCMCGKERTSAMLTVRAMPSKFIEGLRNEEATEGDTATLWCELSKAAPVEWRKGHETLRDGDRHSLRQDGSRCELQIRGLAVVDAGEYSCVCGQERTSATLTVRALPARFIEDVKNQEAREGATAVLQCELSKAAPVEWRKGSETLRGGDRYSLRQDGTRCELQIHGLSVADTGEYSCVCGQERTSATLTVRALPARFTQDLKTKEASEGATATLQCELSKVAPVEWKKGPETLRDGGRYSLKQDGTRCELQIHDLSVADAGEYSCMCGQERTSATLTVRALPARFTEGLRNEEAMEGATATLQCELSKAAPVEWRKGLEALRDGDKYSLRQDGAVCELQIHGLAMADNGVYSCVCGQERTSATLTVRALPARFIEDMRNQKATEGATVTLQCKLRKAAPVEWRKGPNTLKDGDRYSLKQDGTSCELQIRGLVIADAGEYSCICEQERTSATLTVRALPARFIEDVRNHEATEGATAVLQCELSKAAPVEWRKGSETLRDGDRYSLRQDGTRCELQIRGLAVEDTGEYLCVCGQERTSATLTVRALPARFIDNMTNQEAREGATATLHCELSKVAPVEWRKGPETLRDGDRHSLRQDGTRCELQIRGLSVADAGEYSCVCGQERTSATLTIRALPAKFTKGLRNEEATEGATAMLQCELSKVAPVEWRKGPETLRDGDRYNLRQDGTRCELQIHGLSVADTGEYSCVCGQEKTSATLTVKAPQPVFREPLQSLQAEEGSTATLQCELSEPTATVVWSKGGLQLQANGRREPRLQGCTAELVLQDLQREDTGEYTCTCGSQATSATLTVTAAPVRFLRELQHQEVDEGGTAHLCCELSRAGASVEWRKGSLQLFPCAKYQMVQDGAAAELLVRGVEQEDAGDYTCDTGHTQSMASLSVRVPRPKFKTRLQSLEQETGDIARLCCQLSDAESGAVVQWLKEGVELHAGPKYEMRSQGATRELLIHQLEAKDTGEYACVTGGQKTAASLRVTEPEVTIVRGLVDAEVTADEDVEFSCEVSRAGATGVQWCLQGLPLQSNEVTEVAVRDGRIHTLRLKGVTPEDAGTVSFHLGNHASSAQLTVRAPEVTILEPLQDVQLSEGQDASFQCRLSRASGQEARWALGGVPLQANEMNDITVEQGTLHLLTLHKVTLEDAGTVSFHVGTCSSEAQLKVTAKNTVVRGLENVEALEGGEALFECQLSQPEVAAHTWLLDDEPVHTSENAEVVFFENGLRHLLLLKNLRPQDSCRVTFLAGDMVTSAFLTVRGWRLEILEPLKNAAVRAGAQACFTCTLSEAVPVGEASWYINGAAVQPDDSDWTVTADGSHHALLLRSAQPHHAGEVTFACRDAVASARLTVLGLPDPPEDAEVVARSSHTVTLSWAAPMSDGGGGLCGYRVEVKEGATGQWRLCHELVPGPECVVDGLAPGETYRFRVAAVGPVGAGEPVHLPQTVRLAEPPKPVPPQPSAPESRQVAAGEDVSLELEVVAEAGEVIWHKGMERIQPGGRFEVVSQGRQQMLVIKGFTAEDQGEYHCGLAQGSICPAAATFQVALSPASVDEAPQPSLPPEAAQEGDLHLLWEALARKRRMSREPTLDSISELPEEDGRSQRLPQEAEEVAPDLSEGYSTADELARTGDADLSHTSSDDESRAGTPSLVTYLKKAGRPGTSPLASKVGAPAAPSVKPQQQQEPLAAVRPPLGDLSTKDLGDPSMDKAAVKIQAAFKGYKVRKEMKQQEGPMFSHTFGDTEAQVGDALRLECVVASKADVRARWLKDGVELTDGRHHHIDQLGDGTCSLLITGLDRADAGCYTCQVSNKFGQVTHSACVVVSGSESEAESSSGGELDDAFRRAARRLHRLFRTKSPAEVSDEELFLSADEGPAEPEEPADWQTYREDEHFICIRFEALTEARQAVTRFQEMFATLGIGVEIKLVEQGPRRVEMCISKETPAPVVPPEPLPSLLTSDAAPVFLTELQNQEVQDGYPVSFDCVVTGQPMPSVRWFKDGKLLEEDDHYMINEDQQGGHQLIITAVVPADMGVYRCLAENSMGVSSTKAELRVDLTSTDYDTAADATESSSYFSAQGYLSSREQEGTESTTDEGQLPQVVEELRDLQVAPGTRLAKFQLKVKGYPAPRLYWFKDGQPLTASAHIRMTDKKILHTLEIISVTREDSGQYAAYISNAMGAAYSSARLLVRGPDEPEEKPASDVHEQLVPPRMLERFTPKKVKKGSSITFSVKVEGRPVPTVHWLREEAERGVLWIGPDTPGYTVASSAQQHSLVLLDVGRQHQGTYTCIASNAAGQALCSASLHVSGLPKVEEQEKVKEALISTFLQGTTQAISAQGLETASFADLGGQRKEEPLAAKEALGHLSLAEVGTEEFLQKLTSQITEMVSAKITQAKLQVPGGDSDEDSKTPSASPRHGRSRPSSSIQESSSESEDGDARGEIFDIYVVTADYLPLGAEQDAITLREGQYVEVLDAAHPLRWLVRTKPTKSSPSRQGWVSPAYLDRRLKLSPEWGAAEAPEFPGEAVSEDEYKARLSSVIQELLSSEQAFVEELQFLQSHHLQHLERCPHVPIAVAGQKAVIFRNVRDIGRFHSSFLQELQQCDTDDDVAMCFIKNQAAFEQYLEFLVGRVQAESVVVSTAIQEFYKKYAEEALLAGDPSQPPPPPLQHYLEQPVERVQRYQALLKELIRNKARNRQNCALLEQAYAVVSALPQRAENKLHVSLMENYPGTLQALGEPIRQGHFIVWEGAPGARMPWKGHNRHVFLFRNHLVICKPRRDSRTDTVSYVFRNMMKLSSIDLNDQVEGDDRAFEVWQEREDSVRKYLLQARTAIIKSSWVKEICGIQQRLALPVWRPPDFEEELADCTAELGETVKLACRVTGTPKPVISWYKDGKAVQVDPHHILIEDPDGSCALILDSLTGVDSGQYMCFAASAAGNCSTLGKILVQVPPRFVNKVRASPFVEGEDAQFTCTIEGAPYPQIRWYKDGALLTTGNKFQTLSEPRSGLLVLVIRAASKEDLGLYECELVNRLGSARASAELRIQSPMLQAQEQCHREQLVAAVEDTTLERADQEVTSVLKRLLGPKAPGPSTGDLTGPGPCPRGAPALQETGSQPPVTGTSEAPAVPPRVPQPLLHEGPEQEPEAIARAQEWTVPIRMEGAAWPGAGTGELLWDVHSHVVRETTQRTYTYQAIDTHTARPPSMQVTIEDVQAQTGGTAQFEAIIEGDPQPSVTWYKDSVQLVDSTRLSQQQEGTTYSLVLRHVASKDAGVYTCLAQNTGGQVLCKAELLVLGGDNEPDSEKQSHRRKLHSFYEVKEEIGRGVFGFVKRVQHKGNKILCAAKFIPLRSRTRAQAYRERDILAALSHPLVTGLLDQFETRKTLILILELCSSEELLDRLYRKGVVTEAEVKVYIQQLVEGLHYLHSHGVLHLDIKPSNILMVHPAREDIKICDFGFAQNITPAELQFSQYGSPEFVSPEIIQQNPVSEASDIWAMGVISYLSLTCSSPFAGESDRATLLNVLEGRVSWSSPMAAHLSEDAKDFIKATLQRAPQARPSAAQCLSHPWFLKSMPAEEAHFINTKQLKFLLARSRWQRSLMSYKSILVMRSIPELLRGPPDSPSLGVARHLCRDTGGSSSSSSSSDNELAPFARAKSLPPSPVTHSPLLHPRGFLRPSASLPEEAEASERSTEAPAPPASPEGAGPPAAQGCVPRHSVIRSLFYHQAGESPEHGALAPGSRRHPARRRHLLKGGYIAGALPGLREPLMEHRVLEEEAAREEQATLLAKAPSFETALRLPASGTHLAPGHSHSLEHDSPSTPRPSSEACGEAQRLPSAPSGGAPIRDMGHPQGSKQLPSTGGHPGTAQPERPSPDSPWGQPAPFCHPKQGSAPQEGCSPHPAVAPCPPGSFPPGSCKEAPLVPSSPFLGQPQAPPAPAKASPPLDSKMGPGDISLPGRPKPGPCSSPGSASQASSSQVSSLRVGSSQVGTEPGPSLDAEGWTQEAEDLSDSTPTLQRPQEQATMRKFSLGGRGGYAGVAGYGTFAFGGDAGGMLGQGPMWARIAWAVSQSEEEEQEEARAESQSEEQQEARAESPLPQVSARPVPEVGRAPTRSSPEPTPWEDIGQVSLVQIRDLSGDAEAADTISLDISEVDPAYLNLSDLYDIKYLPFEFMIFRKVPKSAQPEPPSPMAEEELAEFPEPTWPWPGELGPHAGLEITEESEDVDALLAEAAVGRKRKWSSPSRSLFHFPGRHLPLDEPAELGLRERVKASVEHISRILKGRPEGLEKEGPPRKKPGLASFRLSGLKSWDRAPTFLRELSDETVVLGQSVTLACQVSAQPAAQATWSKDGAPLESSSRVLISATLKNFQLLTILVVVAEDLGVYTCSVSNALGTVTTTGVLRKAERPSSSPCPDIGEVYADGVLLVWKPVESYGPVTYIVQCSLEGGSWTTLASDIFDCCYLTSKLSRGGTYTFRTACVSKAGMGPYSSPSEQVLLGGPSHLASEEESQGRSAQPLPSTKTFAFQTQIQRGRFSVVRQCWEKASGRALAAKIIPYHPKDKTAVLREYEALKGLRHPHLAQLHAAYLSPRHLVLILELCSGPELLPCLAERASYSESEVKDYLWQMLSATQYLHNQHILHLDLRSENMIITEYNLLKVVDLGNAQSLSQEKVLPSDKFKDYLETMELLEGQGAVPQTDIWAIGVTAFIMLSAEYPVSSEGARDLQRGLRKGLVRLSRCYAGLSGGAVAFLRSTLCAQPWGRPCASSCLQCPWLTEEGPACSRPAPVTFPTARLRVFVRNREKRRALLYKRHNLAQVR

SEQ ID NO: 59288 - protein, 1593 aa, Homo sapiens
  Payload ID: 11573
  Gene Symbol: OBSCN
  Gene Name: obscurin, cytoskeletal calmodulin and titin-interacting RhoGEF
  ENSP ID: ENSP00000455688
  MOD_RES (1)..(1): Any amino acid
XRARVRVHDLHVGITKRLKTMEVLEGESCSFECVLSHESASDPAMWTVGGKTVGSSSRFQATRQGRKYILVVREAAPSDAGEVVFSVRGLTSKASLIVRERPAAIIKPLEDQWVAPGEDVELRCELSRAGTPVHWLKDRKAIRKSQKYDVVCEGTMAMLVIRGASLKDAGEYTCEVEASKSTASLHVEEKANCFTEELTNLQVEEKGTAVFTCKTEHPAATVTWRKGLLELRASGKHQPSQEGLTLRLTISALEKADSDTYTCDIGQAQSRAQLLVQGRRVHIIEDLEDVDVQEGSSATFRCRISPANYEPVHWFLDKTPLHANELNEIDAQPGGYHVLTLRQLALKDSGTIYFEAGDQRASAALRVTEKPSVFSRELTDATITEGEDLTLVCETSTCDIPVCWTKDGKTLRGSARCQLSHEGHRAQLLITGATLQDSGRYKCEAGGACSSSIVRVHARPVRFQEALKDLEVLEGGAATLRCVLSSVAAPVKWCYGNNVLRPGDKYSLRQEGAMLELVVRNLRPQDSGRYSCSFGDQTTSATLTVTALPAQFIGKLRNKEATEGATATLRCELSKAAPVEWRKGSETLRDGDRYCLRQDGAMCELQIRGLAMVDAAEYSCVCGEERTSASLTIRPMPAHFIGRLRHQESIEGATATLRCELSKAAPVEWRKGRESLRDGDRHSLRQDGAVCELQICGLAVADAGEYSCVCGEERTSATLTVKALPAKFTEGLRNEEAVEGATAMLWCELSKVAPVEWRKGPENLRDGDRYILRQEGTRCELQICGLAMADAGEYLCVCGQERTSATLTIRALPARFIEDVKNQEAREGATAVLQCELNSAAPVEWRKGSETLRDGDRYSLRQDGTKCELQIRGLAMADTGEYSCVCGQERTSAMLTVRALPIKFTEGLRNEEATEGATAVLRCELSKMAPVEWWKGHETLRDGDRHSLRQDGARCELQIRGLVAEDAGEYLCMCGKERTSAMLTVRAMPSKFIEGLRNEEATEGDTATLWCELSKAAPVEWRKGHETLRDGDRHSLRQDGSRCELQIRGLAVVDAGEYSCVCGQERTSATLTVRALPARFIEDVKNQEAREGATAVLQCELSKAAPVEWRKGSETLRGGDRYSLRQDGTRCELQIHGLSVADTGEYSCVCGQERTSATLTVRALPARFTQDLKTKEASEGATATLQCELSKVAPVEWKKGPETLRDGGRYSLKQDGTRCELQIHDLSVADAGEYSCMCGQERTSATLTVRALPARFTEGLRNEEAMEGATATLQCELSKAAPVEWRKGLEALRDGDKYSLRQDGAVCELQIHGLAMADNGVYSCVCGQERTSATLTVRALPARFIEDMRNQKATEGATVTLQCKLRKAAPVEWRKGPNTLKDGDRYSLKQDGTSCELQIRGLVIADAGEYSCICEQERTSATLTVRALPARFIEDVRNHEATEGATAVLQCELSKAAPVEWRKGSETLRDGDRYSLRQDGTRCELQIRGLAVEDTGEYLCVCGQERTSATLTVRALPARFIDNMTNQEAREGATATLHCELSKVAPVEWRKGPETLRDGDRHSLRQENCLNPGGRGCSEPRSCHCTPAWVIEQ

SEQ ID NO: 59289 - protein, 612 aa, Homo sapiens
  Payload ID: 11574
  Gene Symbol: OBSL1
  Gene Name: obscurin-like 1
  ENSP ID: ENSP00000289656
MRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDRVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTESYQSQDSSNNNPELCVLLKKPKTRRLWSRFPPWRRTAGTE

SEQ ID NO: 59290 - protein, 1025 aa, Homo sapiens
  Payload ID: 11574
  Gene Symbol: OBSL1
  Gene Name: obscurin-like 1
  Uniprot ID: O75147
  ENSP ID: ENSP00000362980
MKASSGDQGSPPCFLRFPRPVRVVSGAEAELKCVVLGEPPPVVVWEKGGQQLAASERLSFPADGAEHGLLLTAALPTDAGVYVCRARNAAGEAYAAAAVTVLEPPASDPELQPAERPLPSPGSGEGAPVFLTGPRSQWVLRGAEVVLTCRAGGLPEPTLYWEKDGMALDEVWDSSHFALQPGRAEDGPGASLALRILAARLPDSGVYVCHARNAHGHAQAGALLQVHQPPESPPADPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDRVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTESYQSQDSSNNNPELCVLLKKPKTRRLWSRFPPWRRTAGTE

SEQ ID NO: 59291 - protein, 1804 aa, Homo sapiens
  Payload ID: 11574
  Gene Symbol: OBSL1
  Gene Name: obscurin-like 1
  ENSP ID: ENSP00000362983
MKASSGDQGSPPCFLRFPRPVRVVSGAEAELKCVVLGEPPPVVVWEKGGQQLAASERLSFPADGAEHGLLLTAALPTDAGVYVCRARNAAGEAYAAAAVTVLEPPASDPELQPAERPLPSPGSGEGAPVFLTGPRSQWVLRGAEVVLTCRAGGLPEPTLYWEKDGMALDEVWDSSHFALQPGRAEDGPGASLALRILAARLPDSGVYVCHARNAHGHAQAGALLQVHQPPESPPADPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDRVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTEPPVRIIYPRDEVTLIAVTLECVVLMCELSREDAPVRWYKDGLEVEESEALVLERDGPRCRLVLPAAQPEDGGEFVCDAGDDSAFFTVTVTAPPERIVHPAARSLDLHFGAPGRVELRCEVAPAGSQVRWYKDGLEVEASDALQLGAEGPTRTLTLPHAQPEDAGEYVCETRHEAITFNVILAEPPVQFLALETTPSPLCVAPGEPVVLSCELSRAGAPVVWSHNGRPVQEGEGLELHAEGPRRVLCIQAAGPAHAGLYTCQSGAAPGAPSLSFTVQVAEPLLVKLVSELTPLTVHEGDDATFRCEVSPPDADVTWLRNGAVVTPGPQVEMAQNGSSRILTLRGCQLGDAGTVTLRAGSTATSARLHVRETELLFLRRLQDVRAEEGQDVCLEVETGRVGAAGAVRWVRGGQPLPHDSRLSMAQDGHIHRLFIHGVILADQGTYGCESHHDRTLARLSVRPRQLRVLRPLEDVTISEGGSATFQLELSQEGVTGEWARGGVQLYPGPKCHIHSDGHRHRLVLNGLGLADSGCVSFTADSLRCAARLIVREVPVTIVRGPHDLEVTEGDTATFECELSQALADVTWEKDGNALTPSPRLRLQALGTRRLLQLRRCGPSDAGTYSCAVGTARAGPVRLTVRERTVAVLSELRSVSAREGDGATFECTVSEVETTGRWELGGRPLRPGARVRIRQEGKKHILVLSELRAEDAGEVRFQAGPAQSLALLEVEALPLQMCRHPPREKTVLVGRRAVLEVTVSRSGGHVCWLREGAELCPGDKYEMRSHGPTHSLVIHDVRPEDQGTYCCQAGQDSTHTRLLVEGN

SEQ ID NO: 59292 - protein, 1896 aa, Homo sapiens
  Payload ID: 11574
  Gene Symbol: OBSL1
  Gene Name: obscurin-like 1
  Uniprot ID: O75147
  ENSP ID: ENSP00000385636
MKASSGDQGSPPCFLRFPRPVRVVSGAEAELKCVVLGEPPPVVVWEKGGQQLAASERLSFPADGAEHGLLLTAALPTDAGVYVCRARNAAGEAYAAAAVTVLEPPASDPELQPAERPLPSPGSGEGAPVFLTGPRSQWVLRGAEVVLTCRAGGLPEPTLYWEKDGMALDEVWDSSHFALQPGRAEDGPGASLALRILAARLPDSGVYVCHARNAHGHAQAGALLQVHQPPESPPADPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDRVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTEPPVRIIYPRDEVTLIAVTLECVVLMCELSREDAPVRWYKDGLEVEESEALVLERDGPRCRLVLPAAQPEDGGEFVCDAGDDSAFFTVTVTAPPERIVHPAARSLDLHFGAPGRVELRCEVAPAGSQVRWYKDGLEVEASDALQLGAEGPTRTLTLPHAQPEDAGEYVCETRHEAITFNVILAEPPVQFLALETTPSPLCVAPGEPVVLSCELSRAGAPVVWSHNGRPVQEGEGLELHAEGPRRVLCIQAAGPAHAGLYTCQSGAAPGAPSLSFTVQVAEPPVRVVAPEAAQTRVRSTPGGDLELVVHLSGPGGPVRWYKDGERLASQGRVQLEQAGARQVLRVQGARSGDAGEYLCDAPQDSRIFLVSVEEPLLVKLVSELTPLTVHEGDDATFRCEVSPPDADVTWLRNGAVVTPGPQVEMAQNGSSRILTLRGCQLGDAGTVTLRAGSTATSARLHVRETELLFLRRLQDVRAEEGQDVCLEVETGRVGAAGAVRWVRGGQPLPHDSRLSMAQDGHIHRLFIHGVILADQGTYGCESHHDRTLARLSVRPRQLRVLRPLEDVTISEGGSATFQLELSQEGVTGEWARGGVQLYPGPKCHIHSDGHRHRLVLNGLGLADSGCVSFTADSLRCAARLIVREVPVTIVRGPHDLEVTEGDTATFECELSQALADVTWEKDGNALTPSPRLRLQALGTRRLLQLRRCGPSDAGTYSCAVGTARAGPVRLTVRERTVAVLSELRSVSAREGDGATFECTVSEVETTGRWELGGRPLRPGARVRIRQEGKKHILVLSELRAEDAGEVRFQAGPAQSLALLEVEALPLQMCRHPPREKTVLVGRRAVLEVTVSRSGGHVCWLREGAELCPGDKYEMRSHGPTHSLVIHDVRPEDQGTYCCQAGQDSTHTRLLVEGN

SEQ ID NO: 59293 - protein, 445 aa, Homo sapiens
  Payload ID: 11574
  Gene Symbol: OBSL1
  Gene Name: obscurin-like 1
  ENSP ID: ENSP00000403665
  MOD_RES (1)..(1): Any amino acid
XVLMCELSREDAPVRWYKDGLEVEESEALVLERDGPRCRLVLPAAQPEDGGEFVCDAGDDSAFFTVTVTAPPERIVHPAARSLDLHFGAPGRVELRCEVAPAGSQVRWYKDGLEVEASDALQLGAEGPTRTLTLPHAQPEDAGEYVCETRHEAITFNVILAEPPVQFLALETTPSPLCVAPGEPVVLSCELSRAGAPVVWSHNGRPVQEGEGLELHAEGPRRVLCIQAAGPAHAGLYTCQSGAAPGAPSLSFTVQVAEPLLVKLVSELTPLTVHEGDDATFRCEVSPPDADVTWLRNGAVVTPGPQVEMAQNGSSRILTLRGCQLGDAGTVTLRAGSTATSARLHVRETELLFLRRLQDVRAEEGQDVCLEVETGRVGAAGAVRWVRGGQPLPHDSRLSMAQDGHIHRLFIHGVILADQGTYGCESHHDRTLARLSVRRECPVLS

SEQ ID NO: 59294 - protein, 1543 aa, Homo sapiens
  Payload ID: 11574
  Gene Symbol: OBSL1
  Gene Name: obscurin-like 1
  Uniprot ID: O75147
  ENSP ID: ENSP00000474519
MKASSGDQGSPPCFLRFPRPVRVVSGAEAELKCVVLGEPPPVVVWEKGGQQLAASERLSFPADGAEHGLLLTAALPTDAGVYVCRARNAAGEAYAAAAVTVLEPPASDPELQPAERPLPSPGSGEGAPVFLTGPRSQWVLRGAEVVLTCRAGGLPEPTLYWEKDGMALDEVWDSSHFALQPGRAEDGPGASLALRILAARLPDSGVYVCHARNAHGHAQAGALLQVHQPPESPPADPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDRVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTEPPVRIIYPRDEVTLIAVTLECVVLMCELSREDAPVRWYKDGLEVEESEALVLERDGPRCRLVLPAAQPEDGGEFVCDAGDDSAFFTVTVTAPPERIVHPAARSLDLHFGAPGRVELRCEVAPAGSQVRWYKDGLEVEASDALQLGAEGPTRTLTLPHAQPEDAGEYVCETRHEAITFNVILAEPPVQFLALETTPSPLCVAPGEPVVLSCELSRAGAPVVWSHNGRPVQEGEGLELHAEGPRRVLCIQAAGPAHAGLYTCQSGAAPGAPSLSFTVQVAEPPVRVVAPEAAQTRVRSTPGGDLELVVHLSGPGGPVRWYKDGERLASQGRVQLEQAGARQVLRVQGARSGDAGEYLCDAPQDSRIFLVSVEEPLLVKLVSELTPLTVHEGDDATFRCEVSPPDADVTWLRNGAVVTPGPQVEMAQNGSSRILTLRGCQLGDAGTVTLRAGSTATSARLHVRETELLFLRRLQDVRAEEGQDVCLEVETGRVGAAGAVRWVRGGQPLPHDSRLSMAQDGHIHRLFIHGVILADQGTYGCESHHDRTLARLSVRRECPVLS

SEQ ID NO: 59295 - protein, 412 aa, Homo sapiens
  Payload ID: 11574
  Gene Symbol: OBSL1
  Gene Name: obscurin-like 1
  ENSP ID: ENSP00000475126
  MOD_RES (1)..(1): Any amino acid
XEDTVRRLVLPAVQLEDSGEYLCEIDDESASFTVTVTEPPVRIIYPRDEVTLIAVTLECVVLMCELSREDAPVRWYKDGLEVEESEALVLERDGPRCRLVLPAAQPEDGGEFVCDAGDDSAFFTVTVTEPPVQFLALETTPSPLCVAPGEPVVLSCELSRAGAPVVWSHNGRPVQEGEGLELHAEGPRRVLCIQAAGPAHAGLYTCQSGAAPGAPSLSFTVQVAEPLLVKLVSELTPLTVHEGDDATFRCEVSPPDADVTWLRNGAVVTPGPQVEMAQNGSSRILTLRGCQLGDAGTVTLRAGSTATSARLHVRETELLFLRRLQDVRAEEGQDVCLEVETGRVGAAGAVRWVRGGQPLPHDSRLSMAQDGHIHRLFIHGVILADQGTYGCESHHDRTLARLSVRRECPVLS

SEQ ID NO: 59296 - protein, 522 aa, Homo sapiens
  Payload ID: 11575
  Gene Symbol: OCLN
  Gene Name: occludin
  Uniprot ID: Q16625
  ENSP ID: ENSP00000347379
MSSRPLESPPPYRPDEFKPNHYAPSNDIYGGEMHVRPMLSQPAYSFYPEDEILHFYKWTSPPGVIRILSMLIIVMCIAIFACVASTLAWDRGYGTSLLGGSVGYPYGGSGFGSYGSGYGYGYGYGYGYGGYTDPRAAKGFMLAMAAFCFIAALVIFVTSVIRSEMSRTRRYYLSVIIVSAILGIMVFIATIVYIMGVNPTAQSSGSLYGSQIYALCNQFYTPAATGLYVDQYLYHYCVVDPQEAIAIVLGFMIIVAFALIIFFAVKTRRKMDRYDKSNILWDKEHIYDEQPPNVEEWVKNVSAGTQDVPSPPSDYVERVDSPMAYSSNGKVNDKRFYPESSYKSTPVPEVVQELPLTSPVDDFRQPRYSSGGNFETPSKRAPAKGRAGRSKRTEQDHYETDYTTGGESCDELEEDWIREYPPITSDQQRQLYKRNFDTGLQEYKSLQSELDEINKELSRLDKELDDYREESEEYMAAADEYNRLKQVKGSADYKSKKNHCKQLKSKLSHIKKMVGDYDRQKT

SEQ ID NO: 59297 - protein, 522 aa, Homo sapiens; identical to SEQ ID NO: 59296
  Payload ID: 11575
  Gene Symbol: OCLN
  Gene Name: occludin
  Uniprot ID: Q16625
  ENSP ID: ENSP00000379719

SEQ ID NO: 59298 - protein, 271 aa, Homo sapiens
  Payload ID: 11575
  Gene Symbol: OCLN
  Gene Name: occludin
  Uniprot ID: Q16625
  ENSP ID: ENSP00000445940
MIIVAFALIIFFAVKTRRKMDRYDKSNILWDKEHIYDEQPPNVEEWVKNVSAGTQDVPSPPSDYVERVDSPMAYSSNGKVNDKRFYPESSYKSTPVPEVVQELPLTSPVDDFRQPRYSSGGNFETPSKRAPAKGRAGRSKRTEQDHYETDYTTGGESCDELEEDWIREYPPITSDQQRQLYKRNFDTGLQEYKSLQSELDEINKELSRLDKELDDYREESEEYMAAADEYNRLKQVKGSADYKSKKNHCKQLKSKLSHIKKMVGDYDRQKT

SEQ ID NO: 59299 - protein, 522 aa, Homo sapiens
  Payload ID: 11575
  Gene Symbol: OCLN
  Gene Name: occludin
  ENSP ID: ENSP00000480303
MSSRPLESPPPYRPDEFKPNHYAPSNDIYGGEMHVRPMLSQPAYSFYPEDEILHFYKWTSPPGVIRILSMLIIVMCIAIFACVASTLAWDRGYGTSLLGGSVGYPYGGSGFGSYGSGYGYGYGYGYGYGGYTDPRAAKGFMLAMAAFCFIAALVIFVTSVIRSEMSRTRRYYLSVIIVSAILGIMVFIATIVYIMGVNPTAQSSGSLYGSQIYALCNQFYTPAATGLYVDQYLYHYCVVDPQEAIAIVLGFMIIVAFALIIFFAVKTRRKMDRYDKSNILWDKEHIYDEQPPNVEEWVKNVSAGTQDVPSPPSDYVERVDSPMAYSSNGKVNDKRFYPESSYKSTPVPEVVQELPLTSPVDDFRQPRYSSGGNFETPSKRAPAKGRAGRSKRTEQDHYETDYTTGGESCDELEEDWIREYPPITSDQQRQLYKRNFDTGLQEYKSLQSELDEINKELSRLDKELDDYREESEEYMAAADEYNRLKQVKGSADYKSKKNHCKQLNSKLSHIKKMVGDYDRQKT

SEQ ID NO: 59300 - protein, 522 aa, Homo sapiens; identical to SEQ ID NO: 59299
  Payload ID: 11575
  Gene Symbol: OCLN
  Gene Name: occludin
  ENSP ID: ENSP00000480674

SEQ ID NO: 59301 - protein, 522 aa, Homo sapiens; identical to SEQ ID NO: 59299
  Payload ID: 11575
  Gene Symbol: OCLN
  Gene Name: occludin
  ENSP ID: ENSP00000481921

SEQ ID NO: 59302 - protein, 130 aa, Homo sapiens
  Payload ID: 11575
  Gene Symbol: OCLN
  Gene Name: occludin
  ENSP ID: ENSP00000483480
MSSRPLESPPPYRPDEFKPNHYAPSNDIYGGEMHVRPMLSQPAYSFYPEDEILHFYKWTSPPGVIRILSMLIIVMCIAIFACVASTLAWDRGYGTSLLGGHCHCTGVHDYCGFCFNNFLCCENSKKDGQV

SEQ ID NO: 59303 - protein, 264 aa, Homo sapiens
  Payload ID: 11576
  Gene Symbol: OCEL1
  Gene Name: occludin/ELL domain containing 1
  Uniprot ID: Q9H607
  ENSP ID: ENSP00000215061
MHNPDGSASPTADPGSELQTLGQAARRPPPPRAGHDAPRRTRPSARKPLSCFSRRPMPTREPPKTRGSRGHLHTHPPGPGPPLQGLAPRGLKTSAPRPPCQPQPGPHKAKTKKIVFEDELLSQALLGAKKPIGAIPKGHKPRPHPVPDYELKYPPVSSERERSRYVAVFQDQYGEFLELQHEVGCAQAKLRQLEALLSSLPPPQSQKEAQVAARVWREFEMKRMDPGFLDKQARCHYLKGKLRHLKTQIQKFDDQGDSEGSVYF

SEQ ID NO: 59304 - protein, 244 aa, Homo sapiens
  Payload ID: 11576
  Gene Symbol: OCEL1
  Gene Name: occludin/ELL domain containing 1
  ENSP ID: ENSP00000469261
  MOD_RES (1)..(1): Any amino acid
XNPDGSASPTADPGSELQTLGQAARRPPPPRAGHDAPRRTRPSARKPLSCFSRRPMPTREPPKTRGSRGHLHTHPPGPGPPLQGLAPRGLKTSAPRPPCQPQPGPHKAKTKKIVFEDELLSQALLGAKKPIGAIPKGHKPRPHPVPDYELKYPPVSSERERSRYVAVFQDQYGEFLELQHEVGCAQAKLRQLEALLSSLPPPQSQKEAQVAARVWREFEMKRMLPLPGVAFSWIANASSVWTQL

SEQ ID NO: 59305 - protein, 68 aa, Homo sapiens
  Payload ID: 11576
  Gene Symbol: OCEL1
  Gene Name: occludin/ELL domain containing 1
  ENSP ID: ENSP00000469624
KEAQVAARVWREFEMKRMDPGFLDKQRDAWGCRSLAFLGISQLFLLQLPLPGVAFSWIANASSVWTQL

SEQ ID NO: 59306 - protein, 84 aa, Homo sapiens
  Payload ID: 11576
  Gene Symbol: OCEL1
  Gene Name: occludin/ELL domain containing 1
  ENSP ID: ENSP00000470258
  MOD_RES (1)..(1): Any amino acid
XILTRLGLGPRCRDWRPEASKPAPPALRASPSRDPTRQRPRRLCLRMSCSPRPSWAPRSLLEPSLRGISLGPTQCPTMSLSTRQ

SEQ ID NO: 59307 - protein, 208 aa, Homo sapiens
  Payload ID: 11576
  Gene Symbol: OCEL1
  Gene Name: occludin/ELL domain containing 1
  ENSP ID: ENSP00000470270
MPTREPPKTRGSRGHLHTHPPGPGPPLQGLAPRGLKTSAPRPPCQPQPGPHKAKTKKIVFEDELLSQALLGAKKPIGAIPKGHKPRPHPVPDYELKYPPVSSERERSRYVAVFQDQYGEFLELQHEVGCAQAKLRQLEALLSSLPPPQSQKEAQVAARVWREFEMKRMDPGFLDKQARCHYLKGKLRHLKTQIQKFDDQGDSEGSVYF

SEQ ID NO: 59308 - protein, 95 aa, Homo sapiens
  Payload ID: 11576
  Gene Symbol: OCEL1
  Gene Name: occludin/ELL domain containing 1
  ENSP ID: ENSP00000470883
  MOD_RES (1)..(1): Any amino acid
XKEAQVAARVWREFEMKRMDPGFLDKQARCHYLKGKLRHLKTQIQKFDDQGDSEGSVSPYQGSLSPGLQMPLQFGLSSDSPSSRKAFQDFLLWVL

SEQ ID NO: 59309 - protein, 165 aa, Homo sapiens
  Payload ID: 11576
  Gene Symbol: OCEL1
  Gene Name: occludin/ELL domain containing 1
  ENSP ID: ENSP00000471201
MHNPDGSASPTADPGSELQTLGQAARRPPPPRAGHDAPRRTRPSARKPLSCFSRRPMPTREPPKTRGSRGHLHTHPPGPGPPLQGLAPRGLKTSAPRPPCQPQPGPHKAKTKKIVFEDELLSQALLGAKKPIGAIPKGHKPRPHPVPDYELRRPKLQPGFGGSLR

SEQ ID NO: 59310 - protein, 246 aa, Homo sapiens
  Payload ID: 11576
  Gene Symbol: OCEL1
  Gene Name: occludin/ELL domain containing 1
  ENSP ID: ENSP00000471311
  MOD_RES (1)..(1): Any amino acid
XRTRPSARKPLSCFSRRPMPTREPPKTRGSRGHLHTHPPGPGPPLQGLAPRGLKTSAPRPPCQPQPGPHKAKTKKIVFEDELLSQALLGAKKPIGAIPKGHKPRPHPVPDYELKYPPVSSERERSRYVAVFQDQYGEFLELQHEVGCAQAKLRQLEALLSSLPPPQSQKEAQVAARVWREFEMKRMAGVQWYDLSSLQPQRPGFKRFSCLSWDHRRPPPCLANFCICSRDGVSPCWPGWSRTPDLK

SEQ ID NO: 59311 - protein, 52 aa, Homo sapiens
  Payload ID: 11576
  Gene Symbol: OCEL1
  Gene Name: occludin/ELL domain containing 1
  ENSP ID: ENSP00000471742
RASPSRDPTRQRPRRLCLRMSCSPRPSWAPRSLLEPSLRGISLGPTQCPTMS

SEQ ID NO: 59312 - protein, 245 aa, Homo sapiens
  Payload ID: 11577
  Gene Symbol: OCIAD1
  Gene Name: OCIA domain containing 1
  Uniprot ID: Q9NX40
  ENSP ID: ENSP00000264312
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQGPDPNLEESPKRKNITYEELRNKNRESYEVSLTQKTDPSVRPMHERVPKKEVKVNKYGDTWDE

SEQ ID NO: 59313 - protein, 245 aa, Homo sapiens; identical to SEQ ID NO: 59312
  Payload ID: 11577
  Gene Symbol: OCIAD1
  Gene Name: OCIA domain containing 1
  Uniprot ID: Q9NX40
  ENSP ID: ENSP00000370882

SEQ ID NO: 59314 - protein, 187 aa, Homo sapiens
  Payload ID: 11577
  Gene Symbol: OCIAD1
  Gene Name: OCIA domain containing 1
  Uniprot ID: Q9NX40
  ENSP ID: ENSP00000379725
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQGRNFS

SEQ ID NO: 59315 - protein, 194 aa, Homo sapiens
  Payload ID: 11577
  Gene Symbol: OCIAD1
  Gene Name: OCIA domain containing 1
  Uniprot ID: Q9NX40
  ENSP ID: ENSP00000399656
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQVKVNKYGDTWDE

SEQ ID NO: 59316 - protein, 194 aa, Homo sapiens; identical to SEQ ID NO: 59315
  Payload ID: 11577
  Gene Symbol: OCIAD1
  Gene Name: OCIA domain containing 1
  Uniprot ID: Q9NX40
  ENSP ID: ENSP00000416943

SEQ ID NO: 59317 - protein, 119 aa, Homo sapiens
  Payload ID: 11577
  Gene Symbol: OCIAD1
  Gene Name: OCIA domain containing 1
  ENSP ID: ENSP00000420881
MLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAP

SEQ ID NO: 59318 - protein, 97 aa, Homo sapiens
  Payload ID: 11577
  Gene Symbol: OCIAD1
  Gene Name: OCIA domain containing 1
  ENSP ID: ENSP00000420917
MNGRADFREPNAEVPRPIPHIGPDYIPTEEERRVFAECNDESFWFRSVPLAATSMLITQGLISKGILSSHPKYGSIPKLILACIMGYFAGKLSYVKT

SEQ ID NO: 59319 - protein, 46 aa, Homo sapiens
  Payload ID: 11577
  Gene Symbol: OCIAD1
  Gene Name: OCIA domain containing 1
  ENSP ID: ENSP00000421572
MNGRADFREPNAEVPRPIPHIGPDYIPTEEERRVFAECNDESFWFR

SEQ ID NO: 59320 - protein, 29 aa, Homo sapiens
  Payload ID: 11577
  Gene Symbol: OCIAD1
  Gene Name: OCIA domain containing 1
  ENSP ID: ENSP00000421582
MNGRADFREPNAEVPRPIPHIGPDYIPTE

SEQ ID NO: 59321 - protein, 73 aa, Homo sapiens
  Payload ID: 11577
  Gene Symbol: OCIAD1
  Gene Name: OCIA domain containing 1
  ENSP ID: ENSP00000422171
MNGRADFREPNAEVPRPIPHIGPDYIPTEEERRVFAECNDESFWFRSVPLAATSMLITQGLISKGILSSHPKY

SEQ ID NO: 59322 - protein, 245 aa, Homo sapiens; identical to SEQ ID NO: 59312
  Payload ID: 11577
  Gene Symbol: OCIAD1
  Gene Name: OCIA domain containing 1
  Uniprot ID: Q9NX40
  ENSP ID: ENSP00000423002

SEQ ID NO: 59323 - protein, 168 aa, Homo sapiens
  Payload ID: 11577
  Gene Symbol: OCIAD1
  Gene Name: OCIA domain containing 1
  ENSP ID: ENSP00000423126
MNGRADFREPNAEVPRPIPPVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQGPDPNLEESPKRK

SEQ ID NO: 59324 - protein, 110 aa, Homo sapiens
  Payload ID: 11577
  Gene Symbol: OCIAD1
  Gene Name: OCIA domain containing 1
  ENSP ID: ENSP00000423381
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPL

SEQ ID NO: 59325 - protein, 112 aa, Homo sapiens
  Payload ID: 11577
  Gene Symbol: OCIAD1
  Gene Name: OCIA domain containing 1
  ENSP ID: ENSP00000423845
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGE

SEQ ID NO: 59326 - protein, 245 aa, Homo sapiens; identical to SEQ ID NO: 59312
  Payload ID: 11577
  Gene Symbol: OCIAD1
  Gene Name: OCIA domain containing 1
  Uniprot ID: Q9NX40
  ENSP ID: ENSP00000423909

SEQ ID NO: 59327 - protein, 218 aa, Homo sapiens
  Payload ID: 11577
  Gene Symbol: OCIAD1
  Gene Name: OCIA domain containing 1
  ENSP ID: ENSP00000424041
MNGRADFREPNAEVPRPIPPVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQGPDPNLEESPKRKNITYEELRNKNRESYEVSLTQKTDPSVRPMHERVPKKEVKVNKYGDTWDE

SEQ ID NO: 59328 - protein, 80 aa, Homo sapiens
  Payload ID: 11577
  Gene Symbol: OCIAD1
  Gene Name: OCIA domain containing 1
  ENSP ID: ENSP00000424252
MNGRADFREPNAEVPRPIPHIGPDYIPTEEERRVFAECNDESFWFRSVPLAATSMLITQGLISKGILSSHPKYGSIPKLI

SEQ ID NO: 59329 - protein, 179 aa, Homo sapiens
  Payload ID: 11577
  Gene Symbol: OCIAD1
  Gene Name: OCIA domain containing 1
  ENSP ID: ENSP00000425356
MLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQGPDPNLEESPKRKNITYEELRNKNRESYEVSLTQKTDPSVRPMHERVPKKE

SEQ ID NO: 59330 - protein, 97 aa, Homo sapiens; identical to SEQ ID NO: 59318
  Payload ID: 11577
  Gene Symbol: OCIAD1
  Gene Name: OCIA domain containing 1
  ENSP ID: ENSP00000425633

SEQ ID NO: 59331 - protein, 103 aa, Homo sapiens
  Payload ID: 11577
  Gene Symbol: OCIAD1
  Gene Name: OCIA domain containing 1
  ENSP ID: ENSP00000425968
MLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLP

SEQ ID NO: 59332 - protein, 171 aa, Homo sapiens
  Payload ID: 11577
  Gene Symbol: OCIAD1
  Gene Name: OCIA domain containing 1
  ENSP ID: ENSP00000426386
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNES

SEQ ID NO: 59333 - protein, 80 aa, Homo sapiens; identical to SEQ ID NO: 59328
  Payload ID: 11577
  Gene Symbol: OCIAD1
  Gene Name: OCIA domain containing 1
  ENSP ID: ENSP00000426902

SEQ ID NO: 59334 - protein, 140 aa, Homo sapiens
  Payload ID: 11577
  Gene Symbol: OCIAD1
  Gene Name: OCIA domain containing 1
  ENSP ID: ENSP00000427363
MLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESAPTGITDHIVQVKVNKYGDTWDE

SEQ ID NO: 59335 - protein, 172 aa, Homo sapiens
  Payload ID: 11577
  Gene Symbol: OCIAD1
  Gene Name: OCIA domain containing 1
  ENSP ID: ENSP00000427389
MNGRADFREPNAEVPRPIPHIGPDYIPTEEERRVFAECNDESFWFRSVPLAATSMLITQGLISKGILSSHPKYGSIPKLILACIMGYFAGKLSYVKTCQEKFKKLENSPLGEALRSGQARRSSPPGHYYQKSKYDSSVSGQSSFVTSPAADNIEMLPHYEPIPFSSSMNESA

SEQ ID NO: 59336 - protein, 99 aa, Homo sapiens
  Payload ID: 11578
  Gene Symbol: OCIAD2
  Gene Name: OCIA domain containing 2
  Uniprot ID: Q56VL3
  ENSP ID: ENSP00000273860
MASASARGNQDKDAHFPPPSKQSLLFCPKSKLHIHRAEISKIMRECQEESFWKRALPFSLVSMLVTQGLVYQGYLAANSRFGSLPKVARTASLPVRNAK

SEQ ID NO: 59337 - protein, 88 aa, Homo sapiens
  Payload ID: 11578
  Gene Symbol: OCIAD2
  Gene Name: OCIA domain containing 2
  ENSP ID: ENSP00000370873
MASASARGNQDKDAHFPPPSKQSLLFCPKSKLHIHRAEISKIMRECQEESFWKRALPFSLVSMLVTQGLVYQGYLAANSRFGSLPKVA

SEQ ID NO: 59338 - protein, 154 aa, Homo sapiens
  Payload ID: 11578
  Gene Symbol: OCIAD2
  Gene Name: OCIA domain containing 2
  Uniprot ID: Q56VL3
  ENSP ID: ENSP00000423014
MASASARGNQDKDAHFPPPSKQSLLFCPKSKLHIHRAEISKIMRECQEESFWKRALPFSLVSMLVTQGLVYQGYLAANSRFGSLPKVALAGLLGFGLGKVSYIGVCQSKFHFFEDQLRGAGFGPQHNRHCLLTCEECKIKHGLSEKGDSQPSAS

SEQ ID NO: 59339 - protein, 61 aa, Homo sapiens
  Payload ID: 11578
  Gene Symbol: OCIAD2
  Gene Name: OCIA domain containing 2
  ENSP ID: ENSP00000425452
MASASARGNQDKDAHFPPPSKQSLLFCPKSKLHIHRAEISKIMRECQEESFWKRACLSPRD

SEQ ID NO: 59340 - protein, 99 aa, Homo sapiens; identical to SEQ ID NO: 59336
  Payload ID: 11578
  Gene Symbol: OCIAD2
  Gene Name: OCIA domain containing 2
  Uniprot ID: Q56VL3
  ENSP ID: ENSP00000483997

SEQ ID NO: 59341 - protein, 893 aa, Homo sapiens
  Payload ID: 11579
  Gene Symbol: OCRL
  Gene Name: oculocerebrorenal syndrome of Lowe
  Uniprot ID: Q01968
  ENSP ID: ENSP00000349635
MEPPLPVGAQPLATVEGMEMKGPLREPCALTLAQRNGQYELIIQLHEKEQHVQDIIPINSHFRCVQEAEETLLIDIASNSGCKIRVQGDWIRERRFEIPDEEHCLKFLSAVLAAQKAQSQLLVPEQKDSSSWYQKLDTKDKPSVFSGLLGFEDNFSSMNLDKKINSQNQPTGIHREPPPPPFSVNKMLPREKEASNKEQPKVTNTMRKLFVPNTQSGQREGLIKHILAKREKEYVNIQTFRFFVGTWNVNGQSPDSGLEPWLNCDPNPPDIYCIGFQELDLSTEAFFYFESVKEQEWSMAVERGLHSKAKYKKVQLVRLVGMMLLIFARKDQCRYIRDIATETVGTGIMGKMGNKGGVAVRFVFHNTTFCIVNSHLAAHVEDFERRNQDYKDICARMSFVVPNQTLPQLNIMKHEVVIWLGDLNYRLCMPDANEVKSLINKKDLQRLLKFDQLNIQRTQKKAFVDFNEGEIKFIPTYKYDSKTDRWDSSGKCRVPAWCDRILWRGTNVNQLNYRSHMELKTSDHKPVSALFHIGVKVVDERRYRKVFEDSVRIMDRMENDFLPSLELSRREFVFENVKFRQLQKEKFQISNNGQVPCHFSFIPKLNDSQYCKPWLRAEPFEGYLEPNETVDISLDVYVSKDSVTILNSGEDKIEDILVLHLDRGKDYFLTISGNYLPSCFGTSLEALCRMKRPIREVPVTKLIDLEKSLLQMVPLDEGASERPLQVPKEIWLLVDHLFKYACHQEDLFQTPGMQEELQQIIDCLDTSIPETIPGSNHSVAEALLIFLEALPEPVICYELYQRCLDSAYDPRICRQVISQLPRCHRNVFRYLMAFLRELLKFSEYNSVNANMIATLFTSLLLRPPPNLMARQTPSDRQRAIQFLLGFLLGSEED

SEQ ID NO: 59342 - protein, 901 aa, Homo sapiens
  Payload ID: 11579
  Gene Symbol: OCRL
  Gene Name: oculocerebrorenal syndrome of Lowe
  Uniprot ID: Q01968
  ENSP ID: ENSP00000360154
MEPPLPVGAQPLATVEGMEMKGPLREPCALTLAQRNGQYELIIQLHEKEQHVQDIIPINSHFRCVQEAEETLLIDIASNSGCKIRVQGDWIRERRFEIPDEEHCLKFLSAVLAAQKAQSQLLVPEQKDSSSWYQKLDTKDKPSVFSGLLGFEDNFSSMNLDKKINSQNQPTGIHREPPPPPFSVNKMLPREKEASNKEQPKVTNTMRKLFVPNTQSGQREGLIKHILAKREKEYVNIQTFRFFVGTWNVNGQSPDSGLEPWLNCDPNPPDIYCIGFQELDLSTEAFFYFESVKEQEWSMAVERGLHSKAKYKKVQLVRLVGMMLLIFARKDQCRYIRDIATETVGTGIMGKMGNKGGVAVRFVFHNTTFCIVNSHLAAHVEDFERRNQDYKDICARMSFVVPNQTLPQLNIMKHEVVIWLGDLNYRLCMPDANEVKSLINKKDLQRLLKFDQLNIQRTQKKAFVDFNEGEIKFIPTYKYDSKTDRWDSSGKCRVPAWCDRILWRGTNVNQLNYRSHMELKTSDHKPVSALFHIGVKVVDERRYRKVFEDSVRIMDRMENDFLPSLELSRREFVFENVKFRQLQKEKFQISNNGQVPCHFSFIPKLNDSQYCKPWLRAEPFEGYLEPNETVDISLDVYVSKDSVTILNSGEDKIEDILVLHLDRGKDYFLTISGNYLPSCFGTSLEALCRMKRPIREVPVTKLIDLEEDSFLEKEKSLLQMVPLDEGASERPLQVPKEIWLLVDHLFKYACHQEDLFQTPGMQEELQQIIDCLDTSIPETIPGSNHSVAEALLIFLEALPEPVICYELYQRCLDSAYDPRICRQVISQLPRCHRNVFRYLMAFLRELLKFSEYNSVNANMIATLFTSLLLRPPPNLMARQTPSDRQRAIQFLLGFLLGSEED

SEQ ID NO: 59343 - protein, 814 aa, Homo sapiens
  Payload ID: 11580
  Gene Symbol: OCA2
  Gene Name: oculocutaneous albinism II
  Uniprot ID: Q04671
  ENSP ID: ENSP00000261276
MHLEGRDGRRYPGAPAVELLQTSVPSGLAELVAGKRRLPRGAGGADPSHSCPRGAAGQSSWAPAGQEFASFLTKGRSHSSLPQMSSSRSKDSCFTENTPLLRNSLQEKGSRCIPVYHPEFITAEESWEDSSADWERRYLLSREVSGLSASASSEKGDLLDSPHIRLRLSKLRRCVQWLKVMGLFAFVVLCSILFSLYPDQGKLWQLLALSPLENYSVNLSSHVDSTLLQVDLAGALVASGPSRPGREEHIVVELTQADALGSRWRRPQQVTHNWTVYLNPRRSEHSVMSRTFEVLTRETVSISIRASLQQTQAVPLLMAHQYLRGSVETQVTIATAILAGVYALIIFERPSLTHVVEWIDFETLALLFGMMILVAIFSETGFFDYCAVKAYRLSRGRVWAMIIMLCLIAAVLSAFLDNVTTMLLFTPVTIRLCEVLNLDPRQVLIAEVIFTNIGGAATAIGDPPNVIIVSNQELRKMGLDFAGFTAHMFIGICLVLLVCFPLLRLLYWNRKLYNKEPSEIVELKHEIHVWRLTAQRISPASREETAVRRLLLGKVLALEHLLARRLHTFHRQISQEDKNWETNIQELQKKHRISDGILLAKCLTVLGFVIFMFFLNSFVPGIHLDLGWIAILGAIWLLILADIHDFEIILHRVEWATLLFFAALFVLMEALAHLHLIEYVGEQTALLIKMVPEEQRLIAAIVLVVWVSALASSLIDNIPFTATMIPVLLNLSHDPEVGLPAPPLMYALAFGACLGGNGTLIGASANVVCAGIAEQHGYGFSFMEFFRLGFPMMVVSCTVGMCYLLVAHVVVGWN

SEQ ID NO: 59344 - protein, 838 aa, Homo sapiens
  Payload ID: 11580
  Gene Symbol: OCA2
  Gene Name: oculocutaneous albinism II
  Uniprot ID: Q04671
  ENSP ID: ENSP00000346659
MHLEGRDGRRYPGAPAVELLQTSVPSGLAELVAGKRRLPRGAGGADPSHSCPRGAAGQSSWAPAGQEFASFLTKGRSHSSLPQMSSSRSKDSCFTENTPLLRNSLQEKGSRCIPVYHPEFITAEESWEDSSADWERRYLLSREVSGLSASASSEKGDLLDSPHIRLRLSKLRRCVQWLKVMGLFAFVVLCSILFSLYPDQGKLWQLLALSPLENYSVNLSSHVDSTLLQVDLAGALVASGPSRPGREEHIVVELTQADALGSRWRRPQQVTHNWTVYLNPRRSEHSVMSRTFEVLTRETVSISIRASLQQTQAVPLLMAHQYLRGSVETQVTIATAILAGVYALIIFEIVHRTLAAMLGSLAALAALAVIGDRPSLTHVVEWIDFETLALLFGMMILVAIFSETGFFDYCAVKAYRLSRGRVWAMIIMLCLIAAVLSAFLDNVTTMLLFTPVTIRLCEVLNLDPRQVLIAEVIFTNIGGAATAIGDPPNVIIVSNQELRKMGLDFAGFTAHMFIGICLVLLVCFPLLRLLYWNRKLYNKEPSEIVELKHEIHVWRLTAQRISPASREETAVRRLLLGKVLALEHLLARRLHTFHRQISQEDKNWETNIQELQKKHRISDGILLAKCLTVLGFVIFMFFLNSFVPGIHLDLGWIAILGAIWLLILADIHDFEIILHRVEWATLLFFAALFVLMEALAHLHLIEYVGEQTALLIKMVPEEQRLIAAIVLVVWVSALASSLIDNIPFTATMIPVLLNLSHDPEVGLPAPPLMYALAFGACLGGNGTLIGASANVVCAGIAEQHGYGFSFMEFFRLGFPMMVVSCTVGMCYLLVAHVVVGWN

SEQ ID NO: 59345 - protein, 218 aa, Homo sapiens
  Payload ID: 11580
  Gene Symbol: OCA2
  Gene Name: oculocutaneous albinism II
  ENSP ID: ENSP00000414425
MHLEGRDGRRYPGAPAVELLQTSVPSGLAELVAGKRRLPRGAGGADPSHSCPRGAAGQSSWAPAGQEFASFLTKGRSHSSLPQMSSSRSKDSCFTENTPLLRNSLQEKGSRCIPVYHPEFITAEESWEDSSADWERRYLLSREVSGLSASASSEKGDLLDSPHIRLRLSKLRRCVQWLKVMGLFAFVVLCSVTHNWTVYLNPRRSEHSVMSRTFEVLT

SEQ ID NO: 59346 - protein, 264 aa, Homo sapiens
  Payload ID: 11580
  Gene Symbol: OCA2
  Gene Name: oculocutaneous albinism II
  ENSP ID: ENSP00000415431
MHLEGRDGRRYPGAPAVELLQTSVPSGLAELVAGKRRLPRGAGGADPSHSCPRGAAGQSSWAPAGQEFASFLTKGRSHSSLPQMSSSRSKDSCFTENTPLLRNSLQEKGSRCIPVYHPEFITAEESWEDSSADWERRYLLSREVSGLSASASSEKGDLLDSPHIRLRLSKLRRCVQWLKVMGLFAFVVLCSILFSLYPDQGKLWQLLALSPLENYSVNLSSHVDSTLLQVDLAGALVASGPSRPGREEHIVVELTQADALGSRW

SEQ ID NO: 59347 - protein, 132 aa, Homo sapiens
  Payload ID: 11580
  Gene Symbol: OCA2
  Gene Name: oculocutaneous albinism II
  ENSP ID: ENSP00000484219
MSRTFEVLTRETVSISIRASLQQTQAVPLLMAHQYLRGSVETQVTIATAILAGVYALIIFEIVHRTLAAMLGSLAALAALAVIGDRPSLTHVVEWIDFETLALLFGMMILVAIFSETGFFDYCAVKAYRLSR

SEQ ID NO: 59348 - protein, 748 aa, Homo sapiens
  Payload ID: 11580
  Gene Symbol: OCA2
  Gene Name: oculocutaneous albinism II
  ENSP ID: ENSP00000488119
MHLEGRDGRRYPGAPAVELLQTSVPSGLAELVAGKRRLPRGAGGADPSHSCPRGAAGQSSWAPAGQEFASFLTKGRSHSSLPQMSSSRSKDSCFTENTPLLRNSLQEKGSRCIPVYHPEFITAEESWEDSSADWERRYLLSREVSGLSASASSEKGDLLDSPHIRLRLSKLRRCVQWLKVMGLFAFVVLCSILFSLYPDQGKLWQLLALSPLENYSVNLSSHVDSTLLQVDLAGALVASGPSRPGREEHIVVELTQADALGSRWRRPQQVTHNWTVYLNPRRSEHSVMSRTFEVLTRETVSISIRASLQQTQAVPLLMAHQYLRGSVETQVTIATAILAGVYALIIFEIVHRTLAAMLGSLAALAALAVIGDRPSLTHVVEWIDFETLALLFGMMILVAIFSETGFFDYCAVKAYRLSRGRVWAMIIMLCLIAAVLSAFLDNVTTMLLFTPVTIRLCEVLNLDPRQVLIAEVIFTNIGGAATAIGDPPNVIIVSNQELRKMGLDFAGFTAHMFIGICLVLLVCFPLLRLLYWNRKLYNKEPSEIVELKHEIHVWRLTAQRISPASREETAVRRLLLGKVLALEHLLARRLHTFHRQISQEDKNWETNIQELQKKHRISDGILLAKCLTVLGFVIFMFFLNSFVPGIHLDLGWIAILGAIWLLILADIHDFEIILHRVEWATLLFFAALFVLMEALAHLHLIEYVGEQTALLIKMVPEEQRLIAAIVLVVWVSALASSLIDNIPFTATM

SEQ ID NO: 59349 - protein, 218 aa, Homo sapiens; identical to SEQ ID NO: 59345
  Payload ID: 11580
  Gene Symbol: OCA2
  Gene Name: oculocutaneous albinism II
  ENSP ID: ENSP00000488215

SEQ ID NO: 59350 - protein, 724 aa, Homo sapiens
  Payload ID: 11580
  Gene Symbol: OCA2
  Gene Name: oculocutaneous albinism II
  ENSP ID: ENSP00000488458
MHLEGRDGRRYPGAPAVELLQTSVPSGLAELVAGKRRLPRGAGGADPSHSCPRGAAGQSSWAPAGQEFASFLTKGRSHSSLPQMSSSRSKDSCFTENTPLLRNSLQEKGSRCIPVYHPEFITAEESWEDSSADWERRYLLSREVSGLSASASSEKGDLLDSPHIRLRLSKLRRCVQWLKVMGLFAFVVLCSILFSLYPDQGKLWQLLALSPLENYSVNLSSHVDSTLLQVDLAGALVASGPSRPGREEHIVVELTQADALGSRWRRPQQVTHNWTVYLNPRRSEHSVMSRTFEVLTRETVSISIRASLQQTQAVPLLMAHQYLRGSVETQVTIATAILAGVYALIIFERPSLTHVVEWIDFETLALLFGMMILVAIFSETGFFDYCAVKAYRLSRGRVWAMIIMLCLIAAVLSAFLDNVTTMLLFTPVTIRLCEVLNLDPRQVLIAEVIFTNIGGAATAIGDPPNVIIVSNQELRKMGLDFAGFTAHMFIGICLVLLVCFPLLRLLYWNRKLYNKEPSEIVELKHEIHVWRLTAQRISPASREETAVRRLLLGKVLALEHLLARRLHTFHRQISQEDKNWETNIQELQKKHRISDGILLAKCLTVLGFVIFMFFLNSFVPGIHLDLGWIAILGAIWLLILADIHDFEIILHRVEWATLLFFAALFVLMEALAHLHLIEYVGEQTALLIKMVPEEQRLIAAIVLVVWVSALASSLIDNIPFTATM

SEQ ID NO: 59351 - protein, 264 aa, Homo sapiens; identical to SEQ ID NO: 59346
  Payload ID: 11580
  Gene Symbol: OCA2
  Gene Name: oculocutaneous albinism II
  ENSP ID: ENSP00000488768

SEQ ID NO: 59352 - protein, 44 aa, Homo sapiens
  Payload ID: 11581
  Gene Symbol: OCLM
  Gene Name: oculomedin
  Uniprot ID: Q9Y5M6
  ENSP ID: ENSP00000460371
MGMYPPLLLKIYLSRHISILFYLKILYKSGIIWLSWYSFILLVL

SEQ ID NO: 59353 - protein, 266 aa, Homo sapiens
  Payload ID: 11582
  Gene Symbol: OSR1
  Gene Name: odd-skipped related transciption factor 1
  Uniprot ID: Q8TAX0
  ENSP ID: ENSP00000272223
MGSKTLPAPVPIHPSLQLTNYSFLQAVNGLPTVPSDHLPNLYGFSALHAVHLHQWTLGYPAMHLPRSSFSKVPGTVSSLVDARFQLPAFPWFPHVIQPKPEITAGGSVPALKTKPRFDFANLALAATQEDPAKLGRGEGPGSPAGGLGALLDVTKLSPEKKPTRGRLPSKTKKEFVCKFCGRHFTKSYNLLIHERTHTDERPYTCDICHKAFRRQDHLRDHRYIHSKEKPFKCQECGKGFCQSRTLAVHKTLHSQVKELKTSKIKC

SEQ ID NO: 59354 - protein, 312 aa, Homo sapiens
  Payload ID: 11583
  Gene Symbol: OSR2
  Gene Name: odd-skipped related transciption factor 2
  Uniprot ID: Q8N2R0
  ENSP ID: ENSP00000297565
MGSKALPAPIPLHPSLQLTNYSFLQAVNTFPATVDHLQGLYGLSAVQTMHMNHWTLGYPNVHEITRSTITEMAAAQGLVDARFPFPALPFTTHLFHPKQGAIAHVLPALHKDRPRFDFANLAVAATQEDPPKMGDLSKLSPGLGSPISGLSKLTPDRKPSRGRLPSKTKKEFICKFCGRHFTKSYNLLIHERTHTDERPYTCDICHKAFRRQDHLRDHRYIHSKEKPFKCQECGKGFCQSRTLAVHKTLHMQESPHKCPTCGRTFNQRSNLKTHLLTHTDIKPYSCEQCGKVFRRNCDLRRHSLTHTPRQDF

SEQ ID NO: 59355 - protein, 276 aa, Homo sapiens
  Payload ID: 11583
  Gene Symbol: OSR2
  Gene Name: odd-skipped related transciption factor 2
  Uniprot ID: Q8N2R0
  ENSP ID: ENSP00000402862
MGSKALPAPIPLHPSLQLTNYSFLQAVNTFPATVDHLQGLYGLSAVQTMHMNHWTLGYPNVHEITRSTITEMAAAQGLVDARFPFPALPFTTHLFHPKQGAIAHVLPALHKDRPRFDFANLAVAATQEDPPKMGDLSKLSPGLGSPISGLSKLTPDRKPSRGRLPSKTKKEFICKFCGRHFTKSYNLLIHERTHTDERPYTCDICHKAFRRQDHLRDHRYIHSKEKPFKCQECGKGFCQSRTLAVHKTLHMQTSSPTAASSAAKCSGETVICGGTA

SEQ ID NO: 59356 - protein, 433 aa, Homo sapiens
  Payload ID: 11583
  Gene Symbol: OSR2
  Gene Name: odd-skipped related transciption factor 2
  Uniprot ID: Q8N2R0
  ENSP ID: ENSP00000414657
MGLRAEEGKRKPPRSVRGEVSPSQGPLAQEDEARRLRSCTPACHPGKRGKGGHRARRQRSAWDLTTHPLTHRSQELRGAAATEGFLYVLLSHWVFVGAPRPPASDSWKKGLVPSAPPASRKMGSKALPAPIPLHPSLQLTNYSFLQAVNTFPATVDHLQGLYGLSAVQTMHMNHWTLGYPNVHEITRSTITEMAAAQGLVDARFPFPALPFTTHLFHPKQGAIAHVLPALHKDRPRFDFANLAVAATQEDPPKMGDLSKLSPGLGSPISGLSKLTPDRKPSRGRLPSKTKKEFICKFCGRHFTKSYNLLIHERTHTDERPYTCDICHKAFRRQDHLRDHRYIHSKEKPFKCQECGKGFCQSRTLAVHKTLHMQESPHKCPTCGRTFNQRSNLKTHLLTHTDIKPYSCEQCGKVFRRNCDLRRHSLTHTPRQDF

SEQ ID NO: 59357 - protein, 213 aa, Homo sapiens
  Payload ID: 11583
  Gene Symbol: OSR2
  Gene Name: odd-skipped related transciption factor 2
  ENSP ID: ENSP00000429910
MGSKALPAPIPLHPSLQLTNYSFLQAVNTFPATVDHLQGLYGLSAVQTMHMNHWTLGYPNVHEITRSTITEMAAAQGLVDARFPFPALPFTTHLFHPKQGAIAHVLPALHKDRPRFDFANLAVAATQEDPPKMGDLSKLSPGLGSPISGLSKLTPDRKPSRGRLPSKTKKEFICKFCGRHFTKSYNLLIHERTHTDERPYTCDICHKAFRRQD

SEQ ID NO: 59358 - protein, 288 aa, Homo sapiens
  Payload ID: 11583
  Gene Symbol: OSR2
  Gene Name: odd-skipped related transciption factor 2
  ENSP ID: ENSP00000430041
MGSKALPAPIPLHPSLQLTNYSFLQAVNTFPATVDHLQGLYGLSAVQTMHMNHWTLGYPNVHEITRSTITEMAAAQGLVDARFPFPALPFTTHLFHPKQGAIAHVLPALHKDRPRFDFANLAVAATQEDPPKMGDLSKLSPGLGSPISGLSKLTPDRKPSRGRLPSKTKKEFICKFCGRHFTKSYNLLIHERTHTDERPYTCDICHKAFRRQDHLRDHRYIHSKEKPFKCQECGKGFCQSRTLAVHKTLHMQVSLFSCLKTVAGSCYHYCFAKGVQWQTLSLKRLYLD

SEQ ID NO: 59359 - protein, 270 aa, Homo sapiens
  Payload ID: 11583
  Gene Symbol: OSR2
  Gene Name: odd-skipped related transciption factor 2
  ENSP ID: ENSP00000430074
MKRAGFALARRLAIRGFLYVLLSHWVFVGAPRPPASDSWKKGLVPSAPPASRKMGSKALPAPIPLHPSLQLTNYSFLQAVNTFPATVDHLQGLYGLSAVQTMHMNHWTLGYPNVHEITRSTITEMAAAQGLVDARFPFPALPFTTHLFHPKQGAIAHVLPALHKDRPRFDFANLAVAATQEDPPKMGDLSKLSPGLGSPISGLSKLTPDRKPSRGRLPSKTKKEFICKFCGRHFTKSYNLLIHERTHTDERPYTCDICHKAFRRQDHLRD

SEQ ID NO: 59360 - protein, 312 aa, Homo sapiens; identical to SEQ ID NO: 59354
  Payload ID: 11583
  Gene Symbol: OSR2
  Gene Name: odd-skipped related transciption factor 2
  Uniprot ID: Q8N2R0
  ENSP ID: ENSP00000430780

SEQ ID NO: 59361 - protein, 279 aa, Homo sapiens
  Payload ID: 11584
  Gene Symbol: ODAM
  Gene Name: odontogenic, ameloblast asssociated
  Uniprot ID: A1E959
  ENSP ID: ENSP00000379401
MKIIILLGFLGATLSAPLIPQRLMSASNSNELLLNLNNGQLLPLQLQGPLNSWIPPFSGILQQQQQAQIPGLSQFSLSALDQFAGLLPNQIPLTGEASFAQGAQAGQVDPLQLQTPPQTQPGPSHVMPYVFSFKMPQEQGQMFQYYPVYMVLPWEQPQQTVPRSPQQTRQQQYEEQIPFYAQFGYIPQLAEPAISGGQQQLAFDPQLGTAPEIAVMSTGEEIPYLQKEAINFRHDSAGVFMPSTSPKPSTTNVFTSAVDQTITPELPEEKDKTDSLREP

SEQ ID NO: 59362 - protein, 30 aa, Homo sapiens
  Payload ID: 11584
  Gene Symbol: ODAM
  Gene Name: odontogenic, ameloblast asssociated
  ENSP ID: ENSP00000422100
QTPPQTQPGPSHVMPYVFSFKMPQEQGQNI

SEQ ID NO: 59363 - protein, 253 aa, Homo sapiens
  Payload ID: 11584
  Gene Symbol: ODAM
  Gene Name: odontogenic, ameloblast asssociated
  ENSP ID: ENSP00000423070
MKIIILLGFLGATLSAPLLLNLNNGQLLPLQLQGPLNSWIPPFSGILQQQQQAQIPGLSQFSLSALDQFAGLLPNQIPLTGEASFAQGAQAGQVDPLQLQTPPQTQPGPSHVMPYVFSFKMPQEQGQMFQYYPVYMVLPWEQPQQTVPRSPQQTRQQQYEEQIPFYAQFGYIPQLAEPAISGGQQQLAFDPQLGTAPEIAVMSTGEEIPYLQKEAINFRHDSAGVFMPSTSPKPSTTNVFTSAVDQTITPELP

SEQ ID NO: 59364 - protein, 216 aa, Homo sapiens
  Payload ID: 11584
  Gene Symbol: ODAM
  Gene Name: odontogenic, ameloblast asssociated
  ENSP ID: ENSP00000426106
GPLNSWIPPFSGILQQQQQAQIPGLSQFSLSALDQFAGLLPNQIPLTGEASFAQGAQAGQVDPLQLQTPPQTQPGPSHVMPYVFSFKMPQEQGQMFQYYPVYMVLPWEQPQQTVPRSPQQTRQQQYEEQAISGGQQQLAFDPQLGTAPEIAVMSTGEEIPYLQKEAINFRHDSAGVFMPSTSPKPSTTNVFTSAVDQTITPELPEEKDKTDSLREP

SEQ ID NO: 59365 - protein, 147 aa, Homo sapiens
  Payload ID: 11585
  Gene Symbol: OBP2A
  Gene Name: odorant binding protein 2A
  ENSP ID: ENSP00000340950
MKTLFLGVTLGLAAALSFTLEEEDEGGSVHPEENPDAEDGGAWQIQRLWGQEAHIPAGAARDGRLRLLLQRPAPWGPALHGKACGICSLQGRAAVPTLAHLATSPAGRNPNTNLEALEEFKKLVQHKGLSEEDIFMPLQTGSCVLEH

SEQ ID NO: 59366 - protein, 228 aa, Homo sapiens
  Payload ID: 11585
  Gene Symbol: OBP2A
  Gene Name: odorant binding protein 2A
  ENSP ID: ENSP00000342097
MKTLFLGVTLGLAAALSFTLEEEDITGTWYVKAMVVDKDFPEDRRPRKVSPVKVTALGGGNLEATFTFMREDRCIQKKILMRKTEEPGKFSAYGGRKLIYLQELPGTDDYVFYCKDQRRGGLRYMGKLVASAPCRAVPLSPPWLTWPPHLQVGILIPTWRPWKNLRNWCSTRDSRRRTFSCPCRREAAFSNTRQPPGLHLQSPPYHQTQSPDHLDLPSSHDPSLLPPT

SEQ ID NO: 59367 - protein, 170 aa, Homo sapiens
  Payload ID: 11585
  Gene Symbol: OBP2A
  Gene Name: odorant binding protein 2A
  Uniprot ID: Q9NY56
  ENSP ID: ENSP00000360841
MKTLFLGVTLGLAAALSFTLEEEDITGTWYVKAMVVDKDFPEDRRPRKVSPVKVTALGGGNLEATFTFMREDRCIQKKILMRKTEEPGKFSAYGGRKLIYLQELPGTDDYVFYCKDQRRGGLRYMGKLVGRNPNTNLEALEEFKKLVQHKGLSEEDIFMPLQTGSCVLEH

SEQ ID NO: 59368 - protein, 146 aa, Homo sapiens
  Payload ID: 11585
  Gene Symbol: OBP2A
  Gene Name: odorant binding protein 2A
  ENSP ID: ENSP00000436685
MKTLFLGVTLGLAAALSFTLEEEDITGTWYVKAMVVDKDFPEDRRPRKVSPVKVTALGGGNLEATFTFMREDRCIQKKILMRKTEEPGKFSAYGGRKLIYLQELPGTDDYVFYCKDQRRGGLRYMGKLVGPCRCPHLGSPGHLTCR

SEQ ID NO: 59369 - protein, 170 aa, Homo sapiens; identical to SEQ ID NO: 59367
  Payload ID: 11585
  Gene Symbol: OBP2A
  Gene Name: odorant binding protein 2A
  Uniprot ID: Q9NY56
  ENSP ID: ENSP00000441028

SEQ ID NO: 59370 - protein, 85 aa, Homo sapiens
  Payload ID: 11585
  Gene Symbol: OBP2A
  Gene Name: odorant binding protein 2A
  ENSP ID: ENSP00000443986
MKTLFLGVTLGLAAALSFTLEEEDEGGSVHPEENPDAEDGGAWQIQRLWGQEAHIPAGAARDGRLRLLLQRPAPWGPALHGKACG

SEQ ID NO: 59371 - protein, 220 aa, Homo sapiens
  Payload ID: 11585
  Gene Symbol: OBP2A
  Gene Name: odorant binding protein 2A
  ENSP ID: ENSP00000481115
MKTLFLGVTLGLAAALSFTLEEEDITGTWYVKAMVVDKDFPEDRRPRKVSPVKVTALGGGNLEATFTFMREDRCIQKKILMRKTEEPGKFSAYGGRKLIYLQELPGTDDYVFYCKDQRRGGLRYMGKLVASAPCRAVPLSPPWLTWPPHLQVGILIPTWRPWKNLRNWCSTRDSRRRTFSCPCRREAAFSNTRVTPGSAPPEPTLPPDTEPGPPGPTLQP

SEQ ID NO: 59372 - protein, 220 aa, Homo sapiens [sequence omitted]

SEQ ID NO: 59373 - protein, 170 aa, Homo sapiens
  Payload ID: 11586
  Gene Symbol: OBP2B
  Gene Name: odorant binding protein 2B
  Uniprot ID: Q9NPH6
  ENSP ID: ENSP00000361104
MKTLFLGVTLGLAAALSFTLEEEDITGTWYVKAMVVDKDFPEDRRPRKVSPVKVTALGGGKLEATFTFMREDRCIQKKILMRKTEEPGKYSAYGGRKLMYLQELPRRDHYIFYCKDQHHGGLLHMGKLVGRNSDTNREALEEFKKLVQRKGLSEEDIFTPLQTGSCVPEH

SEQ ID NO: 59374 - protein, 165 aa, Homo sapiens
  Payload ID: 11586
  Gene Symbol: OBP2B
  Gene Name: odorant binding protein 2B
  Uniprot ID: Q9NPH6
  ENSP ID: ENSP00000434927
MKTLFLGVTLGLAAALSFTLEEEDITGTWYVKAMVVDKDFPEDRRPRKVSPVKVTALGGGKLEATFTFMREDRCIQKKILMRKTEEPGKYSACLSAVEMDQITPALWEALAIDTLRKLRIGTRRPRIRWGQEAHVPAGAAQEGPLHLLLQRPAPWGPAPHGKACG

SEQ ID NO: 59375 - protein, 170 aa, Homo sapiens; identical to SEQ ID NO: 59373
  Payload ID: 11586
  Gene Symbol: OBP2B
  Gene Name: odorant binding protein 2B
  Uniprot ID: Q9NPH6
  ENSP ID: ENSP00000484615

SEQ ID NO: 59376 - protein, 170 aa, Homo sapiens; identical to SEQ ID NO: 59373
  Payload ID: 11587
  Gene Symbol:
  Gene Name: Odorant-binding protein 2b  [Source:UniProtKB/Swiss-Prot
  Acc:Q9NPH6]
  Uniprot ID: Q9NPH6
  ENSP ID: ENSP00000486108

SEQ ID NO: 59377 - protein, 165 aa, Homo sapiens; identical to SEQ ID NO: 59374
  Payload ID: 11587
  Gene Symbol:
  Gene Name: Odorant-binding protein 2b  [Source:UniProtKB/Swiss-Prot
  Acc:Q9NPH6]
  Uniprot ID: Q9NPH6
  ENSP ID: ENSP00000486815

SEQ ID NO: 59378 - protein, 220 aa, Homo sapiens [sequence omitted]

SEQ ID NO: 59379 - protein, 170 aa, Homo sapiens; identical to SEQ ID NO: 59373
  Payload ID: 11587
  Gene Symbol:
  Gene Name: Odorant-binding protein 2b  [Source:UniProtKB/Swiss-Prot
  Acc:Q9NPH6]
  Uniprot ID: Q9NPH6
  ENSP ID: ENSP00000487521

SEQ ID NO: 59380 - protein, 318 aa, Homo sapiens
  Payload ID: 11588
  Gene Symbol: OLAH
  Gene Name: oleoyl-ACP hydrolase
  Uniprot ID: Q9NV23
  ENSP ID: ENSP00000367462
MERGDQPKRTRNENIFNCLYKNPEATFKLICFPWMGGGSTHFAKWGQDTHDLLEETASHHVAKAGLKLRRSSDPPASAYPCAGVSHRRREPPCLAKILGLFWILIFFMHSLRLPGRESRVEEPLENDISQLVDEVVCALQPVIQDKPFAFFGHSMGSYIAFRTALGLKENNQPEPLHLFLSSATPVHSKAWHRIPKDDELSEEQISHYLMEFGGTPKHFAEAKEFVKQCSPIIRADLNIVRSCTSNVPSKAVLSCDLTCFVGSEDIAKDMEAWKDVTSGNAKIYQLPGGHFYLLDPANEKLIKNYIIKCLEVSSISNF

SEQ ID NO: 59381 - protein, 137 aa, Homo sapiens
  Payload ID: 11588
  Gene Symbol: OLAH
  Gene Name: oleoyl-ACP hydrolase
  ENSP ID: ENSP00000367470
MERGDQPKRTRQATPCATRLFLHPRGSDTLPLNENIFNCLYKNPEATFKLICFPWMGGGSTHFAKWGQDTHDLLEVHSLRLPGRESRVEEPLENDISQLVDEVVCALQPVIQDKPFAFFGHRYLISVLKDFRGVSSI

SEQ ID NO: 59382 - protein, 265 aa, Homo sapiens
  Payload ID: 11588
  Gene Symbol: OLAH
  Gene Name: oleoyl-ACP hydrolase
  Uniprot ID: Q9NV23
  ENSP ID: ENSP00000367473
MERGDQPKRTRNENIFNCLYKNPEATFKLICFPWMGGGSTHFAKWGQDTHDLLEVHSLRLPGRESRVEEPLENDISQLVDEVVCALQPVIQDKPFAFFGHSMGSYIAFRTALGLKENNQPEPLHLFLSSATPVHSKAWHRIPKDDELSEEQISHYLMEFGGTPKHFAEAKEFVKQCSPIIRADLNIVRSCTSNVPSKAVLSCDLTCFVGSEDIAKDMEAWKDVTSGNAKIYQLPGGHFYLLDPANEKLIKNYIIKCLEVSSISNF

SEQ ID NO: 59383 - protein, 143 aa, Homo sapiens
  Payload ID: 11588
  Gene Symbol: OLAH
  Gene Name: oleoyl-ACP hydrolase
  ENSP ID: ENSP00000399290
MERGDQPKRTRNENIFNCLYKNPEATFKLICFPWMGGGSTHFAKWGQDTHDLLEVHSLRLPGRESRVEEPLENDISQLVDEVVCALQPVIQDKPFAFFGHSMGSYIAFRTALGLKENNQPEPLHLFLSSATPVHSKAWHRIPK

SEQ ID NO: 59384 - protein, 96 aa, Homo sapiens
  Payload ID: 11588
  Gene Symbol: OLAH
  Gene Name: oleoyl-ACP hydrolase
  ENSP ID: ENSP00000399449
MERGDQPKRTRNENIFNCLYKNPEATFKLICFPWMGGGSTHFAKWGQDTHDLLEETASHHVAKAGLKLRRSSDPPASAYPCAGVSHRRREPPCLAK

SEQ ID NO: 59385 - protein, 181 aa, Homo sapiens
  Payload ID: 11588
  Gene Symbol: OLAH
  Gene Name: oleoyl-ACP hydrolase
  ENSP ID: ENSP00000399663
MERGDQPKRTRNENIFNCLYKNPEATFKLICFPWMGGGSTHFAKWGQDTHDLLEVHSLRLPGRESRVEEPLENDISQLVDEVVCALQPVIQDKPFAFFGHSMGSYIAFRTALGLKENNQPEPLHLFLSSATPVHSKAWHRIPKDDELSEEQISHYLMEFGGTPKHFAEAKEFVKQCSPIIR

SEQ ID NO: 59386 - protein, 467 aa, Homo sapiens
  Payload ID: 11589
  Gene Symbol: OLFM1
  Gene Name: olfactomedin 1
  Uniprot ID: Q99784
  ENSP ID: ENSP00000252854
MPGRWRWQRDMHPARKLLSLLFLILMGTELTQVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVSNLEERLRACMQKLACGKLTGISDPVTVKTSGSRFGSWMTDPLAPEGDNRVWYMDGYHNNRFVREYKSMVDFMNTDNFTSHRLPHPWSGTGQVVYNGSIYFNKFQSHIIIRFDLKTETILKTRSLDYAGYNNMYHYAWGGHSDIDLMVDESGLWAVYATNQNAGNIVVSRLDPVSLQTLQTWNTSYPKRSAGEAFIICGTLYVTNGYSGGTKVHYAYQTNASTYEYIDIPFQNKYSHISMLDYNPKDRALYAWNNGHQILYNVTLFHVIRSDEL

SEQ ID NO: 59387 - protein, 135 aa, Homo sapiens
  Payload ID: 11589
  Gene Symbol: OLFM1
  Gene Name: olfactomedin 1
  Uniprot ID: Q99784
  ENSP ID: ENSP00000277415
MPGRWRWQRDMHPARKLLSLLFLILMGTELTQVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKG

SEQ ID NO: 59388 - protein, 163 aa, Homo sapiens
  Payload ID: 11589
  Gene Symbol: OLFM1
  Gene Name: olfactomedin 1
  ENSP ID: ENSP00000340318
MEGPGGSGFHLRLEAFCKCKSPINVFDPVRPALQVGLTRVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKAIKAKMDELRPLIPVLEEYKAD

SEQ ID NO: 59389 - protein, 485 aa, Homo sapiens
  Payload ID: 11589
  Gene Symbol: OLFM1
  Gene Name: olfactomedin 1
  Uniprot ID: Q99784
  ENSP ID: ENSP00000360858
MSVPLLKIGVVLSTMAMITNWMSQTLPSLVGLNTTKLSAAGGGTLDRSTGVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVSNLEERLRACMQKLACGKLTGISDPVTVKTSGSRFGSWMTDPLAPEGDNRVWYMDGYHNNRFVREYKSMVDFMNTDNFTSHRLPHPWSGTGQVVYNGSIYFNKFQSHIIIRFDLKTETILKTRSLDYAGYNNMYHYAWGGHSDIDLMVDESGLWAVYATNQNAGNIVVSRLDPVSLQTLQTWNTSYPKRSAGEAFIICGTLYVTNGYSGGTKVHYAYQTNASTYEYIDIPFQNKYSHISMLDYNPKDRALYAWNNGHQILYNVTLFHVIRSDEL

SEQ ID NO: 59390 - protein, 458 aa, Homo sapiens
  Payload ID: 11589
  Gene Symbol: OLFM1
  Gene Name: olfactomedin 1
  Uniprot ID: Q99784
  ENSP ID: ENSP00000360861
MGEAPGREGRGPCPQLESPRRRRVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVSNLEERLRACMQKLACGKLTGISDPVTVKTSGSRFGSWMTDPLAPEGDNRVWYMDGYHNNRFVREYKSMVDFMNTDNFTSHRLPHPWSGTGQVVYNGSIYFNKFQSHIIIRFDLKTETILKTRSLDYAGYNNMYHYAWGGHSDIDLMVDESGLWAVYATNQNAGNIVVSRLDPVSLQTLQTWNTSYPKRSAGEAFIICGTLYVTNGYSGGTKVHYAYQTNASTYEYIDIPFQNKYSHISMLDYNPKDRALYAWNNGHQILYNVTLFHVIRSDEL

SEQ ID NO: 59391 - protein, 167 aa, Homo sapiens
  Payload ID: 11589
  Gene Symbol: OLFM1
  Gene Name: olfactomedin 1
  ENSP ID: ENSP00000360864
MPGRWRWQRDMHPARKLLSLLFLILMGTELTQNKRENKAEKMGGPESERKTTGEKTLNELPLFCLEAHAGSLALPRMCSPNPNPAVGLCRPAYPQSPSPGAAQTISQSLLERFCMASRRGFLGPRKAWWRVVVVHCCWTDAFIHVHTHTHTCTHRGADTCREEPTRS

SEQ ID NO: 59392 - protein, 129 aa, Homo sapiens
  Payload ID: 11589
  Gene Symbol: OLFM1
  Gene Name: olfactomedin 1
  ENSP ID: ENSP00000360866
MPGRWRWQRDMHPARKLLSLLFLILMGTELTQDSAAPDSLLRSSKGSTRGSLAAIVIWRGKSESRIAKTPGIFRGGGTLVLPPTHTPEWLILPLGITLPLGAPETGGGDCAAETWKGSQRAGQLCALLA

SEQ ID NO: 59393 - protein, 153 aa, Homo sapiens
  Payload ID: 11589
  Gene Symbol: OLFM1
  Gene Name: olfactomedin 1
  Uniprot ID: Q99784
  ENSP ID: ENSP00000376717
MSVPLLKIGVVLSTMAMITNWMSQTLPSLVGLNTTKLSAAGGGTLDRSTGVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKG

SEQ ID NO: 59394 - protein, 99 aa, Homo sapiens
  Payload ID: 11589
  Gene Symbol: OLFM1
  Gene Name: olfactomedin 1
  ENSP ID: ENSP00000437906
  MOD_RES (1)..(1): Any amino acid
XSHKQHLARQFKAIKAKMDELRPLIPVLEEYKADAKLVLQFKEEVQNLTSVLNELQEEIGAYDYDELQSRVSNLEERLRACMQKLGVVHGRLSQQPLRT

SEQ ID NO: 59395 - protein, 208 aa, Homo sapiens
  Payload ID: 11589
  Gene Symbol: OLFM1
  Gene Name: olfactomedin 1
  ENSP ID: ENSP00000443806
MSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVSNLEERLRACMQKLACGKLTGISDPVTVKTSGSRFGSWMTDPLAPEGDNRVWYMDGYHNNRFVREYKSMVDFMNTDNFTSHRLPHPWSGTGQVVYNGSIY

SEQ ID NO: 59396 - protein, 129 aa, Homo sapiens
  Payload ID: 11589
  Gene Symbol: OLFM1
  Gene Name: olfactomedin 1
  ENSP ID: ENSP00000444296
MCSRDARTKQLRQLLEKVQNMSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVS

SEQ ID NO: 59397 - protein, 168 aa, Homo sapiens
  Payload ID: 11589
  Gene Symbol: OLFM1
  Gene Name: olfactomedin 1
  ENSP ID: ENSP00000479508
MPGRWRWQRDMHPARKLLSLLFLILMGTELTQNKRENKAEKMGGPESERKTTGEKTLNELPLFCLEAHAGSLALPRMCSPNPNPAVGLCRPAYPQSPSPGAAQTISQSLLERFCMASRRVFLAPGRPGGGWWLCTVAGQMHSFMCTHTHTHAHTGEQIPAEKSQPGPD

SEQ ID NO: 59398 - protein, 454 aa, Homo sapiens
  Payload ID: 11590
  Gene Symbol: OLFM2
  Gene Name: olfactomedin 2
  Uniprot ID: O95897
  ENSP ID: ENSP00000264833
MWPLTVPPPLLLLLCSGLAGQTLFQNPEEGWQLYTSAQAPDGKCICTAVIPAQSTCSRDGRSRELRQLMEKVQNVSQSMEVLELRTYRDLQYVRGMETLMRSLDARLRAADGSLSAKSFQELKDRMTELLPLSSVLEQYKADTRTIVRLREEVRNLSGSLAAIQEEMGAYGYEDLQQRVMALEARLHACAQKLGCGKLTGVSNPITVRAMGSRFGSWMTDTMAPSADSRVWYMDGYYKGRRVLEFRTLGDFIKGQNFIQHLLPQPWAGTGHVVYNGSLFYNKYQSNVVVKYHFRSRSVLVQRSLPGAGYNNTFPYSWGGFSDMDFMVDESGLWAVYTTNQNAGNIVVSRLDPHTLEVMRSWDTGYPKRSAGEAFMICGVLYVTNSHLAGAKVYFAYFTNTSSYEYTDVPFHNQYSHISMLDYNPRERALYTWNNGHQVLYNVTLFHVISTSGDP

SEQ ID NO: 59399 - protein, 376 aa, Homo sapiens
  Payload ID: 11590
  Gene Symbol: OLFM2
  Gene Name: olfactomedin 2
  ENSP ID: ENSP00000464877
MEVLELRTYRDLQYVRGMETLMRSLDARLRAADGSLSAKSFQELKDRMTELLPLSSVLEQYKADTRTIVRLREEVRNLSGSLAAIQEEMGAYGYEDLQQRVMALEARLHACAQKLGCGKLTGVSNPITVRAMGSRFGSWMTDTMAPSADSRVWYMDGYYKGRRVLEFRTLGDFIKGQNFIQHLLPQPWAGTGHVVYNGSLFYNKYQSNVVVKYHFRSRSVLVQRSLPGAGYNNTFPYSWGGFSDMDFMVDESGLWAVYTTNQNAGNIVVSRLDPHTLEVMRSWDTGYPKRSAGEAFMICGVLYVTNSHLAGAKVYFAYFTNTSSYEYTDVPFHNQYSHISMLDYNPRERALYTWNNGHQVLYNVTLFHVISTSGDP

SEQ ID NO: 59400 - protein, 335 aa, Homo sapiens
  Payload ID: 11590
  Gene Symbol: OLFM2
  Gene Name: olfactomedin 2
  ENSP ID: ENSP00000465809
MSVPLLKIGAVLSTMAMVTNWMSQTLPSLVGLNGTVSRAGASEKITLFQNPEEGWQLYTSAQAPDGKCICTAVIPAQSTCSRDGRSRELRQLMEKVQNVSQSMEVLELRTYRDLQYVRGMETLMRSLDARLRAADGSLSAKSFQELKDRMTELLPLSSVLEQYKADTRTIVRLREEVRNLSGSLAAIQEEMGAYGYEDLQQRVMALEARLHACAQKLGCGKLTGVSNPITVRAMGSRFGSWMTDTMAPSADSRVWYMDGYYKGRRVLEFRTLGDFIKGQNFIQHLLPQPWAGTGHVVYNGSLFYNKYQSNVVVKYHFRSRSVLVQRSLPGAGYNN

SEQ ID NO: 59401 - protein, 78 aa, Homo sapiens
  Payload ID: 11590
  Gene Symbol: OLFM2
  Gene Name: olfactomedin 2
  ENSP ID: ENSP00000466018
MEVLELRTYRDLQYVRGMETLMRSLDARLRAADGSLSAKSFQELKDRMTELLPLSSVLEQYKADTRTIVRLREEAVGS

SEQ ID NO: 59402 - protein, 478 aa, Homo sapiens
  Payload ID: 11591
  Gene Symbol: OLFM3
  Gene Name: olfactomedin 3
  Uniprot ID: Q96PB7
  ENSP ID: ENSP00000345192
MSPPLLKLGAVLSTMAMISNWMSQTLPSLVGLNTTRLSTPDTLTQISPKEGWQVYSSAQDPDGRCICTVVAPEQNLCSRDAKSRQLRQLLEKVQNMSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLTCGKLMKITGPVTVKTSGTRFGAWMTDPLASEKNNRVWYMDSYTNNKIVREYKSIADFVSGAESRTYNLPFKWAGTNHVVYNGSLYFNKYQSNIIIKYSFDMGRVLAQRSLEYAGFHNVYPYTWGGFSDIDLMADEIGLWAVYATNQNAGNIVISQLNQDTLEVMKSWSTGYPKRSAGESFMICGTLYVTNSHLTGAKVYYSYSTKTSTYEYTDIPFHNQYFHISMLDYNARDRALYAWNNGHQVLFNVTLFHIIKTEDDT

SEQ ID NO: 59403 - protein, 458 aa, Homo sapiens
  Payload ID: 11591
  Gene Symbol: OLFM3
  Gene Name: olfactomedin 3
  Uniprot ID: Q96PB7
  ENSP ID: ENSP00000359121
MQATSNLLNLLLLSLFAGLDPSKTQISPKEGWQVYSSAQDPDGRCICTVVAPEQNLCSRDAKSRQLRQLLEKVQNMSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLTCGKLMKITGPVTVKTSGTRFGAWMTDPLASEKNNRVWYMDSYTNNKIVREYKSIADFVSGAESRTYNLPFKWAGTNHVVYNGSLYFNKYQSNIIIKYSFDMGRVLAQRSLEYAGFHNVYPYTWGGFSDIDLMADEIGLWAVYATNQNAGNIVISQLNQDTLEVMKSWSTGYPKRSAGESFMICGTLYVTNSHLTGAKVYYSYSTKTSTYEYTDIPFHNQYFHISMLDYNARDRALYAWNNGHQVLFNVTLFHIIKTEDDT

SEQ ID NO: 59404 - protein, 140 aa, Homo sapiens
  Payload ID: 11591
  Gene Symbol: OLFM3
  Gene Name: olfactomedin 3
  Uniprot ID: Q96PB7
  ENSP ID: ENSP00000443471
MSQSIEVLNLRTQRDFQYVLKMETQMKGLKAKFRQIEDDRKTLMTKHFQELKEKMDELLPLIPVLEQYKTDAKLITQFKEEIRNLSAVLTGIQEEIGAYDYEELHQRVLSLETRLRDCMKKLIDLKKRKEEEKRQQKGEA

SEQ ID NO: 59405 - protein, 510 aa, Homo sapiens
  Payload ID: 11592
  Gene Symbol: OLFM4
  Gene Name: olfactomedin 4
  Uniprot ID: Q6UX06
  ENSP ID: ENSP00000219022
MRPGLSFLLALLFFLGQAAGDLGDVGPPIPSPGFSSFPGVDSSSSFSSSSRSGSSSSRSLGSGGSVSQLFSNFTGSVDDRGTCQCSVSLPDTTFPVDRVERLEFTAHVLSQKFEKELSKVREYVQLISVYEKKLLNLTVRIDIMEKDTISYTELDFELIKVEVKEMEKLVIQLKESFGGSSEIVDQLEVEIRNMTLLVEKLETLDKNNVLAIRREIVALKTKLKECEASKDQNTPVVHPPPTPGSCGHGGVVNISKPSVVQLNWRGFSYLYGAWGRDYSPQHPNKGLYWVAPLNTDGRLLEYYRLYNTLDDLLLYINARELRITYGQGSGTAVYNNNMYVNMYNTGNIARVNLTTNTIAVTQTLPNAAYNNRFSYANVAWQDIDFAVDENGLWVIYSTEASTGNMVISKLNDTTLQVLNTWYTKQYKPSASNAFMVCGVLYATRTMNTRTEEIFYYYDTNTGKEGKLDIVMHKMQEKVQSINYNPFDQKLYVYNDGYLLNYDLSVLQKPQ

SEQ ID NO: 59406 - protein, 402 aa, Homo sapiens
  Payload ID: 11593
  Gene Symbol: OLFML1
  Gene Name: olfactomedin-like 1
  Uniprot ID: Q6UWY5
  ENSP ID: ENSP00000332511
MMVALRGASALLVLFLAAFLPPPQCTQDPAMVHYIYQRFRVLEQGLEKCTQATRAYIQEFQEFSKNISVMLGRCQTYTSEYKSAVGNLALRVERAQREIDYIQYLREADECIESEDKTLAEMLLQEAEEEKKIRTLLNASCDNMLMGIKSLKIVKKMMDTHGSWMKDAVYNSPKVYLLIGSRNNTVWEFANIRAFMEDNTKPAPRKQILTLSWQGTGQVIYKGFLFFHNQATSNEIIKYNLQKRTVEDRMLLPGGVGRALVYQHSPSTYIDLAVDEHGLWAIHSGPGTHSHLVLTKIEPGTLGVEHSWDTPCRSQDAEASFLLCGVLYVVYSTGGQGPHRITCIYDPLGTISEEDLPNLFFPKRPRSHSMIHYNPRDKQLYAWNEGNQIIYKLQTKRKLPLK

SEQ ID NO: 59407 - protein, 68 aa, Homo sapiens
  Payload ID: 11593
  Gene Symbol: OLFML1
  Gene Name: olfactomedin-like 1
  ENSP ID: ENSP00000431558
MMVALRGASALLVLFLAAFLPPPQCTQDPAMVHYIYQRFRVLEGWKNVPKQRGHTFKNSKSSQKIYLS

SEQ ID NO: 59408 - protein, 402 aa, Homo sapiens; identical to SEQ ID NO: 59406
  Payload ID: 11593
  Gene Symbol: OLFML1
  Gene Name: olfactomedin-like 1
  Uniprot ID: Q6UWY5
  ENSP ID: ENSP00000433455

SEQ ID NO: 59409 - protein, 56 aa, Homo sapiens
  Payload ID: 11593
  Gene Symbol: OLFML1
  Gene Name: olfactomedin-like 1
  ENSP ID: ENSP00000434813
MMVALRGASALLVLFLAAFLPPPQCTQDPAMVHYIYQRFRVLEQGLEKCTQAVTTC

SEQ ID NO: 59410 - protein, 438 aa, Homo sapiens
  Payload ID: 11594
  Gene Symbol: OLFML2A
  Gene Name: olfactomedin-like 2A
  Uniprot ID: Q68BL7
  ENSP ID: ENSP00000288815
MSKRDKAGKDTARGKGKDISKYGSVQKSFADRGLPKPPKEKLLQVEKLRKESGKGSFLQPTAKPRALAQQQAVIRGFTYYKAGKQEVTEAVADNTLQGTSWLEQLPPKVEGRSNSAEPNSAEQDEAEPRSSERVDLASGTPTSIPATTTTATTTPTPTTSLLPTEPPSGPEVSSQGREASCEGTLRAVDPPVRHHSYGRHEGAWMKDPAARDDRIYVTNYYYGNSLVEFRNLENFKQGRWSNMYKLPYNWIGTGHVVYQGAFYYNRAFTKNIIKYDLRQRFVASWALLPDVVYEDTTPWKWRGHSDIDFAVDESGLWVIYPAVDDRDEAQPEVIVLSRLDPGDLSVHRETTWKTRLRRNSYGNCFLVCGILYAVDTYNQQEGQVAYAFDTHTGTDARPQLPFLNEHAYTTQIDYNPKERVLYAWDNGHQLTYTLHFVV

SEQ ID NO: 59411 - protein, 318 aa, Homo sapiens
  Payload ID: 11594
  Gene Symbol: OLFML2A
  Gene Name: olfactomedin-like 2A
  ENSP ID: ENSP00000336425
MAAAALPPRPLLLLPLVLLLSGRPTRADSKVFGDLDQVRMTSEGSDCRCKCIMRPLSKDACSRVRSGRARVEDFYTVETVSSGTDCRCSCTAPPSSLNPCENEWKMEKLKKQAPELLKSIKANLSRENEVVKDSVRHLSEQLRHYENHSAIMLGIKKELSRLGLQLLQKDAAAAPATPATGTGSKAQDTARGKGKDISKYGSVQKSFADRGLPKPPKEKLLQVEKLRKESGKGSFLQPTAKPRALAQQQAVIRGFTYYKAGKQEVTEAVADNTLQGTSWLEQLPPKVEGRSNSAEPNSAEQDEAEPRSSERVDLASGT

SEQ ID NO: 59412 - protein, 652 aa, Homo sapiens
  Payload ID: 11594
  Gene Symbol: OLFML2A
  Gene Name: olfactomedin-like 2A
  Uniprot ID: Q68BL7
  ENSP ID: ENSP00000362682
MAAAALPPRPLLLLPLVLLLSGRPTRADSKVFGDLDQVRMTSEGSDCRCKCIMRPLSKDACSRVRSGRARVEDFYTVETVSSGTDCRCSCTAPPSSLNPCENEWKMEKLKKQAPELLKLQSMVDLLEGTLYSMDLMKVHAYVHKVASQMNTLEESIKANLSRENEVVKDSVRHLSEQLRHYENHSAIMLGIKKELSRLGLQLLQKDAAAAPATPATGTGSKAQDTARGKGKDISKYGSVQKSFADRGLPKPPKEKLLQVEKLRKESGKGSFLQPTAKPRALAQQQAVIRGFTYYKAGKQEVTEAVADNTLQGTSWLEQLPPKVEGRSNSAEPNSAEQDEAEPRSSERVDLASGTPTSIPATTTTATTTPTPTTSLLPTEPPSGPEVSSQGREASCEGTLRAVDPPVRHHSYGRHEGAWMKDPAARDDRIYVTNYYYGNSLVEFRNLENFKQGRWSNMYKLPYNWIGTGHVVYQGAFYYNRAFTKNIIKYDLRQRFVASWALLPDVVYEDTTPWKWRGHSDIDFAVDESGLWVIYPAVDDRDEAQPEVIVLSRLDPGDLSVHRETTWKTRLRRNSYGNCFLVCGILYAVDTYNQQEGQVAYAFDTHTGTDARPQLPFLNEHAYTTQIDYNPKERVLYAWDNGHQLTYTLHFVV

SEQ ID NO: 59413 - protein, 750 aa, Homo sapiens
  Payload ID: 11595
  Gene Symbol: OLFML2B
  Gene Name: olfactomedin-like 2B
  Uniprot ID: Q68BL8
  ENSP ID: ENSP00000294794
MAKPRLLVLYFALIVVPAWVSSIVLTGTSEPPDAQTVAPAEDETLQNEADNQENVLSQLLGDYDKVKAMSEGSDCQCKCVVRPLGRDACQRINAGASRKEDFYTVETITSGSSCKCACVAPPSALNPCEGDFRLQKLREADSQDLKLSTIIDMLEGAFYGLDLLKLHSVTTKLVGRVDKLEEEVSKNLTKENEQIKEDMEEIRTEMNKRGKENCSENILDSMPDIRSALQRDAAAAYAHPEYEERFLQEETVSQQINSIELLQTRPLALPEVVKSQRPLQRQVHLRGRPASQPTVIRGITYYKAKVSEEENDIEEQQDEFFSGDNGVDLLIEDQLLRHNGLMTSVTRRPAATRQGHSTAVTSDLNARTAPWSSALPQPSTSDPSIANHASVGPTLQTTSVSPDPTRESVLQPSPQVPATTVAHTATQQPAAPAPPAVSPREALMEAMHTVPVPPTTVRTDSLGKDAPAGWGTTPASPTLSPEEEDDIRNVIGRCKDTLSTITGPTTQNTYGRNEGAWMKDPLAKDERIYVTNYYYGNTLVEFRNLENFKQGRWSNSYKLPYSWIGTGHVVYNGAFYYNRAFTRNIIKYDLKQRYVAAWAMLHDVAYEEATPWRWQGHSDVDFAVDENGLWLIYPALDDEGFSQEVIVLSKLNAADLSTQKETTWRTGLRRNFYGNCFVICGVLYAVDSYNQRNANISYAFDTHTNTQIVPRLLFENEYSYTTQIDYNPKDRLLYAWDNGHQVTYHVIFAY

SEQ ID NO: 59414 - protein, 233 aa, Homo sapiens
  Payload ID: 11595
  Gene Symbol: OLFML2B
  Gene Name: olfactomedin-like 2B
  Uniprot ID: Q68BL8
  ENSP ID: ENSP00000356915
MKDPLAKDERIYVTNYYYGNTLVEFRNLENFKQGRWSNSYKLPYSWIGTGHVVYNGAFYYNRAFTRNIIKYDLKQRYVAAWAMLHDVAYEEATPWRWQGHSDVDFAVDENGLWLIYPALDDEGFSQEVIVLSKLNAADLSTQKETTWRTGLRRNFYGNCFVICGVLYAVDSYNQRNANISYAFDTHTNTQIVPRLLFENEYSYTTQIDYNPKDRLLYAWDNGHQVTYHVIFAY

SEQ ID NO: 59415 - protein, 751 aa, Homo sapiens
  Payload ID: 11595
  Gene Symbol: OLFML2B
  Gene Name: olfactomedin-like 2B
  ENSP ID: ENSP00000356917
MAKPRLLVLYFALIVVPAWVSSIVLTGTSEPPDAQTVAPAEDETLQNEADNQENVLSQLLGDYDKVKAMSEGSDCQCKCVVRPLGRDACQRINAGASRKEDFYTVETITSGSSCKCACVAPPSALNPCEGDFRLQKLREADSQDLKLSTIIDMLEGAFYGLDLLKLHSVTTKLVGRVDKLEEEVSKNLTKENEQIKEDMEEIRTEMNKRGKENCSENILDSMPDIRSALQRDAAAAYAHPEQYEERFLQEETVSQQINSIELLQTRPLALPEVVKSQRPLQRQVHLRGRPASQPTVIRGITYYKAKVSEEENDIEEQQDEFFSGDNGVDLLIEDQLLRHNGLMTSVTRRPAATRQGHSTAVTSDLNARTAPWSSALPQPSTSDPSIANHASVGPTLQTTSVSPDPTRESVLQPSPQVPATTVAHTATQQPAAPAPPAVSPREALMEAMHTVPVPPTTVRTDSLGKDAPAGWGTTPASPTLSPEEEDDIRNVIGRCKDTLSTITGPTTQNTYGRNEGAWMKDPLAKDERIYVTNYYYGNTLVEFRNLENFKQGRWSNSYKLPYSWIGTGHVVYNGAFYYNRAFTRNIIKYDLKQRYVAAWAMLHDVAYEEATPWRWQGHSDVDFAVDENGLWLIYPALDDEGFSQEVIVLSKLNAADLSTQKETTWRTGLRRNFYGNCFVICGVLYAVDSYNQRNANISYAFDTHTNTQIVPRLLFENEYSYTTQIDYNPKDRLLYAWDNGHQVTYHVIFAY

SEQ ID NO: 59416 - protein, 88 aa, Homo sapiens
  Payload ID: 11595
  Gene Symbol: OLFML2B
  Gene Name: olfactomedin-like 2B
  ENSP ID: ENSP00000435212
TWRTGLRRNFYGNCFVICGVLYAVDSYNQRNANISYAFDTHTNTQIVPRLLFENEYSYTTQIDYNPKDRLLYAWDNGHQVTYHVIFAY

SEQ ID NO: 59417 - protein, 90 aa, Homo sapiens
  Payload ID: 11595
  Gene Symbol: OLFML2B
  Gene Name: olfactomedin-like 2B
  ENSP ID: ENSP00000436707
ETTWRTGLRRNFYGNCFVICGVLYAVDSYNQRNANISYAFDTHTNTQIVPRLLFENEYSYTTQIDYNPKDRLLYAWDNGHQVTYHVIFAY

SEQ ID NO: 59418 - protein, 406 aa, Homo sapiens
  Payload ID: 11596
  Gene Symbol: OLFML3
  Gene Name: olfactomedin-like 3
  Uniprot ID: Q9NRN5
  ENSP ID: ENSP00000322273
MGPSTPLLILFLLSWSGPLQGQQHHLVEYMERRLAALEERLAQCQDQSSRHAAELRDFKNKMLPLLEVAEKEREALRTEADTISGRVDRLEREVDYLETQNPALPCVEFDEKVTGGPGTKGKGRRNEKYDMVTDCGYTISQVRSMKILKRFGGPAGLWTKDPLGQTEKIYVLDGTQNDTAFVFPRLRDFTLAMAARKASRVRVPFPWVGTGQLVYGGFLYFARRPPGRPGGGGEMENTLQLIKFHLANRTVVDSSVFPAEGLIPPYGLTADTYIDLAADEEGLWAVYATREDDRHLCLAKLDPQTLDTEQQWDTPCPRENAEAAFVICGTLYVVYNTRPASRARIQCSFDASGTLTPERAALPYFPRRYGAHASLRYNPRERQLYAWDDGYQIVYKLEMRKKEEEV

SEQ ID NO: 59419 - protein, 386 aa, Homo sapiens
  Payload ID: 11596
  Gene Symbol: OLFML3
  Gene Name: olfactomedin-like 3
  Uniprot ID: Q9NRN5
  ENSP ID: ENSP00000358564
MAQWHCSQRTQAGGHGVGERLAQCQDQSSRHAAELRDFKNKMLPLLEVAEKEREALRTEADTISGRVDRLEREVDYLETQNPALPCVEFDEKVTGGPGTKGKGRRNEKYDMVTDCGYTISQVRSMKILKRFGGPAGLWTKDPLGQTEKIYVLDGTQNDTAFVFPRLRDFTLAMAARKASRVRVPFPWVGTGQLVYGGFLYFARRPPGRPGGGGEMENTLQLIKFHLANRTVVDSSVFPAEGLIPPYGLTADTYIDLAADEEGLWAVYATREDDRHLCLAKLDPQTLDTEQQWDTPCPRENAEAAFVICGTLYVVYNTRPASRARIQCSFDASGTLTPERAALPYFPRRYGAHASLRYNPRERQLYAWDDGYQIVYKLEMRKKEEEV

SEQ ID NO: 59420 - protein, 345 aa, Homo sapiens
  Payload ID: 11596
  Gene Symbol: OLFML3
  Gene Name: olfactomedin-like 3
  ENSP ID: ENSP00000376977
MLPLLEVAEKEREALRTEADTISGRVDRLEREVDYLETQNPALPCVEFDEKVTGGPGTKGKGRRNEKYDMVTDCGYTISQVRSMKILKRFGGPAGLWTKDPLGQTEKIYVLDGTQNDTAFVFPRLRDFTLAMAARKASRVRVPFPWVGTGQLVYGGFLYFARRPPGRPGGGGEMENTLQLIKFHLANRTVVDSSVFPAEGLIPPYGLTADTYIDLAADEEGLWAVYATREDDRHLCLAKLDPQTLDTEQQWDTPCPRENAEAAFVICGTLYVVYNTRPASRARIQCSFDASGTLTPERAALPYFPRRYGAHASLRYNPRERQLYAWDDGYQIVYKLEMRKKEEEV

SEQ ID NO: 59421 - protein, 163 aa, Homo sapiens
  Payload ID: 11597
  Gene Symbol: OMP
  Gene Name: olfactory marker protein
  Uniprot ID: P47874
  ENSP ID: ENSP00000436376
MAEDRPQQPQLDMPLVLDQGLTRQMRLRVESLKQRGEKRQDGEKLLQPAESVYRLNFTQQQRLQFERWNVVLDKPGKVTITGTSQNWTPDLTNLMTRQLLDPTAIFWRKEDSDAIDWNEADALEFGERLSDLAKIRKVMYFLVTFGEGVEPANLKASVVFNQL

SEQ ID NO: 59422 - protein, 314 aa, Homo sapiens
  Payload ID: 11598
  Gene Symbol:
  Gene Name: Olfactory receptor 10A6  [Source:UniProtKB/Swiss-Prot
  Acc:Q8NH74]
  Uniprot ID: Q8NH74
  ENSP ID: ENSP00000478945
MERQNQSCVVEFILLGFSNYPELQGQLFVAFLVIYLVTLIGNAIIIVIVSLDQSLHVPMYLFLLNLSVVDLSFSAVIMPEMLVVLSTEKTTISFGGCFAQMYFILLFGGAECFLLGAMAYDRFAAICHPLNYQMIMNKGVFMKLIIFSWALGFMLGTVQTSWVSSFPFCGLNEINHISCETPAVLELACADTFLFEIYAFTGTFLIILVPFLLILLSYIRVLFAILKMPSTTGRQKAFSTCAAHLTSVTLFYGTASMTYLQPKSGYSPETKKVMSLSYSLLTPLLNLLIYSLRNSEMKRALMKLWRRRVVLHTI

SEQ ID NO: 59423 - protein, 314 aa, Homo sapiens; identical to SEQ ID NO: 59422
  Payload ID: 11598
  Gene Symbol:
  Gene Name: Olfactory receptor 10A6  [Source:UniProtKB/Swiss-Prot
  Acc:Q8NH74]
  Uniprot ID: Q8NH74
  ENSP ID: ENSP00000485518

SEQ ID NO: 59424 - protein, 314 aa, Homo sapiens; identical to SEQ ID NO: 59422
  Payload ID: 11598
  Gene Symbol:
  Gene Name: Olfactory receptor 10A6  [Source:UniProtKB/Swiss-Prot
  Acc:Q8NH74]
  Uniprot ID: Q8NH74
  ENSP ID: ENSP00000485676

SEQ ID NO: 59425 - protein, 314 aa, Homo sapiens; identical to SEQ ID NO: 59422
  Payload ID: 11598
  Gene Symbol:
  Gene Name: Olfactory receptor 10A6  [Source:UniProtKB/Swiss-Prot
  Acc:Q8NH74]
  Uniprot ID: Q8NH74
  ENSP ID: ENSP00000486077

SEQ ID NO: 59426 - protein, 314 aa, Homo sapiens; identical to SEQ ID NO: 59422
  Payload ID: 11598
  Gene Symbol:
  Gene Name: Olfactory receptor 10A6  [Source:UniProtKB/Swiss-Prot
  Acc:Q8NH74]
  Uniprot ID: Q8NH74
  ENSP ID: ENSP00000486810

SEQ ID NO: 59427 - protein, 314 aa, Homo sapiens; identical to SEQ ID NO: 59422
  Payload ID: 11598
  Gene Symbol:
  Gene Name: Olfactory receptor 10A6  [Source:UniProtKB/Swiss-Prot
  Acc:Q8NH74]
  Uniprot ID: Q8NH74
  ENSP ID: ENSP00000487179

SEQ ID NO: 59428 - protein, 326 aa, Homo sapiens
  Payload ID: 11599
  Gene Symbol:
  Gene Name: Olfactory receptor 10X1  [Source:UniProtKB/Swiss-Prot
  Acc:Q8NGY0]
  Uniprot ID: Q8NGY0
  ENSP ID: ENSP00000485062
MVLNVYCCFFQISDIQTMKINQTILKEFILVGFSVYPHVQTFLFVVFFCLYLLTLAGNLIIMGLTWVDRSLHTPMYLFLSALSFSETCYTLTIVPKMLEDLLAKDRSISVTGCSLQMCFFLGLGGTNCIILTLMGYDRFLAICNPLRYPLLMTNIVCGQLVASACTAGFFISLTETALIFRDSFCRPNLVKHFFCHMLAVIRLSCIDSNHTEFIITLISVSGLLGTLLLIILTDVFIISTVLRIPSAEGKQKAFTTCASHLTVVIIHFGFASIVYLKPEASGDDTLIAVPYTVITPFLSPIIFSLRNKDMKNAFRRMMGNTVALKK

SEQ ID NO: 59429 - protein, 326 aa, Homo sapiens; identical to SEQ ID NO: 59428
  Payload ID: 11599
  Gene Symbol:
  Gene Name: Olfactory receptor 10X1  [Source:UniProtKB/Swiss-Prot
  Acc:Q8NGY0]
  Uniprot ID: Q8NGY0
  ENSP ID: ENSP00000485609

SEQ ID NO: 59430 - protein, 316 aa, Homo sapiens
  Payload ID: 11600
  Gene Symbol:
  Gene Name: Olfactory receptor 2T11  [Source:UniProtKB/Swiss-Prot
  Acc:Q8NH01]
  Uniprot ID: Q8NH01
  ENSP ID: ENSP00000485254
MTNTSSSDFTLLGLLVNSEAAGIVFTVILAVFLGAVTANLVMIFLIQVDSRLHTPMYFLLSQLSIMDTLFICTTVPKLLADMVSKEKIISFVACGIQIFLYLTMIGSEFFLLGLMAYDCYVAVCNPLRYPVLMNRKKCLLLAAGAWFGGSLDGFLLTPITMNVPYCGSRSINHFFCEIPAVLKLACADTSLYETLMYICCVLMLLIPISIISTSYSLILLTIHRMPSAEGRKKAFTTCSSHLTVVSIFYGAAFYTYVLPQSFHTPEQDKVVSAFYTIVTPMLNPLIYSLRNKDVIGAFKKVFACCSSAQKVATSDA

SEQ ID NO: 59431 - protein, 316 aa, Homo sapiens; identical to SEQ ID NO: 59430
  Payload ID: 11600
  Gene Symbol:
  Gene Name: Olfactory receptor 2T11  [Source:UniProtKB/Swiss-Prot
  Acc:Q8NH01]
  Uniprot ID: Q8NH01
  ENSP ID: ENSP00000485455

SEQ ID NO: 59432 - protein, 310 aa, Homo sapiens
  Payload ID: 11601
  Gene Symbol:
  Gene Name: Olfactory receptor 4C16  [Source:UniProtKB/Swiss-Prot
  Acc:Q8NGL9]
  Uniprot ID: Q8NGL9
  ENSP ID: ENSP00000485295
MQLNNNVTEFILLGLTQDPFWKKIVFVIFLRLYLGTLLGNLLIIISVKTSQALKNPMFFFLFYLSLSDTCLSTSITPRMIVDALLKKTTISFSECMIQVFSSHVFGCLEIFILILTAVDRYVDICKPLHYMTIISQWVCGVLMAVAWVGSCVHSLVQIFLALSLPFCGPNVINHCFCDLQPLLKQACSETYVVNLLLVSNSGAICAVSYVMLIFSYVIFLHSLRNHSAEVIKKALSTCVSHIIVVILFFGPCIFMYTCLATVFPMDKMIAVFYTVGTSFLNPVIYTLKNTEVKSAMRKLWSKKLITDDKR

SEQ ID NO: 59433 - protein, 310 aa, Homo sapiens; identical to SEQ ID NO: 59432
  Payload ID: 11601
  Gene Symbol:
  Gene Name: Olfactory receptor 4C16  [Source:UniProtKB/Swiss-Prot
  Acc:Q8NGL9]
  Uniprot ID: Q8NGL9
  ENSP ID: ENSP00000485647

SEQ ID NO: 59434 - protein, 313 aa, Homo sapiens
  Payload ID: 11602
  Gene Symbol:
  Gene Name: Olfactory receptor 4M2  [Source:UniProtKB/Swiss-Prot
  Acc:Q8NGB6]
  Uniprot ID: Q8NGB6
  ENSP ID: ENSP00000329467
METANYTKVTEFVLTGLSQTPEVQLVLFVIFLSFYLFILPGNILIICTISLDPHLTSPMYFLLANLAFLDIWYSSITAPEMLIDFFVERKIISFDECIAQLFFLHFAGASEMFLLTVMAFDLYTAICRPLHYATIMNQRLCCILVALSWRGGFIHSIIQVALIVRLPFCGPNELDSYFCDITQVVRIACANTFPEELVMICSSGLISVVCLIALLMSYAFLLALLKKLSGSGENTNRAVSTCYSHITIVVLMFGPSIYIYARPFDSFSLDKVVSVFNTLIFPLHNPIIYTLRNKEVKAAMRKLVTKYILCKEK

SEQ ID NO: 59435 - protein, 303 aa, Homo sapiens
  Payload ID: 11603
  Gene Symbol:
  Gene Name: Olfactory receptor 4X2  [Source:UniProtKB/Swiss-Prot
  Acc:Q8NGF9]
  Uniprot ID: Q8NGF9
  ENSP ID: ENSP00000307751
MTEFIFLVLSPNQEVQRVCFVIFLFLYTAIVLGNFLIVLTVMTSRSLGSPMYFFLSYLSFMEICYSSATAPKLISDLLAERKVISWWGCMAQLFFLHFFGGTEIFLLTVMAYDHYVAICKPLSYTTIMNWQVCTVLVGIAWVGGFMHSFAQILLIFHLLFCGPNVINHYFCDLVPLLKLACSDTFLIGLLIVANGGTLSVISFGVLLASYMVILLHLRTWSSEGWCKALSTCGSHFAVVILFFGPCVFNSLRPSTTLPIDKMVAVFYTVITAILNPVIYSLRNAEMRKAMKRLWIRTLRLNEK

SEQ ID NO: 59436 - protein, 303 aa, Homo sapiens; identical to SEQ ID NO: 59435
  Payload ID: 11603
  Gene Symbol:
  Gene Name: Olfactory receptor 4X2  [Source:UniProtKB/Swiss-Prot
  Acc:Q8NGF9]
  Uniprot ID: Q8NGF9
  ENSP ID: ENSP00000485431

SEQ ID NO: 59437 - protein, 319 aa, Homo sapiens
  Payload ID: 11604
  Gene Symbol:
  Gene Name: Olfactory receptor 51F1  [Source:UniProtKB/Swiss-Prot
  Acc:A6NGY5]
  Uniprot ID: A6NGY5
  ENSP ID: ENSP00000369744
MLQNQDTMEILSNSTSKFPTFLLTGIPGLESAHVWISIPFCCFYAIALSGNSVILFVIITQQSLHEPMYYFLFRLSATDLGLTVSSLSTTLGILWFEAREISLYSCIVQMFFLHGFTFMESGVLVATAFDRYVAICDPLRYTTILTNSRIIQMGLLMITRAIVLILPLLLLLKPLYFCRMNALSHSYCYHPDVIQLACSDIRANSICGLIDLILTTGIDTPCIVLSYILIIHSVLRIASPEEWHKVFSTCVSHVGAVAFFYIHMLSLSLVYRYGRSAPRVVHSVMANVYLLLPPVLNPIIDSVKTKQIRKAMLSLLLTK

SEQ ID NO: 59438 - protein, 312 aa, Homo sapiens
  Payload ID: 11604
  Gene Symbol:
  Gene Name: Olfactory receptor 51F1  [Source:UniProtKB/Swiss-Prot
  Acc:A6NGY5]
  ENSP ID: ENSP00000485387
MEILSNSTSKFPTFLLTGIPGLESAHVWISIPFCCFYAIALSGNSVILFVIITQQSLHEPMYYFLFRLSATDLGLTVSSLSTTLGILWFEAREISLYSCIVQMFFLHGFTFMESGVLVATAFDRYVAICDPLRYTTILTNSRIIQMGLLMITRAIVLILPLLLLLKPLYFCRMNALSHSYCYHPDVIQLACSDIRANSICGLIDLILTTGIDTPCIVLSYILIIHSVLRIASPEEWHKVFSTCVSHVGAVAFFYIHMLSLSLVYRYGRSAPRVVHSVMANVYLLLPPVLNPIIDSVKTKQIRKAMLSLLLTK

SEQ ID NO: 59439 - protein, 315 aa, Homo sapiens
  Payload ID: 11605
  Gene Symbol:
  Gene Name: Olfactory receptor 52R1  [Source:UniProtKB/Swiss-Prot
  Acc:Q8NGF1]
  Uniprot ID: Q8NGF1
  ENSP ID: ENSP00000485292
MVLASGNSSSHPVSFILLGIPGLESFQLWIAFPFCATYAVAVVGNITLLHVIRIDHTLHEPMYLFLAMLAITDLVLSSSTQPKMLAIFWFHAHEIQYHACLIQVFFIHAFSSVESGVLMAMALDCYVAICFPLRHSSILTPSVVIKLGTIVMLRGLLWVSPFCFMVSRMPFCQHQAIPQSYCEHMAVLKLVCADTSISRGNGLFVAFSVAGFDMIVIGMSYVMILRAVLQLPSGEARLKAFSTRSSHICVILALYIPALFSFLTYRFGHDVPRVVHILFANLYLLIPPMLNPIIYGVRTKQIGDRVIQGCCGNIP

SEQ ID NO: 59440 - protein, 315 aa, Homo sapiens; identical to SEQ ID NO: 59439
  Payload ID: 11605
  Gene Symbol:
  Gene Name: Olfactory receptor 52R1  [Source:UniProtKB/Swiss-Prot
  Acc:Q8NGF1]
  Uniprot ID: Q8NGF1
  ENSP ID: ENSP00000485549

SEQ ID NO: 59441 - protein, 310 aa, Homo sapiens
  Payload ID: 11606
  Gene Symbol:
  Gene Name: Olfactory receptor 5AR1  [Source:UniProtKB/Swiss-Prot
  Acc:Q8NGP9]
  Uniprot ID: Q8NGP9
  ENSP ID: ENSP00000302639
MDKENSSMVTEFIFMGITQDPQMEIIFFVVFLIVYLVNVVGNIGMIILITTDTQLHTPMYFFLCNLSFVDLGYSSAIAPRMLADFLTNHKVISFSSCATQFAFFVGFVDAECYVLAAMAYGRFVAICRPLHYSTFMSKQVCLALMLGSYLAGLVSLVAHTTLTFSLSYCGSNIINHFFCEIPPLLALSCSDTYISEILLFSLCGFIEFSTILIIFISYTFILVAIIRMRSAEGRLKAFSTCGSHLTGITLFYGTVMFMYLRPTSSYSLDQDKWASVFYTVIIPMLNPLIYSLRNKDVKAAFKKLIGKKSQ

SEQ ID NO: 59442 - protein, 310 aa, Homo sapiens; identical to SEQ ID NO: 59441
  Payload ID: 11606
  Gene Symbol:
  Gene Name: Olfactory receptor 5AR1  [Source:UniProtKB/Swiss-Prot
  Acc:Q8NGP9]
  Uniprot ID: Q8NGP9
  ENSP ID: ENSP00000485240

SEQ ID NO: 59443 - protein, 311 aa, Homo sapiens
  Payload ID: 11607
  Gene Symbol:
  Gene Name: Olfactory receptor 5L1  [Source:UniProtKB/Swiss-Prot
  Acc:Q8NGL2]
  Uniprot ID: Q8NGL2
  ENSP ID: ENSP00000485319
MGKENCTTVAEFILLGLSDVPELRVCLFLLFLLIYGVTLLANLGMIALIQVSSRLHTPMYFFLSHLSSVDFCYSSIIVPKMLANIFNKDKAISFLGCMVQFYLFCTCVVTEVFLLAVMAYDRFVAICNPLLYTVTMSWKVRVELASCCYFCGTVCSLIHLCLALRIPFYRSNVINHFFCDLPPVLSLACSDITVNETLLFLVATLNESVTIMIILTSYLLILTTILKMGSAEGRHKAFSTCASHLTAITVFHGTVLSIYCRPSSGNSGDADKVATVFYTVVIPMLNSVIYSLRNKDVKEALRKVMGSKIHS

SEQ ID NO: 59444 - protein, 311 aa, Homo sapiens; identical to SEQ ID NO: 59443
  Payload ID: 11607
  Gene Symbol:
  Gene Name: Olfactory receptor 5L1  [Source:UniProtKB/Swiss-Prot
  Acc:Q8NGL2]
  Uniprot ID: Q8NGL2
  ENSP ID: ENSP00000485509

SEQ ID NO: 59445 - protein, 324 aa, Homo sapiens
  Payload ID: 11608
  Gene Symbol:
  Gene Name: Olfactory receptor 5R1  [Source:UniProtKB/Swiss-Prot
  Acc:Q8NH85]
  Uniprot ID: Q8NH85
  ENSP ID: ENSP00000485063
MAEVNIIYVTVFILKGITNRPELQAPCFGVFLVIYLVTVLGNLGLITLIKIDTRLHTPMYYFLSHLAFVDLCYSSAITPKMMVNFVVERNTIPFHACATQLGCFLTFMITECFLLASMAYDCYVAICSPLHYSTLMSRRVCIQLVAVPYIYSFLVALFHTVITFRLTYCGPNLINHFYCDDLPFLALSCSDTHMKEILIFAFAGFDMISSSSIVLTSYIFIIAAILRIRSTQGQHKAISTCGSHMVTVTIFYGTLIFMYLQPKSNHSLDTDKMASVFYTVVIPMLNPLIYSLRNKEVKDASKKALDKGCENLQILTFLKIRKLY

SEQ ID NO: 59446 - protein, 324 aa, Homo sapiens; identical to SEQ ID NO: 59445
  Payload ID: 11608
  Gene Symbol:
  Gene Name: Olfactory receptor 5R1  [Source:UniProtKB/Swiss-Prot
  Acc:Q8NH85]
  Uniprot ID: Q8NH85
  ENSP ID: ENSP00000485324

SEQ ID NO: 59447 - protein, 317 aa, Homo sapiens
  Payload ID: 11609
  Gene Symbol:
  Gene Name: Olfactory receptor 6Q1  [Source:UniProtKB/Swiss-Prot
  Acc:Q8NGQ2]
  Uniprot ID: Q8NGQ2
  ENSP ID: ENSP00000307734
MQPYTKNWTQVTEFVMMGFAGIHEAHLLFFILFLTMYLFTLVENLAIILVVGLDHRLRRPMYFFLTHLSCLEIWYTSVTVPKMLAGFIGVDGGKNISYADCLSQLFIFTFLGATECFLLAAMAYDRYVAICMPLHYGAFVSWGTCIRLAAACWLVGFLTPILPIYLLSQLTFYGPNVIDHFSCDASPLLALSCSDVTWKETVDFLVSLAVLLASSMVIAVSYGNIVWTLLHIRSAAERWKAFSTCAAHLTVVSLFYGTLFFMYVQTKVTSSINFNKVVSVFYSVVTPMLNPLIYSLRNKEVKGALGRVFSLNFWKGQ

SEQ ID NO: 59448 - protein, 317 aa, Homo sapiens; identical to SEQ ID NO: 59447
  Payload ID: 11609
  Gene Symbol:
  Gene Name: Olfactory receptor 6Q1  [Source:UniProtKB/Swiss-Prot
  Acc:Q8NGQ2]
  Uniprot ID: Q8NGQ2
  ENSP ID: ENSP00000485102

SEQ ID NO: 59449 - protein, 309 aa, Homo sapiens
  Payload ID: 11610
  Gene Symbol:
  Gene Name: Olfactory receptor 8B4  [Source:UniProtKB/Swiss-Prot
  Acc:Q96RC9]
  Uniprot ID: Q96RC9
  ENSP ID: ENSP00000348449
MTLRNSSSVTEFILVGLSEQPELQLPLFLLFLGIYVFTVVGNLGLITLIGINPSLHTPMYFFLFNLSFIDLCYSCVFTPKMLNDFVSESIISYVGCMTQLFFFCFFVNSECYVLVSMAYDRYVAICNPLLYMVTMSPRVCFLLMFGSYVVGFAGAMAHTGSMLRLTFCDSNVIDHYLCDVLPLLQLSCTSTHVSELVFFIVVGVITMLSSISIVISYALILSNILCIPSAEGRSKAFSTWGSHIIAVALFFGSGTFTYLTTSFPGSMNHGRFASVFYTNVVPMLNPSIYSLRNKDDKLALGKTLKRVLF

SEQ ID NO: 59450 - protein, 309 aa, Homo sapiens; identical to SEQ ID NO: 59449
  Payload ID: 11610
  Gene Symbol:
  Gene Name: Olfactory receptor 8B4  [Source:UniProtKB/Swiss-Prot
  Acc:Q96RC9]
  Uniprot ID: Q96RC9
  ENSP ID: ENSP00000485485

SEQ ID NO: 59451 - protein, 309 aa, Homo sapiens
  Payload ID: 11611
  Gene Symbol: OR1A1
  Gene Name: olfactory receptor, family 1, subfamily A, member 1
  Uniprot ID: Q9P1Q5
  ENSP ID: ENSP00000305207
MRENNQSSTLEFILLGVTGQQEQEDFFYILFLFIYPITLIGNLLIVLAICSDVRLHNPMYFLLANLSLVDIFFSSVTIPKMLANHLLGSKSISFGGCLTQMYFMIALGNTDSYILAAMAYDRAVAISRPLHYTTIMSPRSCIWLIAGSWVIGNANALPHTLLTASLSFCGNQEVANFYCDITPLLKLSCSDIHFHVKMMYLGVGIFSVPLLCIIVSYIRVFSTVFQVPSTKGVLKAFSTCGSHLTVVSLYYGTVMGTYFRPLTNYSLKDAVITVMYTAVTPMLNPFIYSLRNRDMKAALRKLFNKRISS

SEQ ID NO: 59452 - protein, 309 aa, Homo sapiens
  Payload ID: 11612
  Gene Symbol: OR1A2
  Gene Name: olfactory receptor, family 1, subfamily A, member 2
  Uniprot ID: Q9Y585
  ENSP ID: ENSP00000371377
MKKENQSFNLDFILLGVTSQQEQNNVFFVIFLCIYPITLTGNLLIILAICADIRLHNPMYFLLANLSLVDIIFSSVTIPKVLANHLLGSKFISFGGCLMQMYFMIALAKADSYTLAAMAYDRAVAISCPLHYTTIMSPRSCILLIAGSWVIGNTSALPHTLLTASLSFCGNQEVANFYCDIMPLLKLSCSDVHFNVKMMYLGVGVFSLPLLCIIVSYVQVFSTVFQVPSTKSLFKAFCTCGSHLTVVFLYYGTTMGMYFRPLTSYSPKDAVITVMYVAVTPALNPFIYSLRNWDMKAALQKLFSKRISS

SEQ ID NO: 59453 - protein, 318 aa, Homo sapiens
  Payload ID: 11613
  Gene Symbol: OR1B1
  Gene Name: olfactory receptor, family 1, subfamily B, member 1 (gene/pseudogene)
  Uniprot ID: Q8NGR6
  ENSP ID: ENSP00000303151
MMSFAPNASHSPVFLLLGFSRANISYTLLFFLFLAIYLTTILGNVTLVLLISWDSRLHSPMYYLLRGLSVIDMGLSTVTLPQLLAHLVSHYPTIPAARCLAQFFFFYAFGVTDTLVIAVMALDRYVAICDPLHYALVMNHQRCACLLALSWVVSILHTMLRVGLVLPLCWTGDAGGNVNLPHFFCDHRPLLRASCSDIHSNELAIFFEGGFLMLGPCALIVLSYVRIGAAILRLPSAAGRRRAVSTCGSHLTMVGFLYGTIICVYFQPPFQNSQYQDMVASVMYTAITPLANPFVYSLHNKDVKGALCRLLEWVKVDP

SEQ ID NO: 59454 - protein, 314 aa, Homo sapiens
  Payload ID: 11614
  Gene Symbol: OR1C1
  Gene Name: olfactory receptor, family 1, subfamily C, member 1
  Uniprot ID: Q15619
  ENSP ID: ENSP00000386138
MEKRNLTVVREFVLLGLPSSAEQQHLLSVLFLCMYLATTLGNMLIIATIGFDSHLHSPMYFFLSNLAFVDICFTSTTVPQMVVNILTGTKTISFAGCLTQLFFFVSFVNMDSLLLCVMAYDRYVAICHPLHYTARMNLCLCVQLVAGLWLVTYLHALLHTVLIAQLSFCASNIIHHFFCDLNPLLQLSCSDVSFNVMIIFAVGGLLALTPLVCILVSYGLIFSTVLKITSTQGKQRAVSTCSCHLSVVVLFYGTAIAVYFSPSSPHMPESDTLSTIMYSMVAPMLNPFIYTLRNRDMKRGLQKMLLKCTVFQQQ

SEQ ID NO: 59455 - protein, 312 aa, Homo sapiens
  Payload ID: 11615
  Gene Symbol: OR1D2
  Gene Name: olfactory receptor, family 1, subfamily D, member 2
  Uniprot ID: P34982
  ENSP ID: ENSP00000327585
MDGGNQSEGSEFLLLGMSESPEQQRILFWMFLSMYLVTVVGNVLIILAISSDSRLHTPVYFFLANLSFTDLFFVTNTIPKMLVNLQSHNKAISYAGCLTQLYFLVSLVALDNLILAVMAYDRYVAICCPLHYTTAMSPKLCILLLSLCWVLSVLYGLIHTLLMTRVTFCGSRKIHYIFCEMYVLLRMACSNIQINHTVLIATGCFIFLIPFGFVIISYVLIIRAILRIPSVSKKYKAFSTCASHLGAVSLFYGTLCMVYLKPLHTYSVKDSVATVMYAVVTPMMNPFIYSLRNKDMHGALGRLLDKHFKRLT

SEQ ID NO: 59456 - protein, 312 aa, Homo sapiens
  Payload ID: 11616
  Gene Symbol: OR1D5
  Gene Name: olfactory receptor, family 1, subfamily D, member 5
  Uniprot ID: P58170
  ENSP ID: ENSP00000459028
MDGDNQSENSQFLLLGISESPEQQRILFWMFLSMYLVTVLGNVLIILAISSDSHLHTPMYFFLANLSFTDLFFVTNTIPKMLVNFQSQNKAISYAGCLTQLYFLVSLVTLDNLILAVMAYDRYVATCCPLHYVTAMSPGLCVLLLSLCWGLSVLYGLLLTFLLTRVTFCGPREIHYLFCDMYILLWLACSNTHIIHTALIATGCFIFLTPLGFMTTSYVRIVRTILQMPSASKKYKTFSTCASHLGVVSLFYGTLAMVYLQPLHTYSMKDSVATVMYAVLTPMMNPFIYRLRNKDMHGAPGRVLWRPFQRPK

SEQ ID NO: 59457 - protein, 314 aa, Homo sapiens
  Payload ID: 11617
  Gene Symbol: OR1E1
  Gene Name: olfactory receptor, family 1, subfamily E, member 1
  Uniprot ID: P30953
  ENSP ID: ENSP00000313384
MMGQNQTSISDFLLLGLPIQPEQQNLCYALFLAMYLTTLLGNLLIIVLIRLDSHLHTPMYLFLSNLSFSDLCFSSVTIPKLLQNMQNQDPSIPYADCLTQMYFFLLFGDLESFLLVAMAYDRYVAICFPLHYTAIMSPMLCLALVALSWVLTTFHAMLHTLLMARLCFCADNVIPHFFCDMSALLKLAFSDTRVNEWVIFIMGGLILVIPFLLILGSYARIVSSILKVPSSKGICKAFSTCGSHLSVVSLFYGTVIGLYLCSSANSSTLKDTVMAMMYTVVTPMLNPFIYSLRNRDMKGALSRVIHQKKTFFSL

SEQ ID NO: 59458 - protein, 323 aa, Homo sapiens
  Payload ID: 11618
  Gene Symbol: OR1E2
  Gene Name: olfactory receptor, family 1, subfamily E, member 2
  Uniprot ID: P47887
  ENSP ID: ENSP00000248384
MMGQNQTSISDFLLLGLPIQPEQQNLCYALFLAMYLTTLLGNLLIIVLIRLDSHLHTPVYLFLSNLSFSDLCFSSVTMPKLLQNMQNQDPSIPYADCLTQMYFFLYFSDLESFLLVAMAYDRYVAICFPMHYTAICFLLHYTAIMSPMLCLSVVALSWVLTTFHAMLHTLLMARLCFCADNVIPHFFCDMSALLKLACSDTRVNEWVIFIMGGLILVIPFLLILGSYARIVSSILKVPSSKGICKAFSTCGSHLSVVSLFYGTVIGLYLCPSANSSTLKDTVMAMMYTVVTPMLTPFIYSLRNRDMKGALERVICKRKNPFLL

SEQ ID NO: 59459 - protein, 312 aa, Homo sapiens
  Payload ID: 11619
  Gene Symbol: OR1F1
  Gene Name: olfactory receptor, family 1, subfamily F, member 1
  Uniprot ID: O43749
  ENSP ID: ENSP00000305424
MSGTNQSSVSEFLLLGLSRQPQQQHLLFVFFLSMYLATVLGNLLIILSVSIDSCLHTPMYFFLSNLSFVDICFSFTTVPKMLANHILETQTISFCGCLTQMYFVFMFVDMDNFLLAVMAYDHFVAVCHPLHYTAKMTHQLCALLVAGLWVVANLNVLLHTLLMAPLSFCADNAITHFFCDVTPLLKLSCSDTHLNEVIILSEGALVMITPFLCILASYMHITCTVLKVPSTKGRWKAFSTCGSHLAVVLLFYSTIIAVYFNPLSSHSAEKDTMATVLYTVVTPMLNPFIYSLRNRYLKGALKKVVGRVVFSV

SEQ ID NO: 59460 - protein, 313 aa, Homo sapiens
  Payload ID: 11620
  Gene Symbol: OR1G1
  Gene Name: olfactory receptor, family 1, subfamily G, member 1
  Uniprot ID: P47890
  ENSP ID: ENSP00000331545
MEGKNLTSISECFLLGFSEQLEEQKPLFGSFLFMYLVTVAGNLLIILVIITDTQLHTPMYFFLANLSLADACFVSTTVPKMLANIQIQSQAISYSGCLLQLYFFMLFVMLEAFLLAVMAYDCYVAICHPLHYILIMSPGLCIFLVSASWIMNALHSLLHTLLMNSLSFCANHEIPHFFCDINPLLSLSCTDPFTNELVIFITGGLTGLICVLCLIISYTNVFSTILKIPSAQGKRKAFSTCSSHLSVVSLFFGTSFCVDFSSPSTHSAQKDTVASVMYTVVTPMLNPFIYSLRNQEIKSSLRKLIWVRKIHSP

SEQ ID NO: 59461 - protein, 355 aa, Homo sapiens
  Payload ID: 11621
  Gene Symbol: OR1I1
  Gene Name: olfactory receptor, family 1, subfamily I, member 1
  Uniprot ID: O60431
  ENSP ID: ENSP00000209540
MEPEKQTEISEFFLQGLSEKPEHQTLLFTMFLSTYLVTIIGNALIILAIITDSHLHTPMYFFLFNLSLVDTLLSSTTVPKMLANIQAQSRAIPFVGCLTQMYAFHLFGTMDSFLLAVMAIDRFVAIVHPQRYLVLMCSPVCGLLLGASWMITNLQSLIHTCLMAQLTFCAGSEISHFFCDLMPLLKLSGSDTHTNELVIFAFGIVVGTSPFSCILLSYIRIFWTVFKIPSTRGKWKAFSTCGLHLTVVSLSYGTIFAVYLQPTSPSSSQKDKAAALMCGVFIPMLNPFIYSIRNKDMKAALGKLIGKVAVPCPRPEQLLDVYHVPGSLLAARDTEMHPIPYPGGVQSLAGNRDME

SEQ ID NO: 59462 - protein, 322 aa, Homo sapiens
  Payload ID: 11622
  Gene Symbol: OR1J1
  Gene Name: olfactory receptor, family 1, subfamily J, member 1
  Uniprot ID: Q8NGS3
  ENSP ID: ENSP00000259357
MSPENQSSVSEFLLLGLPIRPEQQAVFFALFLGMYLTTVLGNLLIMLLIQLDSHLHTPMYFFLSHLALTDISFSSVTVPKMLMNMQTQHLAVFYKGCISQTYFFIFFADLDSFLITSMAYDRYVAICHPLHYATIMTQSQCVMLVAGSWVIACACALLHTLLLAQLSFCADHIIPHYFCDLGALLKLSCSDTSLNQLAIFTAALTAIMLPFLCILVSYGHIGVTILQIPSTKGICKALSTCGSHLSVVTIYYRTIIGLYFLPPSSNTNDKNIIASVIYTAVTPMLNPFIYSLRNKDIKGALRKLLSRSGAVAHACNLNTLGG

SEQ ID NO: 59463 - protein, 313 aa, Homo sapiens
  Payload ID: 11623
  Gene Symbol: OR1J2
  Gene Name: olfactory receptor, family 1, subfamily J, member 2
  Uniprot ID: Q8NGS2
  ENSP ID: ENSP00000335575
MSPENQSSVSEFLLLGLPIRPEQQAVFFTLFLGMYLTTVLGNLLIMLLIQLDSHLHTPMYFFLSHLALTDISFSSVTVPKMLMDMRTKYKSILYEECISQMYFFIFFTDLDSFLITSMAYDRYVAICHPLHYTVIMREELCVFLVAVSWILSCASSLSHTLLLTRLSFCAANTIPHVFCDLAALLKLSCSDIFLNELVMFTVGVVVITLPFMCILVSYGYIGATILRVPSTKGIHKALSTCGSHLSVVSLYYGSIFGQYLFPTVSSSIDKDVIVALMYTVVTPMLNPFIYSLRNRDMKEALGKLFSRATFFSW

SEQ ID NO: 59464 - protein, 313 aa, Homo sapiens
  Payload ID: 11624
  Gene Symbol: OR1J4
  Gene Name: olfactory receptor, family 1, subfamily J, member 4
  Uniprot ID: Q8NGS1
  ENSP ID: ENSP00000343521
MKRENQSSVSEFLLLDLPIWPEQQAVFFTLFLGMYLITVLGNLLIILLIRLDSHLHTPMFFFLSHLALTDISLSSVTVPKMLLSMQTQDQSILYAGCVTQMYFFIFFTDLDNFLLTSMAYDRYVAICHPLRYTTIMKEGLCNLLVTVSWILSCTNALSHTLLLAQLSFCADNTIPHFFCDLVALLKLSCSDISLNELVIFTVGQAVITLPLICILISYGHIGVTILKAPSTKGIFKALSTCGSHLSVVSLYYGTIIGLYFLPSSSASSDKDVIASVMYTVITPLLNPFIYSLRNRDIKGALERLFNRATVLSQ

SEQ ID NO: 59465 - protein, 316 aa, Homo sapiens
  Payload ID: 11625
  Gene Symbol: OR1K1
  Gene Name: olfactory receptor, family 1, subfamily K, member 1
  Uniprot ID: Q8NGR3
  ENSP ID: ENSP00000277309
MEAANESSEGISFVLLGLTTSPGQQRPLFVLFLLLYVASLLGNGLIVAAIQASPALHAPMYFLLAHLSFADLCFASVTVPKMLANLLAHDHSISLAGCLTQMYFFFALGVTDSCLLAAMAYDCYVAIRHPLPYATRMSRAMCAALVGMAWLVSHVHSLLYILLMARLSFCASHQVPHFFCDHQPLLRLSCSDTHHIQLLIFTEGAAVVVTPFLLILASYGAIAAAVLQLPSASGRLRAVSTCGSHLAVVSLFYGTVIAVYFQATSRREAEWGRVATVMYTVVTPMLNPIIYSLWNRDVQGALRALLIGRRISASDS

SEQ ID NO: 59466 - protein, 310 aa, Homo sapiens
  Payload ID: 11626
  Gene Symbol: OR1L1
  Gene Name: olfactory receptor, family 1, subfamily L, member 1
  ENSP ID: ENSP00000310773
MGRNNLTRPSEFILLGLSSRPEDQKPLFAVFLPIYLITVIGNLLIILAIRSDTRLQTPMYFFLSILSFVDICYVTVIIPKMLVNFLSETKTISYSECLTQMYFFLAFGNTDSYLLAAMAIDRYVAICNPFHYITIMSHRCCVLLLVLSFCIPHFHSLLHILLTNQLIFCASNVIHHFFCDDQPVLKLSCSSHFVKEITVMTEGLAVIMTPFSCIIISYLRILITVLKIPSAAGKRKAFSTCGSHLTVVTLFYGSISYLYFQPLSNYTVKDQIATIIYTVLTPMLNPFIYSLRNKDMKQGLAKLMHRMKCQ

SEQ ID NO: 59467 - protein, 360 aa, Homo sapiens
  Payload ID: 11626
  Gene Symbol: OR1L1
  Gene Name: olfactory receptor, family 1, subfamily L, member 1
  Uniprot ID: Q8NH94
  ENSP ID: ENSP00000362790
MERNHNPDNCNVLNFFFADKKNKRRNFGQIVSDVGRICYSVSLSLGEPTTMGRNNLTRPSEFILLGLSSRPEDQKPLFAVFLPIYLITVIGNLLIILAIRSDTRLQTPMYFFLSILSFVDICYVTVIIPKMLVNFLSETKTISYSECLTQMYFFLAFGNTDSYLLAAMAIDRYVAICNPFHYITIMSHRCCVLLLVLSFCIPHFHSLLHILLTNQLIFCASNVIHHFFCDDQPVLKLSCSSHFVKEITVMTEGLAVIMTPFSCIIISYLRILITVLKIPSAAGKRKAFSTCGSHLTVVTLFYGSISYLYFQPLSNYTVKDQIATIIYTVLTPMLNPFIYSLRNKDMKQGLAKLMHRMKCQ

SEQ ID NO: 59468 - protein, 324 aa, Homo sapiens
  Payload ID: 11627
  Gene Symbol: OR1L3
  Gene Name: olfactory receptor, family 1, subfamily L, member 3
  Uniprot ID: Q8NH93
  ENSP ID: ENSP00000302863
MGMSNLTRLSEFILLGLSSRSEDQRPLFALFLIIYLVTLMGNLLIILAIHSDPRLQNPMYFFLSILSFADICYTTVIVPKMLVNFLSEKKTISYAECLAQMYFFLVFGNIDSYLLAAMAINRCVAICNPFHYVTVMNRRCCVLLLAFPITFSYFHSLLHVLLVNRLTFCTSNVIHHFFCDVNPVLKLSCSSTFVNEIVAMTEGLASVMAPFVCIIISYLRILIAVLKIPSAAGKHKAFSTCSSHLTVVILFYGSISYVYLQPLSSYTVKDRIATINYTVLTSVLNPFIYSLRNKDMKRGLQKLINKIKSQMSRFSTKTNKICGP

SEQ ID NO: 59469 - protein, 311 aa, Homo sapiens
  Payload ID: 11628
  Gene Symbol: OR1L4
  Gene Name: olfactory receptor, family 1, subfamily L, member 4
  Uniprot ID: Q8NGR5
  ENSP ID: ENSP00000259466
METKNYSSSTSGFILLGLSSNPKLQKPLFAIFLIMYLLTAVGNVLIILAIYSDPRLHTPMYFFLSNLSFMDICFTTVIVPKMLVNFLSETKIISYVGCLIQMYFFMAFGNTDSYLLASMAIDRLVAICNPLHYDVVMKPWHCLLMLLGSCSISHLHSLFRVLLMSRLSFCASHIIKHFFCDTQPVLKLSCSDTSSSQMVVMTETLAVIVTPFLCTIFSYLQIIVTVLRIPSAAGKWKAFSTCGSHLTVVVLFYGSVIYVYFRPLSMYSVMKGRVATVMYTVVTPMLNPFIYSLRNKDMKRGLKKLRHRIYS

SEQ ID NO: 59470 - protein, 311 aa, Homo sapiens
  Payload ID: 11629
  Gene Symbol: OR1L6
  Gene Name: olfactory receptor, family 1, subfamily L, member 6
  ENSP ID: ENSP00000304235
MEIKNYSSSTSGFILLGLSSNPQLQKPLFAIFLIMYLLAAVGNVLIIPAIYSDPRLHTPMYFFLSNLSFMDICFTTVIVPKMLVNFLSETKVISYVGCLAQMYFFMAFGNTDSYLLASMAIDRLVAICNPLHYDVVMKPRHCLLMLLGSCSISHLHSLFRVLLMSRLSFCASHIIKHFFCDTQPVLKLSCSDTSSSQMVVMTETLAVIVTPFLCIIFSYLRIMVTVLRIPSAAGKWKAFSTCGSHLTAVALFYGSIIYVYFRPLSMYSVVRDRVATVMYTVVTPMLNPFIYSLRNKDMKRGLKKLQDRIYR

SEQ ID NO: 59471 - protein, 347 aa, Homo sapiens
  Payload ID: 11629
  Gene Symbol: OR1L6
  Gene Name: olfactory receptor, family 1, subfamily L, member 6
  Uniprot ID: Q8NGR2
  ENSP ID: ENSP00000362788
MSYFYRLKLMKEAVLVKLPFTSLPLLLQTLSRKSRDMEIKNYSSSTSGFILLGLSSNPQLQKPLFAIFLIMYLLAAVGNVLIIPAIYSDPRLHTPMYFFLSNLSFMDICFTTVIVPKMLVNFLSETKVISYVGCLAQMYFFMAFGNTDSYLLASMAIDRLVAICNPLHYDVVMKPRHCLLMLLGSCSISHLHSLFRVLLMSRLSFCASHIIKHFFCDTQPVLKLSCSDTSSSQMVVMTETLAVIVTPFLCIIFSYLRIMVTVLRIPSAAGKWKAFSTCGSHLTAVALFYGSIIYVYFRPLSMYSVVRDRVATVMYTVVTPMLNPFIYSLRNKDMKRGLKKLQDRIYR

SEQ ID NO: 59472 - protein, 309 aa, Homo sapiens
  Payload ID: 11630
  Gene Symbol: OR1L8
  Gene Name: olfactory receptor, family 1, subfamily L, member 8
  Uniprot ID: Q8NGR8
  ENSP ID: ENSP00000306607
MERINHTSSVSEFILLGLSSRPEDQKTLFVLFLIVYLVTITGNLLIILAIRFNPHLQTPMYFFLSFLSLTDICFTTSVVPKMLMNFLSEKKTISYAGCLTQMYFLYALGNSDSCLLAVMAFDRYVAVCDPFHYVTTMSHHHCVLLVAFSCSFPHLHSLLHTLLLNRLTFCDSNVIHHFLCDLSPVLKLSCSSIFVNEIVQMTEAPIVLVTRFLCIAFSYIRILTTVLKIPSTSGKRKAFSTCGFYLTVVTLFYGSIFCVYLQPPSTYAVKDHVATIVYTVLSSMLNPFIYSLRNKDLKQGLRKLMSKRS

SEQ ID NO: 59473 - protein, 313 aa, Homo sapiens
  Payload ID: 11631
  Gene Symbol: OR1M1
  Gene Name: olfactory receptor, family 1, subfamily M, member 1
  Uniprot ID: Q8NGA1
  ENSP ID: ENSP00000401966
MEPRNQTSASQFILLGLSEKPEQETLLFSLFFCMYLVMVVGNLLIILAISIDSHLHTPMYFFLANLSLVDFCLATNTIPKMLVSLQTGSKAISYPCCLIQMYFFHFFGIVDSVIIAMMAYDRFVAICHPLHYAKIMSLRLCRLLVGALWAFSCFISLTHILLMARLVFCGSHEVPHYFCDLTPILRLSCTDTSVNRIFILIVAGMVIATPFVCILASYARILVAIMKVPSAGGRKKAFSTCSSHLSVVALFYGTTIGVYLCPSSVLTTVKEKASAVMYTAVTPMLNPFIYSLRNRDLKGALRKLVNRKITSSS

SEQ ID NO: 59474 - protein, 311 aa, Homo sapiens
  Payload ID: 11632
  Gene Symbol: OR1N1
  Gene Name: olfactory receptor, family 1, subfamily N, member 1
  Uniprot ID: Q8NGS0
  ENSP ID: ENSP00000306974
MENQSSISEFFLRGISAPPEQQQSLFGIFLCMYLVTLTGNLLIILAIGSDLHLHTPMYFFLANLSFVDMGLTSSTVTKMLVNIQTRHHTISYTGCLTQMYFFLMFGDLDSFFLAAMAYDRYVAICHPLCYSTVMRPQVCALMLALCWVLTNIVALTHTFLMARLSFCVTGEIAHFFCDITPVLKLSCSDTHINEMMVFVLGGTVLIVPFLCIVTSYIHIVPAILRVRTRGGVGKAFSTCSSHLCVVCVFYGTLFSAYLCPPSIASEEKDIAAAAMYTIVTPMLNPFIYSLRNKDMKGALKRLFSHRSIVSS

SEQ ID NO: 59475 - protein, 312 aa, Homo sapiens
  Payload ID: 11632
  Gene Symbol: OR1N1
  Gene Name: olfactory receptor, family 1, subfamily N, member 1
  ENSP ID: ENSP00000480866
VMENQSSISEFFLRGISAPPEQQQSLFGIFLCMYLVTLTGNLLIILAIGSDLHLHTPMYFFLANLSFVDMGLTSSTVTKMLVNIQTRHHTISYTGCLTQMYFFLMFGDLDSFFLAAMAYDRYVAICHPLCYSTVMRPQVCALMLALCWVLTNIVALTHTFLMARLSFCVTGEIAHFFCDITPVLKLSCSDTHINEMMVFVLGGTVLIVPFLCIVTSYIHIVPAILRVRTRGGVGKAFSTCSSHLCVVCVFYGTLFSAYLCPPSIASEEKDIAAAAMYTIVTPMLNPFIYSLRNKDMKGALKRLFSHRSIVSS

SEQ ID NO: 59476 - protein, 330 aa, Homo sapiens
  Payload ID: 11633
  Gene Symbol: OR1N2
  Gene Name: olfactory receptor, family 1, subfamily N, member 2
  Uniprot ID: Q8NGR9
  ENSP ID: ENSP00000362792
MEGFYLRRSHELQGMGKPGRVNQTTVSDFLLLGLSEWPEEQPLLFGIFLGMYLVTMVGNLLIILAISSDPHLHTPMYFFLANLSLTDACFTSASIPKMLANIHTQSQIISYSGCLAQLYFLLMFGGLDNCLLAVMAYDRYVAICQPLHYSTSMSPQLCALMLGVCWVLTNCPALMHTLLLTRVAFCAQKAIPHFYCDPSALLKLACSDTHVNELMIITMGLLFLTVPLLLIVFSYVRIFWAVFVISSPGGRWKAFSTCGSHLTVVLLFYGSLMGVYLLPPSTYSTERESRAAVLYMVIIPTLNPFIYSLRNRDMKEALGKLFVSGKTFFL

SEQ ID NO: 59477 - protein, 308 aa, Homo sapiens
  Payload ID: 11633
  Gene Symbol: OR1N2
  Gene Name: olfactory receptor, family 1, subfamily N, member 2
  ENSP ID: ENSP00000483293
GRVNQTTVSDFLLLGLSEWPEEQPLLFGIFLGMYLVTMVGNLLIILAISSDPHLHTPMYFFLANLSLTDACFTSASIPKMLANIHTQSQIISYSGCLAQLYFLLMFGGLDNCLLAVMAYDRYVAICQPLHYSTSMSPQLCALMLGVCWVLTNCPALMHTLLLTRVAFCAQKAIPHFYCDPSALLKLACSDTHVNELMIITMGLLFLTVPLLLIVFSYVRIFWAVFVISSPGGRWKAFSTCGSHLTVVLLFYGSLMGVYLLPPSTYSTERESRAAVLYMVIIPTLNPFIYSLRNRDMKEALGKLFRKRS

SEQ ID NO: 59478 - protein, 314 aa, Homo sapiens
  Payload ID: 11634
  Gene Symbol: OR1Q1
  Gene Name: olfactory receptor, family 1, subfamily Q, member 1
  Uniprot ID: Q15612
  ENSP ID: ENSP00000297913
MDNSNWTSVSHFVLLGISTHPEEQIPLFLVFSLMYAINISGNLAIITLILSAPRLHIPMYIFLSNLALTDICFTSTTVPKMLQIIFSPTKVISYTGCLAQTYFFICFAVMENFILAVMAYDRYIAICHPFHYTMILTRMLCVKMVVMCHALSHLHAMLHTFLIGQLIFCADNRIPHFFCDLYALMKISCTSTYLNTLMIHTEGAVVISGALAFITASYACIILVVLRIPSAKGRWKTFSTCGSHLTVVAIFYGTLSWVYFRPLSSYSVTKGRIITVVYTVVTPMLNPFIYSLRNGDVKGGFMKWMSRMQTFFFR

SEQ ID NO: 59479 - protein, 325 aa, Homo sapiens
  Payload ID: 11635
  Gene Symbol: OR1S1
  Gene Name: olfactory receptor, family 1, subfamily S, member 1 (gene/pseudogene)
  Uniprot ID: Q8NH92
  ENSP ID: ENSP00000311688
MKTFSSFLQIGRNMHQGNQTTITEFILLGFFKQDEHQNLLFVLFLGMYLVTVIGNGLIIVAISLDTYLHTPMYLFLANLSFADISSISNSVPKMLVNIQTKSQSISYESCITQMYFSIVFVVIDNLLLGTMAYDHFVAICHPLNYTILMRPRFGILLTVISWFLSNIIALTHTLLLIQLLFCNHNTLPHFFCDLAPLLKLSCSDTLINELVLFIVGLSVIIFPFTLSFFSYVCIIRAVLRVSSTQGKWKAFSTCGSHLTVVLLFYGTIVGVYFFPSSTHPEDTDKIGAVLFTVVTPMINPFIYSLRNKDMKGALRKLINRKISSL

SEQ ID NO: 59480 - protein, 325 aa, Homo sapiens; identical to SEQ ID NO: 59479
  Payload ID: 11635
  Gene Symbol: OR1S1
  Gene Name: olfactory receptor, family 1, subfamily S, member 1 (gene/pseudogene)
  Uniprot ID: Q8NH92
  ENSP ID: ENSP00000485156

SEQ ID NO: 59481 - protein, 325 aa, Homo sapiens; identical to SEQ ID NO: 59479
  Payload ID: 11635
  Gene Symbol: OR1S1
  Gene Name: olfactory receptor, family 1, subfamily S, member 1 (gene/pseudogene)
  Uniprot ID: Q8NH92
  ENSP ID: ENSP00000485365

SEQ ID NO: 59482 - protein, 325 aa, Homo sapiens
  Payload ID: 11636
  Gene Symbol: OR1S2
  Gene Name: olfactory receptor, family 1, subfamily S, member 2
  Uniprot ID: Q8NGQ3
  ENSP ID: ENSP00000305469
MKTLCSFLQISRNMHQENQTTITEFILLGLSNQAEHQNLLFVLFLSMYVVTVVGNGLIIVAISLDIYLHTPMYLFLAYLSFADISSISNSVPKMLVNIQTNSQSISYESCITQMYFSIVFVVTDNLLLGTMAFDHFVAICHPLNYTTFMRARFGTLLTVISWFLSNIIALTHTLLLIQLLFCDHNTLPHFFCDLAPLLKLSCSDTMINELVLFIVGLSVIIFPFVLIFFSYVCIIRAVLGVSSTQGKWKAFSTCGSHLTIALLFYGTTVGVYFFPSSTHPEDTDKIGAVLFTVVTPMMNPFIYSLRNKDMKGALRKLINRKISSL

SEQ ID NO: 59483 - protein, 303 aa, Homo sapiens
  Payload ID: 11637
  Gene Symbol: OR10A2
  Gene Name: olfactory receptor, family 10, subfamily A, member 2
  Uniprot ID: Q9H208
  ENSP ID: ENSP00000303862
MSFSSLPTEIQSLLFLTFLTIYLVTLMGNCLIILVTLADPMLHSPMYFFLRNLSFLEIGFNLVIVPKMLGTLLAQDTTISFLGCATQMYFFFFFGVAECFLLATMAYDRYVAICSPLHYPVIMNQRTRAKLAAASWFPGFPVATVQTTWLFSFPFCGTNKVNHFFCDSPPVLRLVCADTALFEIYAIVGTILVVMIPCLLILCSYTHIAAAILKIPSAKGKNKAFSTCSSHLLVVSLFYISLSLTYFRPKSNNSPEGKKLLSLSYTVMTPMLNPIIYSLRNNEVKNALSRTVSKALALRNCIP

SEQ ID NO: 59484 - protein, 314 aa, Homo sapiens
  Payload ID: 11638
  Gene Symbol: OR10A3
  Gene Name: olfactory receptor, family 10, subfamily A, member 3
  Uniprot ID: P58181
  ENSP ID: ENSP00000353988
MKRQNQSCVVEFILLGFSNFPELQVQLFGVFLVIYVVTLMGNAIITVIISLNQSLHVPMYLFLLNLSVVEVSFSAVITPEMLVVLSTEKTMISFVGCFAQMYFILLFGGTECFLLGAMAYDRFAAICHPLNYPVIMNRGVFMKLVIFSWISGIMVATVQTTWVFSFPFCGPNEINHLFCETPPVLELVCADTFLFEIYAFTGTILIVMVPFLLILLSYIRVLFAILKMPSTTGRQKAFSTCASHLTSVTLFYGTANMTYLQPKSGYSPETKKLISLAYTLLTPLLNPLIYSLRNSEMKRTLIKLWRRKVILHTF

SEQ ID NO: 59485 - protein, 314 aa, Homo sapiens; identical to SEQ ID NO: 59484
  Payload ID: 11638
  Gene Symbol: OR10A3
  Gene Name: olfactory receptor, family 10, subfamily A, member 3
  Uniprot ID: P58181
  ENSP ID: ENSP00000484096

SEQ ID NO: 59486 - protein, 314 aa, Homo sapiens; identical to SEQ ID NO: 59484
  Payload ID: 11638
  Gene Symbol: OR10A3
  Gene Name: olfactory receptor, family 10, subfamily A, member 3
  Uniprot ID: P58181
  ENSP ID: ENSP00000487530

SEQ ID NO: 59487 - protein, 315 aa, Homo sapiens
  Payload ID: 11639
  Gene Symbol: OR10A4
  Gene Name: olfactory receptor, family 10, subfamily A, member 4
  Uniprot ID: Q9H209
  ENSP ID: ENSP00000369157
MMWENWTIVSEFVLVSFSALSTELQALLFLLFLTIYLVTLMGNVLIILVTIADSALQSPMYFFLRNLSFLEIGFNLVIVPKMLGTLIIQDTTISFLGCATQMYFFFFFGAAECCLLATMAYDRYVAICDPLHYPVIMGHISCAQLAAASWFSGFSVATVQTTWIFSFPFCGPNRVNHFFCDSPPVIALVCADTSVFELEALTATVLFILFPFLLILGSYVRILSTIFRMPSAEGKHQAFSTCSAHLLVVSLFYSTAILTYFRPQSSASSESKKLLSLSSTVVTPMLNPIIYSSRNKEVKAALKRLIHRTLGSQKL

SEQ ID NO: 59488 - protein, 317 aa, Homo sapiens
  Payload ID: 11640
  Gene Symbol: OR10A5
  Gene Name: olfactory receptor, family 10, subfamily A, member 5
  Uniprot ID: Q9H207
  ENSP ID: ENSP00000299454
MAIGNWTEISEFILMSFSSLPTEIQSLLFLTFLTIYLVTLKGNSLIILVTLADPMLHSPMYFFLRNLSFLEIGFNLVIVPKMLGTLLAQDTTISFLGCATQMYFFFFFGVAECFLLATMAYDRYVAICSPLHYPVIMNQRTRAKLAAASWFPGFPVATVQTTWLFSFPFCGTNKVNHFFCDSPPVLKLVCADTALFEIYAIVGTILVVMIPCLLILCSYTRIAAAILKIPSAKGKHKAFSTCSSHLLVVSLFYISSSLTYFWPKSNNSPESKKLLSLSYTVVTPMLNPIIYSLRNSEVKNALSRTFHKVLALRNCIP

SEQ ID NO: 59489 - protein, 314 aa, Homo sapiens; identical to SEQ ID NO: 59422
  Payload ID: 11641
  Gene Symbol: OR10A6
  Gene Name: olfactory receptor, family 10, subfamily A, member 6 (gene/pseudogene)
  Uniprot ID: Q8NH74
  ENSP ID: ENSP00000312470

SEQ ID NO: 59490 - protein, 316 aa, Homo sapiens
  Payload ID: 11642
  Gene Symbol: OR10A7
  Gene Name: olfactory receptor, family 10, subfamily A, member 7
  Uniprot ID: Q8NGE5
  ENSP ID: ENSP00000326718
MICENHTRVTEFILLGFTNNPEMQVSLFIFFLAIYTVTLLGNFLIVTVTSVDLALQTPMYFFLQNLSLLEVCFTLVMVPKMLVDLVSPRKIISFVGCGTQMYFFFFFGSSECFLLSMMAYDRFVAICNPLHYSVIMNRSLCLWMAIGSWMSGVPVSMLQTAWMMALPFCGPNAVDHFFCDGPPVLKLVTVDTTMYEMQALASTLLFIMFPFCLILVSYTRIIITILRMSSATGRQKAFSTCSSHLIVVSLFYGTASLTYLRPKSNQSPESKKLVSLSYTVITPMLNPIIYGLRNNEVKGAVKRTITQKVLQKLDVF

SEQ ID NO: 59491 - protein, 325 aa, Homo sapiens
  Payload ID: 11643
  Gene Symbol: OR10AC1
  Gene Name: olfactory receptor, family 10, subfamily AC, member 1 (gene/pseudogene)
  ENSP ID: ENSP00000476380
MDSPSNATVPCGFLLQGFSEFPHLRPVLFLLLLGVHLATLGGNLLILVAVASMPSRQPMLLFLCQLSAIELCYTLVVVPRSLVDLSTPGPPQGQPYLLPELRLSDADVCGSGRGRVLPAGRHGLPLRGHLPPVALRGRGDPRAVRATGSGLLPQGTGGVRGAHGGHLPPAFLRLPPAAALLLRHHGAAAPGLHAELRRRAASAGRLPGAAAAALGAHPGLLWRHRRRPAPPALPQRPGQGRLHLRLAPGSHLPALRLRHLHVRAAQGQLLPAPGPHPGAGLHQRHAAAVPTHLQPAQPRDHRRPEQGAGAPAARPSSRRGSARAL

SEQ ID NO: 59492 - protein, 317 aa, Homo sapiens
  Payload ID: 11644
  Gene Symbol: OR10AD1
  Gene Name: olfactory receptor, family 10, subfamily AD, member 1
  Uniprot ID: Q8NGE0
  ENSP ID: ENSP00000308689
MLRNGSIVTEFILVGFQQSSTSTRALLFALFLALYSLTMAMNGLIIFITSWTDPKLNSPMYFFLGHLSLLDVCFITTTIPQMLIHLVVRDHIVSFVCCMTQMYFVFCVGVAECILLAFMAYDRYVAICYPLNYVPIISQKVCVRLVGTAWFFGLINGIFLEYISFREPFRRDNHIESFFCEAPIVIGLSCGDPQFSLWAIFADAIVVILSPMVLTVTSYVHILATILSKASSSGRGKTFSTCASHLTVVIFLYTSAMFSYMNPHSTHGPDKDKPFSLLYTIITPMCNPIIYSFRNKEIKEAMVRALGRTRLAQPQSV

SEQ ID NO: 59493 - protein, 301 aa, Homo sapiens
  Payload ID: 11645
  Gene Symbol: OR10AG1
  Gene Name: olfactory receptor, family 10, subfamily AG, member 1
  Uniprot ID: Q8NH19
  ENSP ID: ENSP00000311477
MEFVLLGFSDIPNLHWMLFSIFLLMYLMILMCNGIIILLIKIHPALQTPMYFFLSNFSLLEICYVTIIIPRMLMDIWTQKGNISLFACATQMCFFLMLGGTECLLLTVMAYDRYVAICKPLQYPLVMNHKVCIQLIIASWTITIPVVIGETCQIFLLPFCGTNTINHFFCDIPPILKLACGNIFVNEITVHVVAVVFITVPFLLIVVSYGKIISNILKLSSARGKAKAFSTCSSHLIVVILFFGAGTITYLQPKPHQFQRMGKLISLFYTILIPTLNPIIYTLRNKDIMVALRKLLAKLLT

SEQ ID NO: 59494 - protein, 312 aa, Homo sapiens
  Payload ID: 11646
  Gene Symbol: OR10C1
  Gene Name: olfactory receptor, family 10, subfamily C, member 1 (gene/pseudogene)
  Uniprot ID: Q96KK4
  ENSP ID: ENSP00000366343
MSANTSMVTEFLLLGFSHLADLQGLLFSVFLTIYLLTVAGNFLIVVLVSTDAALQSPMYFFLRTLSALEIGYTSVTVPLLLHHLLTGRRHISRSGCALQMFFFLFFGATECCLLAAMAYDRYAAICEPLRYPLLLSHRVCLQLAGSAWACGVLVGLGHTPFIFSLPFCGPNTIPQFFCEIQPVLQLVCGDTSLNELQIILATALLILCPFGLILGSYGRILVTIFRIPSVAGRRKAFSTCSSHLIMVSLFYGTALFIYIRPKASYDPATDPLVSLFYAVVTPILNPIIYSLRNTEVKAALKRTIQKTVPMEI

SEQ ID NO: 59495 - protein, 312 aa, Homo sapiens; identical to SEQ ID NO: 59494
  Payload ID: 11646
  Gene Symbol: OR10C1
  Gene Name: olfactory receptor, family 10, subfamily C, member 1 (gene/pseudogene)
  Uniprot ID: Q96KK4
  ENSP ID: ENSP00000375393

SEQ ID NO: 59496 - protein, 312 aa, Homo sapiens
  Payload ID: 11646
  Gene Symbol: OR10C1
  Gene Name: olfactory receptor, family 10, subfamily C, member 1 (gene/pseudogene)
  Uniprot ID: Q96KK4
  ENSP ID: ENSP00000402486
MSANTSMVTEFLLLGFSHLADLQGLLFSVFLTIYLLTVAGNFLIVVLVSTDAALQSPMYFFLRTLSALEIGYTSVTVPLLLHHLLTGRRHISRSGCALQMFFFLFFGATECCLLAAMAYDRYAAICEPLRYPLLLSHRVCLQLAGSAWACGVLVGLGHTPFIFSLPFCGPNTIPQFFCEIQPVLQLVCGDTSLNELQIILATALLILCPFGLILGSYGRILVTIFRIPSVAGRRKAFSTCSSHLIVVSLFYGTALFIYIRPKASYDPATDPLVSLFYAVVTPILNPIIYSLRNTEVKAALKRTIQKTVPMEI

SEQ ID NO: 59497 - protein, 312 aa, Homo sapiens
  Payload ID: 11646
  Gene Symbol: OR10C1
  Gene Name: olfactory receptor, family 10, subfamily C, member 1 (gene/pseudogene)
  ENSP ID: ENSP00000404869
MSANTSMVTEFLLLGFSHLADLQGLLFSVFLTIYLLTVAGNFLIVVLVSTDAALQSPMYLFLRTLSALEIGYTSVTVPLLLHHLLTGRRHISRSGCALQMFFFLFFGATECCLLAAMAYDRYAAICEPLRYPLLLSHRVCLQLAGSAWACGVLVGLGHTPFIFSLPFCGPNTIQQFFCEIQPVLQLVCGDTSLNELQIILATALLILCPFGLILGSYGRILVTIFRIPSVAGRRKAFSTCSSHLIVVSLFYGTALFIYIRPKASYDPATDPLVSLFYAVVTPILNPIIYSLRNTEVKAALKRTIQKTVPMEI

SEQ ID NO: 59498 - protein, 312 aa, Homo sapiens; identical to SEQ ID NO: 59496
  Payload ID: 11646
  Gene Symbol: OR10C1
  Gene Name: olfactory receptor, family 10, subfamily C, member 1 (gene/pseudogene)
  Uniprot ID: Q96KK4
  ENSP ID: ENSP00000408961

SEQ ID NO: 59499 - protein, 312 aa, Homo sapiens; identical to SEQ ID NO: 59496
  Payload ID: 11646
  Gene Symbol: OR10C1
  Gene Name: olfactory receptor, family 10, subfamily C, member 1 (gene/pseudogene)
  Uniprot ID: Q96KK4
  ENSP ID: ENSP00000412512

SEQ ID NO: 59500 - protein, 312 aa, Homo sapiens; identical to SEQ ID NO: 59494
  Payload ID: 11646
  Gene Symbol: OR10C1
  Gene Name: olfactory receptor, family 10, subfamily C, member 1 (gene/pseudogene)
  Uniprot ID: Q96KK4
  ENSP ID: ENSP00000419119

SEQ ID NO: 59501 - protein, 312 aa, Homo sapiens; identical to SEQ ID NO: 59496
  Payload ID: 11646
  Gene Symbol: OR10C1
  Gene Name: olfactory receptor, family 10, subfamily C, member 1 (gene/pseudogene)
  ENSP ID: ENSP00000425554

SEQ ID NO: 59502 - protein, 314 aa, Homo sapiens
  Payload ID: 11646
  Gene Symbol: OR10C1
  Gene Name: olfactory receptor, family 10, subfamily C, member 1 (gene/pseudogene)
  ENSP ID: ENSP00000447194
GRMSANTSMVTEFLLLGFSHLADLQGLLFSVFLTIYLLTVAGNFLIVVLVSTDAALQSPMYFFLRTLSALEIGYTSVTVPLLLHHLLTGRRHISRSGCALQMFFFLFFGATECCLLAAMAYDRYAAICEPLRYPLLLSHRVCLQLAGSAWACGVLVGLGHTPFIFSLPFCGPNTIPQFFCEIQPVLQLVCGDTSLNELQIILATALLILCPFGLILGSYGRILVTIFRIPSVAGRRKAFSTCSSHLIVVSLFYGTALFIYIRPKASYDPATDPLVSLFYAVVTPILNPIIYSLRNTEVKAALKRTIQKTVPMEI

SEQ ID NO: 59503 - protein, 314 aa, Homo sapiens; identical to SEQ ID NO: 59502
  Payload ID: 11646
  Gene Symbol: OR10C1
  Gene Name: olfactory receptor, family 10, subfamily C, member 1 (gene/pseudogene)
  ENSP ID: ENSP00000448011

SEQ ID NO: 59504 - protein, 314 aa, Homo sapiens; identical to SEQ ID NO: 59502
  Payload ID: 11646
  Gene Symbol: OR10C1
  Gene Name: olfactory receptor, family 10, subfamily C, member 1 (gene/pseudogene)
  ENSP ID: ENSP00000448262

SEQ ID NO: 59505 - protein, 314 aa, Homo sapiens; identical to SEQ ID NO: 59502
  Payload ID: 11646
  Gene Symbol: OR10C1
  Gene Name: olfactory receptor, family 10, subfamily C, member 1 (gene/pseudogene)
  ENSP ID: ENSP00000448371

SEQ ID NO: 59506 - protein, 314 aa, Homo sapiens
  Payload ID: 11646
  Gene Symbol: OR10C1
  Gene Name: olfactory receptor, family 10, subfamily C, member 1 (gene/pseudogene)
  ENSP ID: ENSP00000448774
GRMSANTSMVTEFLLLGFSHLADLQGLLFSVFLTIYLLTVAGNFLIVVLVSTDAALQSPMYFFLRTLSALEIGYTSVTVPLLLHHLLTGRRHISRSGCALQMFFFLFFGATECCLLAAMAYDRYAAICEPLRYPLLLSHRVCLQLAGSAWACGVLVGLGHTPFIFSLPFCGPNTIPQFFCEIQPVLQLVCGDTSLNELQIILATALLILCPFGLILGSYGRILVTIFRIPSVAGRRKAFSTCSSHLIMVSLFYGTALFIYIRPKASYDPATDPLVSLFYAVVTPILNPIIYSLRNTEVKAALKRTIQKTVPMEI

SEQ ID NO: 59507 - protein, 314 aa, Homo sapiens
  Payload ID: 11646
  Gene Symbol: OR10C1
  Gene Name: olfactory receptor, family 10, subfamily C, member 1 (gene/pseudogene)
  ENSP ID: ENSP00000449846
GRMSANTSMVTEFLLLGFSHLADLQGLLFSVFLTIYLLTVAGNFLIVVLVSTDAALQSPMYLFLRTLSALEIGYTSVTVPLLLHHLLTGRRHISRSGCALQMFFFLFFGATECCLLAAMAYDRYAAICEPLRYPLLLSHRVCLQLAGSAWACGVLVGLGHTPFIFSLPFCGPNTIQQFFCEIQPVLQLVCGDTSLNELQIILATALLILCPFGLILGSYGRILVTIFRIPSVAGRRKAFSTCSSHLIVVSLFYGTALFIYIRPKASYDPATDPLVSLFYAVVTPILNPIIYSLRNTEVKAALKRTIQKTVPMEI

SEQ ID NO: 59508 - protein, 314 aa, Homo sapiens; identical to SEQ ID NO: 59506
  Payload ID: 11646
  Gene Symbol: OR10C1
  Gene Name: olfactory receptor, family 10, subfamily C, member 1 (gene/pseudogene)
  ENSP ID: ENSP00000450100

SEQ ID NO: 59509 - protein, 314 aa, Homo sapiens; identical to SEQ ID NO: 59506
  Payload ID: 11646
  Gene Symbol: OR10C1
  Gene Name: olfactory receptor, family 10, subfamily C, member 1 (gene/pseudogene)
  ENSP ID: ENSP00000481429

SEQ ID NO: 59510 - protein, 312 aa, Homo sapiens; identical to SEQ ID NO: 59494
  Payload ID: 11646
  Gene Symbol: OR10C1
  Gene Name: olfactory receptor, family 10, subfamily C, member 1 (gene/pseudogene)
  ENSP ID: ENSP00000485032

SEQ ID NO: 59511 - protein, 312 aa, Homo sapiens
  Payload ID: 11647
  Gene Symbol: OR10D3
  Gene Name: olfactory receptor, family 10, subfamily D, member 3 (non-functional)
  Uniprot ID: Q8NH80
  ENSP ID: ENSP00000323895
MEVKNCCMVTEFILLGIPHTEGLEMTLFVLFLPFYACTLLGNVSILVAVMSSARLHTPMYFFLGNLSVFDMGFSSVTCPKMLLYLMGLSRLISYKDCVCQLFFFHFLGSIECFLFTVMAYDRFTAICYPLRYTVIMNPRICVALAVGTWLLGCIHSSILTSLTFTLPYCGPNEVDHFFCDIPALLPLACADTSLAQRVSFTNVGLISLVCFLLILLSYTRITISILSIRTTEGRRRAFSTCSAHLIAILCAYGPIITVYLQPTPNPMLGTVVQILMNLVGPMLNPLIYTLRNKEVKTALKTILHRTGHVPES

SEQ ID NO: 59512 - protein, 310 aa, Homo sapiens
  Payload ID: 11648
  Gene Symbol: OR10G2
  Gene Name: olfactory receptor, family 10, subfamily G, member 2
  Uniprot ID: Q8NGC3
  ENSP ID: ENSP00000445383
MGKTKNTSLDAVVTDFILLGLSHPPNLRSLLFLVFFIIYILTQLGNLLILLTMWADPKLCARPMYILLGVLSFLDMWLSSVTVPLLILDFTPSIKAIPFGGCVAQLYFFHFLGSTQCFLYTLMAYDRYLAICQPLRYPVLMNGRLCTVLVAGAWVAGSMHGSIQATLTFRLPYCGPNQVDYFICDIPAVLRLACADTTVNELVTFVDVGVVAASCFMLILLSYANIVNAILKIRTTDGRRRAFSTCGSHLIVVTVYYVPCIFIYLRAGSKDPLDGAAAVFYTVVTPLLNPLIYTLRNQEVKSALKRITAG

SEQ ID NO: 59513 - protein, 313 aa, Homo sapiens
  Payload ID: 11649
  Gene Symbol: OR10G3
  Gene Name: olfactory receptor, family 10, subfamily G, member 3
  Uniprot ID: Q8NGC4
  ENSP ID: ENSP00000302437
MERINSTLLTAFILTGIPYPLRLRTLFFVFFFLIYILTQLGNLLILITVWADPRLHARPMYIFLGVLSVIDMSISSIIVPRLMMNFTLGVKPIPFGGCVAQLYFYHFLGSTQCFLYTLMAYDRYLAICQPLRYPVLMTAKLSALLVAGAWMAGSIHGALQAILTFRLPYCGPNQVDYFFCDIPAVLRLACADTTVNELVTFVDIGVVVASCFSLILLSYIQIIQAILRIHTADGRRRAFSTCGAHVTVVTVYYVPCAFIYLRPETNSPLDGAAALVPTAITPFLNPLIYTLRNQEVKLALKRMLRSPRTPSEV

SEQ ID NO: 59514 - protein, 311 aa, Homo sapiens
  Payload ID: 11650
  Gene Symbol: OR10G4
  Gene Name: olfactory receptor, family 10, subfamily G, member 4
  Uniprot ID: Q8NGN3
  ENSP ID: ENSP00000325076
MSNASLVTAFILTGLPHAPGLDALLFGIFLVVYVLTVLGNLLILLVIRVDSHLHTPMYYFLTNLSFIDMWFSTVTVPKMLMTLVSPSGRAISFHSCVAQLYFFHFLGSTECFLYTVMSYDRYLAISYPLRYTSMMSGSRCALLATGTWLSGSLHSAVQTILTFHLPYCGPNQIQHYFCDAPPILKLACADTSANVMVIFVDIGIVASGCFVLIVLSYVSIVCSILRIRTSDGRRRAFQTCASHCIVVLCFFVPCVVIYLRPGSMDAMDGVVAIFYTVLTPLLNPVVYTLRNKEVKKAVLKLRDKVAHPQRK

SEQ ID NO: 59515 - protein, 332 aa, Homo sapiens
  Payload ID: 11651
  Gene Symbol: OR10G6
  Gene Name: olfactory receptor, family 10, subfamily G, member 6
  Uniprot ID: Q8NH81
  ENSP ID: ENSP00000477445
MLEGVEHLLLLLLLTDVNSKELQSGNQTSVSHFILVGLHHPPQLGAPLFLAFLVIYLLTVSGNGLIILTVLVDIRLHRPMCLFLCHLSFLDMTISCAIVPKMLAGFLLGSRIISFGGCVIQLFSFHFLGCTECFLYTLMAYDRFLAICKPLHYATIMTHRVCNSLALGTWLGGTIHSLFQTSFVFRLPFCGPNRVDYIFCDIPAMLRLACADTAINELVTFADIGFLALTCFMLILTSYGYIVAAILRIPSADGRRNAFSTCAAHLTVVIVYYVPCTFIYLRPCSQEPLDGVVAVFYTVITPLLNSIIYTLCNKEMKAALQRLGGHKEVQPH

SEQ ID NO: 59516 - protein, 311 aa, Homo sapiens
  Payload ID: 11652
  Gene Symbol: OR10G7
  Gene Name: olfactory receptor, family 10, subfamily G, member 7
  Uniprot ID: Q8NGN6
  ENSP ID: ENSP00000329689
MSNATLLTAFILTGLPHAPGLDAPLFGIFLVVYVLTVLGNLLILLVIRVDSHLHTPMYYFLTNLSFIDMWFSTVTVPKMLMTLVSPSGRTISFHSCVAQLYFFHFLGSTECFLYTVMSYDRYLAISYPLRYTNMMTGRSCALLATGTWLSGSLHSAVQTILTFHLPYCGPNQIQHYFCDAPPILKLACADTSANEMVIFVNIGLVASGCFVLIVLSYVSIVCSILRIRTSEGRHRAFQTCASHCIVVLCFFGPGLFIYLRPGSRDALHGVVAVFYTTLTPLFNPVVYTLRNKEVKKALLKLKNGSVFAQGE

SEQ ID NO: 59517 - protein, 311 aa, Homo sapiens
  Payload ID: 11653
  Gene Symbol: OR10G8
  Gene Name: olfactory receptor, family 10, subfamily G, member 8
  Uniprot ID: Q8NGN5
  ENSP ID: ENSP00000389072
MSNASLLTAFILMGLPHAPALDAPLFGVFLVVYVLTVLGNLLILLVIRVDSHLHTTMYYFLTNLSFIDMWFSTVTVPKLLMTLVFPSGRAISFHSCMAQLYFFHFLGGTECFLYRVMSCDRYLAISYPLRYTSMMTGRSCTLLATSTWLSGSLHSAVQAILTFHLPYCGPNWIQHYLCDAPPILKLACADTSAIETVIFVTVGIVASGCFVLIVLSYVSIVCSILRIRTSEGKHRAFQTCASHCIVVLCFFGPGLFIYLRPGSRKAVDGVVAVFYTVLTPLLNPVVYTLRNKEVKKALLKLKDKVAHSQSK

SEQ ID NO: 59518 - protein, 311 aa, Homo sapiens
  Payload ID: 11654
  Gene Symbol: OR10G9
  Gene Name: olfactory receptor, family 10, subfamily G, member 9
  Uniprot ID: Q8NGN4
  ENSP ID: ENSP00000364164
MSKTSLVTAFILTGLPHAPGLDAPLFGIFLVVYVLTVLGNLLILLVIRVDSHLHTPMYYFLTNLSFIDMWFSTVTVPKMLMTLVSPSGRAISFHSCVAQLYFFHFLGSTECFLYTVMSYDRYLAISYPLRYTSMMSGSRCALLATSTWLSGSLHSAVQTILTFHLPYCGPNQIQHYLCDAPPILKLACADTSANEMVIFVDIGLVASGCFLLIVLSYVSIVCSILRIHTSEGRHRAFQTCASHCIVVLCFFVPCVFIYLRPGSRDVVDGVVAIFYTVLTPLLNPVVYTLRNKEVKKAVLKLRDKVAHSQGE

SEQ ID NO: 59519 - protein, 318 aa, Homo sapiens
  Payload ID: 11655
  Gene Symbol: OR10H1
  Gene Name: olfactory receptor, family 10, subfamily H, member 1
  Uniprot ID: Q9Y4A9
  ENSP ID: ENSP00000335596
MQRANHSTVTQFILVGFSVFPHLQLMLFLLFLLMYLFTLLGNLLIMATVWSERSLHTPMYLFLCALSVSEILYTVAIIPRMLADLLSTQRSIAFLACASQMFFSFSFGFTHSFLLTVMGYDRYVAICHPLRYNVLMSPRGCACLVGCSWAGGLVMGMVVTSAIFHLAFCGHKEIHHFACHVPPLLKLACGDDVLVVAKGVGLVCITALLGCFLLILLSYAFIVAAILKIPSAEGRNKAFSTCASHLTVVVVHYGFASVIYLKPKSPQSLEGDTLMGITYTVLTPFLSPIIFSLRNKELKVAMKKTFFSKLYPEKNVMM

SEQ ID NO: 59520 - protein, 315 aa, Homo sapiens
  Payload ID: 11656
  Gene Symbol: OR10H2
  Gene Name: olfactory receptor, family 10, subfamily H, member 2
  Uniprot ID: O60403
  ENSP ID: ENSP00000306095
MLGLNHTSMSEFILVGFSAFPHLQLMLFLLFLLMYLFTLLGNLLIMATVWSERSLHTPMYLFLCVLSVSEILYTVAIIPRMLADLLSTQRSIAFLACASQMFFSFSFGFTHSFLLTVMGYDRYVAICHPLRYNVLMSPRGCACLVGCSWAGGSVMGMVVTSAIFQLTFCGSHEIQHFLCHVPPLLKLACGNNVPAVALGVGLVCIMALLGCFLLILLSYAFIVADILKIPSAEGRNKAFSTCASHLIVVIVHYGFASVIYLKPKGPHSQEGDTLMATTYAVLTPFLSPIIFSLRNKELKVAMKRTFLSTLYSSGT

SEQ ID NO: 59521 - protein, 316 aa, Homo sapiens
  Payload ID: 11657
  Gene Symbol: OR10H3
  Gene Name: olfactory receptor, family 10, subfamily H, member 3
  Uniprot ID: O60404
  ENSP ID: ENSP00000307130
MPGQNYRTISEFILSGFSAFPQQLLPVLFLLYLLMFLFTLLGNLLIMATVWIERRLHTPMYLFLCALSISEILFTVAITPRMLADLLFTHRSITFVACAIQMFFSFMFGFTHSFLLMVMGYDHYVTICHPLHYNMLMSPRGCAHLVAWTWAGGSVMGMMVTMMVFHLTFCGSNVIHHFLCHVLSLLKLACGSKTSSVIMGVMLVCVTALIGCLFLIILSFVFIVAAILRIPSAEGRHKTFSTCVSHLTVVVMHYSFASLIYLKPKGLHSMYSDALMATTYTVFTPFLSPIIFSLRNKELKNAINKNFCRRFCPLSS

SEQ ID NO: 59522 - protein, 316 aa, Homo sapiens
  Payload ID: 11658
  Gene Symbol: OR10H4
  Gene Name: olfactory receptor, family 10, subfamily H, member 4
  Uniprot ID: Q8NGA5
  ENSP ID: ENSP00000318834
MPSQNYSIISEFNLFGFSAFPQHLLPILFLLYLLMFLFTLLGNLLIMATIWIEHRLHTPMYLFLCTLSVSEILFTVAITPRMLADLLSTHHSITFVACANQMFFSFMFGFTHSFLLLVMGYDRYVAICHPLRYNVLMSPRDCAHLVACTWAGGSVMGMMVTTIVFHLTFCGSNVIHHFFCHVLSLLKLACENKTSSVIMGVMLVCVTALIGCLFLIILSYVFIVAAILRIPSAEGRHKTFSTCVSHLTVVVTHYSFASFIYLKPKGLHSMYSDALMATTYTVFTPFLSPIIFSLRNKELKNAINKNFYRKFCPPSS

SEQ ID NO: 59523 - protein, 315 aa, Homo sapiens
  Payload ID: 11659
  Gene Symbol: OR10H5
  Gene Name: olfactory receptor, family 10, subfamily H, member 5
  Uniprot ID: Q8NGA6
  ENSP ID: ENSP00000310704
MQGLNHTSVSEFILVGFSAFPHLQLMLFLLFLLMYLFTLLGNLLIMATVWSERSLHMPMYLFLCALSITEILYTVAIIPRMLADLLSTQRSIAFLACASQMFFSFSFGFTHSFLLTVMGYDRYVAICHPLRYNVLMSLRGCTCRVGCSWAGGLVMGMVVTSAIFHLAFCGHKEIHHFFCHVPPLLKLACGDDVLVVAKGVGLVCITALLGCFLLILLSYAFIVAAILKIPSAEGRNKAFSTCASHLTVVVVHYGFASVIYLKPKGPQSPEGDTLMGITYTVLTPFLSPIIFSLRNKELKVAMKKTCFTKLFPQNC

SEQ ID NO: 59524 - protein, 320 aa, Homo sapiens
  Payload ID: 11660
  Gene Symbol: OR10J1
  Gene Name: olfactory receptor, family 10, subfamily J, member 1
  Uniprot ID: P30954
  ENSP ID: ENSP00000399078
MLLCFRFGNQSMKRENFTLITDFVFQGFSSFHEQQITLFGVFLALYILTLAGNIIIVTIIRMDLHLHTPMYFFLSMLSTSETVYTLVILPRMLSSLVGMSQPISLAGCATQMFFFVTFGITNCFLLTAMGYDRYVAICNPLRYMVIMNKRLRIQLVLGACSIGLIVAITQVTSVFRLPFCARKVPHFFCDIRPVMKLSCIDTTVNEILTLIISVLVLVVPMGLVFISYVLIISTILKIASVEGRKKAFATCASHLTVVIVHYSCASIAYLKPKSENTREHDQLISVTYTVITPLLNPVVYTLRNKEVKDALCRAVGGKFS
